United States Patent 11,098,302 (IDENTIFICATION OF POLYNUCLEOTIDES ASSOCIATED WITH A SAMPLE) - sequence listing, part 32

SEQ ID NO: 107628 - DNA, 659 bp, Homo sapiens
  misc_feature: GYAE6OF01AVWQ6.12.1.A01.1.454.CMB.1.raw
  modified_base (218)..(218): a, c, t, g, unknown or other
  misc_feature (218)..(218): n is a, c, g, or t
  modified_base (271)..(271): a, c, t, g, unknown or other
  misc_feature (271)..(271): n is a, c, g, or t
tcagatacgacgtacacgaccggtgctcgatttagacgtctcatcagggggcaggagtcagtctcagtcaggacacagcatggacatgaggtccccgctcagctcctggggctcctgctactctggctccgaggtgccagatgtgacatccagatgacccagtctccatcctccctgtctgcatctgtagcagacagagtcaccatcacgttgccggnaagtcagaccatcagcagcttaatttaatgtatcagcaagaaaccagggaacncccgtaaggtcctgactctatgctgctattcctagtttcgacgtaaacggtcgggtacccagtacgaaggtttcgaggtggacgtagggtcgggtacgtagggactaggttacttaccgaccttaccgtacctaaccgtagttacgacgtcgtaacggtcctacgacccgtaaaccgttaggtaaagttacttttacccgtagttaaccctttaaacttttaccgtttaacgttcggttaacctaaacggtaacgttaacgtaaacccgttacccgtttaaccccgtacccgttaaccgtttaccggggacgggtaaccgggtacccgtaaggggttacggaacgtaacgtaaccgaaacggtacgtaggtacggactcgctaacccg

SEQ ID NO: 107629 - DNA, 284 bp, Homo sapiens
  misc_feature: GYAE6OF01C6Y1E.12.1.A01.1.454.CMB.1.raw
  modified_base (270)..(270): a, c, t, g, unknown or other
  misc_feature (270)..(270): n is a, c, g, or t
  modified_base (276)..(284): a, c, t, g, unknown or other
  misc_feature (276)..(284): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtacaacagagtaacagttaccctccactttcggcggaggaccaaggtggagatacaaacgactgtggctgcacatctgtctcatctccgcatcagatcgtcgtatctgagcggctggacaaggcncatagnnnnnnnnn

SEQ ID NO: 107630 - DNA, 660 bp, Homo sapiens
  misc_feature: GYAE6OF01BWW4E.12.1.A01.1.454.CMB.1.raw
tcagatacgacgtacacgaccggtgctcgatttagacgtctcatcaggggagtctcagtcaggacacagaatggacatgagggtccccgctcagctcctgggctcctgctactctggctccgaggtgccagatgtgacatccagatgacccagtctaccatcctccctgtctgcatctgtagcagacagagtcaccatccacgttcggccggactaagtccaacgtacccagtcgagcagtacttaattttaaacgttggtaactcgaagaccaaacggaaacccgaggggaaacctccccgtaaggtcctagacttcgtacgtgctgactacgtcctagtttacgacgtaaaggtccgggtacccagtaccgtaggttcgagtggcgaggtcgacgtcgtacgggactagtactttcaccttctaccacctacgtccgacggtccggttacacgtacctaaaccgttgtaacgttcttttacgaaccttaactttccgttctacgtaactaacgtaacgtaaccgttaaccctaacccttaccccgtccgttaccacccggtacgacccgggaaccgtaaggtacccgacggtacgtacggaacgttaaccgttaacgacggttcgacgtccgtcgaacctacctagttcgttcgtacc

SEQ ID NO: 107631 - DNA, 627 bp, Homo sapiens
  misc_feature: GYAE6OF01DYICX.12.1.A01.1.454.CMB.1.raw
  modified_base (500)..(500): a, c, t, g, unknown or other
  misc_feature (500)..(500): n is a, c, g, or t
  modified_base (514)..(514): a, c, t, g, unknown or other
  misc_feature (514)..(514): n is a, c, g, or t
  modified_base (520)..(520): a, c, t, g, unknown or other
  misc_feature (520)..(520): n is a, c, g, or t
  modified_base (574)..(574): a, c, t, g, unknown or other
  misc_feature (574)..(574): n is a, c, g, or t
  modified_base (614)..(614): a, c, t, g, unknown or other
  misc_feature (614)..(614): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatcgacccagtctcatcctccctgtcctgcatctgtagcagacagtacgtcacctatcgtacgttcggccggacaaggtcacgaccatcagctagtacttaatttaaagttggtatcgagacgaaacggaaaaccgaggggtaaacctccccgttaaggtcctagtaacttcctaagtcgctagacctaacttccgtaaggtttcgaacggttaaacgggttccgggtaaccctaagttaccggtaaagggtttccgaaagggttcggcgtacgggttgggtaccgtagggaactaggttactttccaactccgtacaactgtcagcctagtctagacctacaggaactttacgntactacttagttancgtaanactaggtaacttactaccctacccttctacggtgacgggacgtacgtagggtanacgtagtaaccaagtcggttgcggtactacgacctaactnttcgtcgttaccc

SEQ ID NO: 107632 - DNA, 661 bp, Homo sapiens
  misc_feature: GYAE6OF01CYK0H.12.1.A01.1.454.CMB.1.raw
  modified_base (278)..(278): a, c, t, g, unknown or other
  misc_feature (278)..(278): n is a, c, g, or t
tcagatacgacgtacacgaccggtgctcgatttagacgtctcatcagggggcaggagtcagtctcagtcaggacacagcatggacatgaggtccccgctcagctcctggggctcctgctactctggctccgaggtgccagatgtgacatccagatgacccagtctccatcctccctgtctgcatctgtagcagacagagtcaccatcacttggccgggcaagtcacgaccatcagcagacttaatttaaattgtatcagcaagaaaccgagggaaacncccgtaaggtcctagatctatgctgcatccgtagttacgacgtaaaggtcggggtacccagtaccgtaaggtttcgaggtcggtcgtagggttcgggtacgtagggaactaggttactttaccgtaccttcctaccaacctactacagtctaagtctacgaccaaccttaggaagttactttcgtacgtaaccttaaacttttacgttaccgttagtaaccgtaaacgtacggtaaaccgttaaaccttaccgtttaacccccgtacccgttaaccgggtttccgggaaccgggtaacgggtaacccgtaaggggtaacgggtaaacgtaccgtaaaccgtaaaaccggtacgttacgggtaggtcctaggtccctaaacccg

SEQ ID NO: 107633 - DNA, 288 bp, Homo sapiens
  misc_feature: GYAE6OF01DVTMA.12.1.A01.1.454.CMB.1.raw
  modified_base (281)..(288): a, c, t, g, unknown or other
  misc_feature (281)..(288): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcggctggcaaggcgcatagnnnnnnnn

SEQ ID NO: 107634 - DNA, 662 bp, Homo sapiens
  misc_feature: GYAE6OF01D8SA7.12.1.A01.1.454.CMB.1.raw
  modified_base (230)..(230): a, c, t, g, unknown or other
  misc_feature (230)..(230): n is a, c, g, or t
tcagatacgacgtacacgaccggtgctcgatttagacgtctcatcagggggcaggagtcagtctcagtcaggacacagcatggacatgagggtccccgctcagctccgtggggctcctgctactctggctccgaggtgccagatgtgacatccagatcgacccagtcctccactccctcctgtctgcatctgtagcagacagacgtcacctatctacgttcggccggganaagtcagaccatcagcagtacttaatttaagtgtatcagacaacgaaacgaggaacgacccgtaaggtcctagtactactagtcgtcgtcgtactacttacgtagtttacgaacgtaaacggttccgggtacctaagtacgtaacggttcgaagggtcggacgttagggtcgggtacggtaggactagttacttcctaccttcgtacctaccacgtacacgtacgtagtccgtacgaccgtaacgtagtaacgttacttacgtacgtaaccttaacgtttactaacttaccgtaacaaacgtaacgtaaccttaaccgtaccgtttaccccctacggttaacccgttcggaccggttacgggaccgggtaaccgtaagggtacggaactaaccggtaaacgtaaacggtcgttaggccgtagtccgtaaccg

SEQ ID NO: 107635 - DNA, 284 bp, Homo sapiens
  misc_feature: GYAE6OF01EPXMG.12.1.A01.1.454.CMB.1.raw
  modified_base (279)..(284): a, c, t, g, unknown or other
  misc_feature (279)..(284): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtggagatcaaacgactgtggctgcaccatctgtcttcatcttcccgcatctgatacgtcgtatctgagcggctggcaaggcgcatagnnnnnn

SEQ ID NO: 107636 - DNA, 328 bp, Homo sapiens
  misc_feature: GYAE6OF01DY5PM.12.1.A01.1.454.CMB.1.raw
  modified_base (289)..(289): a, c, t, g, unknown or other
  misc_feature (289)..(289): n is a, c, g, or t
  modified_base (295)..(328): a, c, t, g, unknown or other
  misc_feature (295)..(328): n is a, c, g, or t
tcagatacgacgtacacgaccggtgctcgatttagacgtctcatcagggatagaagttattcagcaggcacacaacagaggcagttccagatttcactctcaccatcagcagtctgcaactgagattctgcaacttattactgtcaacagagtaacagtttaccctcccacttttcggacggagggaccaaggtggagatacaaacgaactggtggctgcaccatctgttctcatccttcccgctatccgtgattaccgtcgttatctggagcgggtctggcaaggccncaagtnnnnnnnnnnnnnnnnnnnnnnnnnnnnnnnnnn

SEQ ID NO: 107637 - DNA, 848 bp, Homo sapiens
  misc_feature: GYAE6OF01DX5U1.12.1.A01.1.454.CMB.1.raw
  modified_base (203)..(203): a, c, t, g, unknown or other
  misc_feature (203)..(203): n is a, c, g, or t
tcagatacgacgtacacgaccggtgctcgatttagacgtctcatcgagggggcaggagtcagtctcagtcaggtcacagcatggacatgacgggtccccgctcagctccgtggggctcctgctactctggctccggaggtgccagatgtagacatccagctcgacccagtcctccactccctcctgtctgcatcgtagagganaacaaatcaaccatccgacgttcggaccgggactaaacggagtagttacttgacccgtaagtttaaattttaaaagttggtaaactaaccaaaaacgaaaaaacggcgaaaacggtacctaaaaaccggtccccaaaaaggtcccttttaccgtaggttaacttttaacgtcggccgttaccgtacccaaaccgtcggttaccggttaacgggaccggttaaaacggggggttttccggggtttacccccttaagggtaaaccgggttttaccgaaacggttcgggggtacccggttagggtacttaacccgggaaaggggtaccctaaaaggtttaaaaccttttccctccggaaacctacccggtaataactacggttaacgttaccgtaaccgtaacgtacgtaaaggttaaacgtaacttttaagtaccgttaacttttaaacgttttacttaaccgtttgaaccgttaagacgttaacgtaacggttacccgacggttaccctacccgtaacgtttaccgttacccgtttaaccggggaacccgaacgggtaccaacccggaccgaaccgtaaggttacgttaacgggaacgttacggacggttacgccgtaacggacacctacgttcgtcgtttacccg

SEQ ID NO: 107638 - DNA, 308 bp, Homo sapiens
  misc_feature: GYAE6OF01C5GVC.12.1.A01.1.454.CMB.1.raw
  modified_base (294)..(308): a, c, t, g, unknown or other
  misc_feature (294)..(308): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtggagatacaaacgactgtggctgcacatctgtcttcacttccgtcccgcattcagtactacgtcgtatctgacggcgggctcggacaacggcgactataggnnnnnnnnnnnnnnn

SEQ ID NO: 107639 - DNA, 615 bp, Homo sapiens
  misc_feature: GYAE6OF01BD7BM.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagcttaatttaaattggtatcgagacaacgaaaccgaggggaaacgacccccgtaaggtcctagtactctatcgctgcctactcgtagtttcgacgtaaaggtcgggtacccatacgaaggttcgaggtgacgtaggtgggtcgtggggactagtatttccacttctaccacctatacacgctacgtctacgaccgtaacctagaacgtactttcgtagtaccttaactttacttacctacgtaacaaacgtaagtaacgtaaaccgttacccgttaccccttacccgtaccggtttaccgggacgggtaacgggaccggtaagggtaggaacgtactaaccgaaacggtacgtggtcgacgtaccgactaaccgtcttcgtgttaccc

SEQ ID NO: 107640 - DNA, 743 bp, Homo sapiens
  misc_feature: GYAE6OF01AEPYG.12.1.A01.1.454.CMB.1.raw
  modified_base (736)..(736): a, c, t, g, unknown or other
  misc_feature (736)..(736): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatcgacccagtcctccactccctccctgtcctgctatctagtagacacgacagacgtccaaccatccacgttcggcccgggacaacgtcaagaccctatacagacagtacttaagttttaaagttggtatacgagaacaacgaaaccgaacgggaaccgtaccccgtaacggtcctaggtactactagtcgactcgtctacgttaccgtagtttcggaacgtaaacgggttcgggtaccctaagtacggttaacggtacggtacggttcggacggtacgggttacggggttacggtacggggtaactagtttaccttaccgtactaccgtccgtaaccctagttacccgaacgtaccttacggtaccgtaccggtaacccgttaaacggtaacggttaacttaacccgtttcgtacgtaaccttttaaacgtttacttacgtaactaaacgtaaaccgtagtaaaccgtaacccgttacccgttaaccctcccgttaacggttaccggggaaacgggtaccggaaccggttaacgggagtaacgaaccgtaaacgaacggtacggttcgaaccgtcgtaacnccgtacg

SEQ ID NO: 107641 - DNA, 763 bp, Homo sapiens
  misc_feature: GYAE6OF01EE3EL.12.1.A01.1.454.CMB.1.raw
  modified_base (442)..(442): a, c, t, g, unknown or other
  misc_feature (442)..(442): n is a, c, g, or t
  modified_base (562)..(562): a, c, t, g, unknown or other
  misc_feature (562)..(562): n is a, c, g, or t
tcagatacgacgtacacgaccggtgctcgatttagacgtctcatcaggggagtctcagtcaggacacagcatggacatggaggggtccccgctcagctccgtggggctcctgctactctggctccgaggtgccagatgtgacatccagatcgacccagtcctccactccctccctgtctgcatctgtacgacagacagacgtacaccgtatcctagtcggaccgggacaacgtcaaccgaccatcaagcactatttaaagtttaagttggtactacgagactaaacggaaaaccggaagggtaaacccgtacccgtaaacggtccgtagtcttactagttcgcctagtaccacgttacttaaggtttacggaacgttaaccggggtccggtacctaagtacggtaaggttacgagggttacggacgtagggtcgggttacgngggtaactagttactactaacgtcctacgtaccttacgacgtcggtctaacgttgacgtaaccctaaggtaataaccgtttattccggtaataaccttaagtttaaccgtaccggttaanaacgtaacgtaacggtaaaccgttaccctaacccgtttacccccgtaacggttcccggttaacgggggaacccggttaaaccggggaccggtaaagggtaacgggtaaaccgtacgaaaacccgggttaacccgtagtttacccggggaggaccttaacccgggaacctaacccgggttacttcccgttcgggtttacccc

SEQ ID NO: 107642 - DNA, 694 bp, Homo sapiens
  misc_feature: GYAE6OF01ASVTK.12.1.A01.1.454.CMB.1.raw
  modified_base (299)..(299): a, c, t, g, unknown or other
  misc_feature (299)..(299): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagacgtcaccatcacgttcgccgggcaacgtcagaccatcagcagtacttaatttaaattggtatcgagacaagaaaccgagggaactccccgtaaggtcctagactcgtancgctcgctactcctagtttacggaacgtaaagggtccggggtaccctaaagttaccgtaaagggtttacgtagggttacgtacgggtagggtttacggggtaccgttagggggtaaacctacggttaacgttttaccaccttaccgtaccaccctaacgtaccaacggtcctacgggttacccaacgtaacccaaacgtaacgaagttacttacgtcgtaactttaacctttattaccgtagtaacgaaactaaggtaaccgtaaccgtaccctttaccccgtaccgttaccggttacggaacgggtaccggtaccgtaagggtacggtaacgaacttaggaaaccgtacggtaggtacggtacgtacgacctacgttacgtccgttgttacccg

SEQ ID NO: 107643 - DNA, 546 bp, Homo sapiens
  misc_feature: GYAE6OF01EZI8T.12.1.A01.1.454.CMB.1.raw
  modified_base (182)..(182): a, c, t, g, unknown or other
  misc_feature (182)..(182): n is a, c, g, or t
  modified_base (263)..(263): a, c, t, g, unknown or other
  misc_feature (263)..(263): n is a, c, g, or t
  modified_base (392)..(392): a, c, t, g, unknown or other
  misc_feature (392)..(392): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtancagacagatcaccatcacttgccgggcaagtcagaccatcagcagctatttaattggtatcagcaagaaaccagggaaacnccccaaggtcctgatctatgctgcatcagtttgacaaagtgggtcccagtcaaggttcagtggcaggtcgggtcgtgggacagtattcgactctcaccgatccagcacgtctacgcaaacctgaacgtnttactcgacctaactttattacctgtacaactaacgtaacgtaacctaacgttacccccttacccgtaacgtttcgggacgggtacggtaccgaagggtacggagtaactacgaaacggtactgtacggctacgccaacctattccgtgttacc

SEQ ID NO: 107644 - DNA, 701 bp, Homo sapiens
  misc_feature: GYAE6OF01CXAPB.12.1.A01.1.454.CMB.1.raw
  modified_base (358)..(358): a, c, t, g, unknown or other
  misc_feature (358)..(358): n is a, c, g, or t
tcagatacgacgtacacgaccggtgctcgatttagacgtctcatcaggggagtctcagtcaggacacagcatggacatgacgggtccccgctcagctccgtggggctcctgctactctggctccgaggtcgccagatgtgacactccagactcgacccgtagtcctaccatcccctccctcgtctgctactcgtgtacgcaacgacgagtacacacctactacgtacgtacggccgagtacgacacgaccagacgagacgtacgttatttaaagtttaagtggttacaccgaacgacgaaacggtaaaaccgtaaccgggaaacctaccccggttaaagtccgtaactacttacgtanggtaccagtactaagtttacccgtggtacgtacggtaacggtccggaactagacggtaagtcgtggcggtaggtacgttcgggagtacggtattaccgttacgtctacgtccgtaactacacgtacgacgtctacgtcgtaacgactaaccgttagacttcgtacagttaaccgtaacttacgacgtaacctaaggaacctaaacggtaaccctttccgtaaacccgttcccgtaggtttaacccggaccgggtacgggaagtacgggtaagtacgacggtaactaacggaaccgttggacggttcaaccggtccaacgttaccctagttcctccgttaaccg

SEQ ID NO: 107645 - DNA, 782 bp, Homo sapiens
  misc_feature: GYAE6OF01C7LRH.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctcctgtctgcatctgtagcagacagagtccaccatcacgttggccgggacaagtcagaccatcagcagtctaatttaaatggtatcgagacaagaaaccgaagggaaacgccccgtaaggtcctgactctatcgactggacacttccgtagtttacgacgtaaacgggttcggggtacccaagtacgtaaacgggttcaagggttcggacgtagggttcggggtcgtaggggtacctaaggttacctttcgaacctccttaccgaacctacgttaccgaacgtaccgtaacggttacccgttacgtaaccgtaaaaccccgttagtaaacggttacgttttaccgtaacggtaaccctttaaaccctttttaacgtttaaccgttacggttaaacccgtaaaaccgttaacgggtaaacggtttaaacccgttacccggtttaacccccttacccggtttaaccggttttaccgggggaaccggggttaaaaccgggggtaaccgtaaacgggggttacgaaacgggttaaccgttaaaccggaaaacgggttaaccgttacgggttaccggtacgtacccggtaaccctacgtttaactccggtttccgtttaacccg

SEQ ID NO: 107646 - DNA, 363 bp, Homo sapiens
  misc_feature: GYAE6OF01BTLDA.12.1.A01.1.454.CMB.1.raw
  modified_base (132)..(132): a, c, t, g, unknown or other
  misc_feature (132)..(132): n is a, c, g, or t
  modified_base (145)..(145): a, c, t, g, unknown or other
  misc_feature (145)..(145): n is a, c, g, or t
  modified_base (206)..(206): a, c, t, g, unknown or other
  misc_feature (206)..(206): n is a, c, g, or t
  modified_base (288)..(292): a, c, t, g, unknown or other
  misc_feature (288)..(292): n is a, c, g, or t
  modified_base (294)..(296): a, c, t, g, unknown or other
  misc_feature (294)..(296): n is a, c, g, or t
  modified_base (298)..(298): a, c, t, g, unknown or other
  misc_feature (298)..(298): n is a, c, g, or t
  modified_base (300)..(301): a, c, t, g, unknown or other
  misc_feature (300)..(301): n is a, c, g, or t
  modified_base (303)..(303): a, c, t, g, unknown or other
  misc_feature (303)..(303): n is a, c, g, or t
  modified_base (305)..(307): a, c, t, g, unknown or other
  misc_feature (305)..(307): n is a, c, g, or t
  modified_base (310)..(312): a, c, t, g, unknown or other
  misc_feature (310)..(312): n is a, c, g, or t
  modified_base (314)..(314): a, c, t, g, unknown or other
  misc_feature (314)..(314): n is a, c, g, or t
  modified_base (317)..(363): a, c, t, g, unknown or other
  misc_feature (317)..(363): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagatttcngcaacttattacngtcaacagagtaacagttacccctccatttcggcgaggaccaaggtgagatcaaacgatgngctgcaccatctgtcttcatcctcccgctatctgattaccgtcgtatctggacggcgggtctggcaagggctcaattacggnnnnntnnnancnncntnnngtnnnantcnnnnnnnnnnnnnnnnnnnnnnnnnnnnnnnnnnnnnnnnnnnnnnn

SEQ ID NO: 107647 - DNA, 759 bp, Homo sapiens
  misc_feature: GYAE6OF01CA2JI.12.1.A01.1.454.CMB.1.raw
  modified_base (208)..(208): a, c, t, g, unknown or other
  misc_feature (208)..(208): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatccctccctgtctgcatctgtagcagacagatcacatcacttgccggnaagtcagaccatcagcagtacttaatttaaagtggtatcgagcaagaaaccgagggaaacgcccctaaggtccagatctatgctgcctaattccgagttttcgacgtaaaacggttcgggtacccctaagttacggtaaacgggtttccgaagggttcgggaaccgttaaggggttcggggtaccgttagggggaaccctaagggttaactttttaccgacctttacctaccctaaccgaacttacgaacgacgtaacgggtttacccgtacggtacctaaaacccggtttagggaaacttacgttttacctacgggtaacctttaaaccgtttttacttaaccgtacgggtttaacccaaaccggtaaggttaaacccgtttaaacccgttacccggtttaacccccctttacccgtttaaccgggttttccgggaacggggtaacggggtaaccctagggggttacgaaacggtaaccttaacggaaaaccggtacgtggtacccggtcttacgggaccctaacctacgtttaccgttggtttaacccc

SEQ ID NO: 107648 - DNA, 728 bp, Homo sapiens
  misc_feature: GYAE6OF01EW615.12.1.A01.1.454.CMB.1.raw
  modified_base (90)..(90): a, c, t, g, unknown or other
  misc_feature (90)..(90): n is a, c, g, or t
  modified_base (411)..(411): a, c, t, g, unknown or other
  misc_feature (411)..(411): n is a, c, g, or t
tcagatacgacgtacacgaccggtgctcgatttagacgtctcatcaggggagtctcagtcaggacacagcatggacatgagggtccccgntcagctcctggggctcctgctactctggctccgaggtgccagatgtgacatccagatgacccagtcctccatccctccctgtctgcatctgtagcaagacagacgtccaacctatccgtacgttcggaccgggactaaagtcaacgaccatccagccagtacttaatttaaagttggtactacgaagacgaaacggaaaacgaacgggaaaccgtaccccgtaaagggtcctaggtacttacgtaagtcgtactcgactaactccgtagtttgaacgtaaagggtcgggtacccaagttacgtaaaggttcgaggtacggngtaacgggtgggttaccggtagggtaactacggttactttaccgaccttactaccgaactacgtacgacgtacgtacgttccgtaacgaccgtaaacgtaaggtaacgttactttaccgtaacgtaaccttaaacgtttaacgttaacgtacggttaaccaaagtaaccggtaaacgtaaaccgttaacccgtttaaccccgttacccgtaacggtttaccgggaccgggtaaacgggtaacccgtaagggtacgaacgtaacgtaacgaaaccggtatacggtcgacgtacgtactacctacgttccgtcgttacg

SEQ ID NO: 107649 - DNA, 347 bp, Homo sapiens
  misc_feature: GYAE6OF01D9TDT.12.1.A01.1.454.CMB.1.raw
  modified_base (293)..(293): a, c, t, g, unknown or other
  misc_feature (293)..(293): n is a, c, g, or t
  modified_base (295)..(296): a, c, t, g, unknown or other
  misc_feature (295)..(296): n is a, c, g, or t
  modified_base (298)..(347): a, c, t, g, unknown or other
  misc_feature (298)..(347): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccctactttcggcggagggaccaaggtggagatacaaacggaactgtggctgccaccgatctgtcttcatcttcccgccatctcgtatacgtcgtatctgagcggctggactaaggcgacagtagncnncnnnnnnnnnnnnnnnnnnnnnnnnnnnnnnnnnnnnnnnnnnnnnnnnnn

SEQ ID NO: 107650 - DNA, 339 bp, Homo sapiens
  misc_feature: GYAE6OF01ARHD4.12.1.A01.1.454.CMB.1.raw
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (294)..(339): a, c, t, g, unknown or other
  misc_feature (294)..(339): n is a, c, g, or t
tcagatacgacgtacacgaccggtgctcgatttagacgtctcatcagggagtagaagttattcagcaggcacacaacagaggcagttccagatttcatctcaccatcagcagtctgccaacctgaagattctgcaacttattactgtcaacagagtaacagttaccctcccactttcggcggagggaccaaggtcggagatcaaacgacgtgtggctgcaccatctgtcttcatcttcccgcctatctgatacgtcgtatctgaggcgggctggcaaggcgacatagncntnannnnnnnnnnnnnnnnnnnnnnnnnnnnnnnnnnnnnnnnnnnnnn

SEQ ID NO: 107651 - DNA, 738 bp, Homo sapiens
  misc_feature: GYAE6OF01BNGPZ.12.1.A01.1.454.CMB.1.raw
tcagatacgacgtacacgaccggtgctcgatttagacgtctcatcagggcacagcatggacatggagggtccccgctcagctccgtggggctcctgctactctggctccgaggtgccagatgtgacatccagatcgacccagtcctccactcccgtccctgtctgcatcgtgtagcagactagacgtccaccagtcacgttggaccgggacaagtcaacaccagtcagctagtactttaaattaaagtgtactacgaagacaaacggaaccgaaggaaaccgtcccgtaaggtcctaggactactagtgactacgactacctacgttaggttacgaacggtaacggttcgggtaccctaagtaccggtaaacggttctaaggtcggtacgtagggttcgggtcgttaacgggaagttacgttacttaccctacgtacctaaccgtaaaccgcttaacgacgtaccggtaggtactaaccgtactaaaccggtaagtaacgtttactcgttaagtaaaccctttaaagtttaacgttacgtacggtaaactaacgaacggtaacgtttaacctaccccttacccggttaacggttaccggtacccggaacggggtacgtaaaccggtggtaaccggtaataaccgtaaacgaaaccggttaggtcgtacgggtctactaacccggtaactacgttaccttccggttaacctcggtaactttccccgtaaccttcgtacg

SEQ ID NO: 107652 - DNA, 745 bp, Homo sapiens
  misc_feature: GYAE6OF01AU8S0.12.1.A01.1.454.CMB.1.raw
  modified_base (210)..(210): a, c, t, g, unknown or other
  misc_feature (210)..(210): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggnaagtcagaccatcagcagactatttaaattggtatcagcagaaaccagggaacgcccctaaggtcctagatctatgctgcatcctagtttcgcgtaaaggtcggggtacccagtcgtaaggttccgaaggtcggactagggttcgggtacgtacggggacctaggtaacttttaccgaccgttccgtaaccgtaaccctaacgttaccgaacggtcccgtaacggttcccgttaaccgacccgttaaaacccgttaggtaaaaccggttaacgttttacccgtacgtaaacccgttaaaaccttttaactttaaccgtaaccgtttaacgtaaaaccgtaagggtaaccggttaaacccgtaacccggttttaacccccgttaccccgttaacgggtttccccggggtaacgggtaaccggggtaaccccgtaaagggggttaccgggaacgtaaacggtaccgtaaaacggtaaccgttacgggtacgggtacccgtaggtaccccaaccgttaacttcggttacgtttacccg

SEQ ID NO: 107653 - DNA, 304 bp, Homo sapiens
  misc_feature: GYAE6OF01AX18E.12.1.A01.1.454.CMB.1.raw
  modified_base (290)..(291): a, c, t, g, unknown or other
  misc_feature (290)..(291): n is a, c, g, or t
  modified_base (293)..(304): a, c, t, g, unknown or other
  misc_feature (293)..(304): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaaacgactgtggctgcaccatctgtcttcattccttcccgcctatctgactcgtcgtatctggacgcgggctgggacaggcgcagtagnngnnnnnnnnnnnn

SEQ ID NO: 107654 - DNA, 641 bp, Homo sapiens
  misc_feature: GYAE6OF01B1ZMF.12.1.A01.1.454.CMB.1.raw
tcagatacgacgtacacgaccggtgctcgatttagacgtctcatcagggcacagcatggacatgagggtccccgctcagctcctggggctcctgctactctggctccgaggtgccagatgtgacatccagatgacccagtctccatccctccctgtctgcatctgtagcagacagagtcaccatcacttgccgggcaagtcagaccatcagcagcttaattttaaattggtatcagacaaggaaaaccgaagggaaacgccccgtaaaggtcctagactctatgctgcatccgtagtttgacgtaaaggtcgggtaccctagtacgtaaggttcaggtggacgtaggtcgggtcgtagggactagtactttcacgtctaccaccatcgagctacgtctacgtaccaaccgttagaatactttctagtaccttaaactttagttactacgtactaaacgtacgtaacgttaaccgtaccgtttacccctaccgttaccggttacgggaccgggtaacgggtaacccgtaaggggtacgacgtaacgtaaccgaaaacgtaccgtggtaccggtcgtaccgactaccgttacgttcttaccggtttacttcctaacctttcccgtttccccgaccgttaaccg

SEQ ID NO: 107655 - DNA, 683 bp, Homo sapiens
  misc_feature: GYAE6OF01EM7XO.12.1.A01.1.454.CMB.1.raw
  modified_base (196)..(196): a, c, t, g, unknown or other
  misc_feature (196)..(196): n is a, c, g, or t
  modified_base (664)..(664): a, c, t, g, unknown or other
  misc_feature (664)..(664): n is a, c, g, or t
  modified_base (674)..(674): a, c, t, g, unknown or other
  misc_feature (674)..(674): n is a, c, g, or t
  modified_base (678)..(678): a, c, t, g, unknown or other
  misc_feature (678)..(678): n is a, c, g, or t
tcagatacgacgtacacgaccggtgctcgatttagacgtctcatcagggggcaggagtcagtctcagtcaggacacagcatggacatggagggtccccgctcagctcctggggctcctgctactctggctccgaggtgccagatgtgacatccagatcgacccagtcctccactccctcctgtctgctatctgtanctagacagagtcaccatctacgttcggccgggataaggtcacgaccatcagcagtactttaattttaaagtggttaactcgaacgtacgaaacggaaaacccgtaaggggaaaccgtccccgtaaacggttccctaggtactactacgtcgtactcggctaaccgttccgtaagttttacggacggtaaacggtcggggtaccctaagttaccggtaaggtttacgagggtcggacggttagggttacggggtcgtaacgggtaactacggtttacttaccgtaccttcctaaccgaactacgttaccgaaggtcctactccgtacgaccctaacccgtagtaaacgttccgttacgtacgtaccttaaacgtttcttaccgtactaacgtaacgtaacgtaacttaacccgtaacccttccgtaaccgttcggttacgggacgtacgggtacgagtaggatacgtanaacgtgtcgnccgnctacg

SEQ ID NO: 107656 - DNA, 718 bp, Homo sapiens
  misc_feature: GYAE6OF01ASFAB.12.1.A01.1.454.CMB.1.raw
  modified_base (188)..(188): a, c, t, g, unknown or other
  misc_feature (188)..(188): n is a, c, g, or t
tcagatacgacgtacacgaccggtgctcgatttagacgtctcatcaggggagtctcagtcaggacacagcatggacatgagggtccccgctcagctcctggggctcctgctgctctggcctcccaggtgccagatgtgacatccagttcgacccagtctccatcccttcctgtctgcatctatagganacagatcaccatcacttggccggcagtcgaggactattagactaattattaggctaggtatcacgcaaggaacgccgaagggaacgccccctaacgtcctagactctagtcggtcgacactaccctactttgctagttacggtcggggtacccaattccgtaaggttccgaggtcggactaggtcggtacgttccggtaggggaaccaggtaactttccgaaccttacgtacctaaacgtaactacccgaaccaccggtcccttacggaccgtaaccgtacccgttaaggtaacgttacgtttttacggaaccctttaaactttacgtttacctacgttaacccgttaaacgttacggtttttaactttaacccgttttacccctttaggtttacccgttttacccgggaccccgttacgggaccctaacgtaacggttaacgtaacgttacgtaaaccccgtaaaggttaacctggttaccgggtacttacgcccctaacccgtatttacccgttgttccctttacccg

SEQ ID NO: 107657 - DNA, 592 bp, Homo sapiens
  misc_feature: GYAE6OF01BGCE1.12.1.A01.1.454.CMB.1.raw
  modified_base (305)..(305): a, c, t, g, unknown or other
  misc_feature (305)..(305): n is a, c, g, or t
  modified_base (430)..(430): a, c, t, g, unknown or other
  misc_feature (430)..(430): n is a, c, g, or t
  modified_base (459)..(459): a, c, t, g, unknown or other
  misc_feature (459)..(459): n is a, c, g, or t
tcagatacgacgtacacgaccggtgctcgatttagacgtctcatcagggggagtctcagtcaggacacagcatggacatggagggtccccgctcagctcctggggctcctgctactctggctccgagggtgccagatggtgacatccagatgacccagtctccatcctccctgtctgcatctgtagcagacagagtcacatcacgttggccggacaagtcagaccatcagcagtcttaatttaagtgtatcagacaagaaacgacgggaaactccccgtaaggtcctagacttctagtcgcgtanctatccgtaggttacgacgtaaaggtcgggtaccagtacgtaaggttcgaaggtgacgtgggtcggtacgtagggactagtaccttcgactcgtaccactatacacgtctagtctagacaacgtnaacgtcttctagtaaccttaatacgttanactaaccgaatacggtaacgtaacttaccgttacccgtactacgggttccggaggtaacggatacgggtacgtaacgacgttacgaaacggtcgtacgggtcacgttcgaccgtactattcggttagttaccg

SEQ ID NO: 107658 - DNA, 709 bp, Homo sapiens
  misc_feature: GYAE6OF01CXK28.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtaccaccatacacgttcgccgggacaagtcaacgaccatcaagcagtacttaattttaaagttggtaatcgagacaacggaaaaccgaaggggaaacctacccgtaacggtcctagactactatcgctgacacgtaccgtagttagacgtaaaggttccgggtaccctatacgtaaggttactaaggtcggtacgtagggttcgggtacggtagggaacctaggttactttaccctacgttcctaacctaaccagttaccgaggtacctaacggttcctacgtaacccgtaaaccgttagaacgtacttttacgacgaaccttaacgtttaacgtatttaccgttaacgaaccgtaagtaaacgtaacgttaaccttaccccggtttaacccttcccggtaacggtttaccggggaacggggttaacccggtaaacggttaaggggtaacggaacggtaaacctaaacggtaaccggtaacgttcgggtacgtagtcccggtaaacccg

SEQ ID NO: 107659 - DNA, 657 bp, Homo sapiens
  misc_feature: GYAE6OF01BIVW9.12.1.A01.1.454.CMB.1.raw
  modified_base (543)..(543): a, c, t, g, unknown or other
  misc_feature (543)..(543): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatcgacccagtcctccatccctccctgtctgcatctgtagcagacagatccacatctacgttcggccggtacaagtcacgaccatacgagacagtacttaagtttaaagtcggtatcgaaggacctaaacggaaaaccggacggggaaacctacccccgtttaaagggtccctaggtaacttccgtaagtcgtacctggtacctacgtttaccgtaggttacgaaccgtaagggtccggtacctaagtacgtaacggttcgaggtaggcgtagggtcggtacggtggactagttactttaccgacttccgtaacgaccctagtacctagtacccgtagtcccgtaacgacctaaacgtaggtaaccttacgttgtaaccgtacgttaactttaacgtntaccgtaacgacgtaagttaccgtaactacccgttacccacgttcggtacggacggtacgagtacggtgacgactacgaacgtgtcgaggtcctaggaccattctgttacgtcc

SEQ ID NO: 107660 - DNA, 701 bp, Homo sapiens
  misc_feature: GYAE6OF01D08MU.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccactcctccctgtctgcatcgtgtagcagacagatcacagtcacgttggccggacaagtcagaccagtcagcaagtacttaagtttaaagttggtaatacgagaaccgaaacggaaaaccgaacgggaaaaccgtacccccgttaaaggtaccctaggtacttacttaagtcggtacgtagacctaacgtaccgttagtttagaaccgttaaagggtcgggtaccctaagtacgtaaggtcgaggtggactgggtgggtcgtaggactagttacttaccactacctaccgaactacgtacgaaacgttcgaagttccgacgaacaaaccgttagaagttacttctaacgtaacttaactttacgttacgtagtaacaaacgtaacgtaacgttaaccgttaaccgttaccccctaccgttaaccggtttccggggaaacgggtacgggtaaccgtaagggtaagggactaaacgttaaacccggaaaagttaccggtggagttccggtaactaacccgacgtttatcccggttacgttaaccc

SEQ ID NO: 107661 - DNA, 314 bp, Homo sapiens
  misc_feature: GYAE6OF01ATQ3K.12.1.A01.1.454.CMB.1.raw
  modified_base (295)..(296): a, c, t, g, unknown or other
  misc_feature (295)..(296): n is a, c, g, or t
  modified_base (298)..(314): a, c, t, g, unknown or other
  misc_feature (298)..(314): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttacccctcccactttcggcggagggaccaaggtggagatacaaacgactgtggctgcaccatctgtcttcacttccttcccgcatctgacttacgtcgtatcgtgacggcgggtctggacaaggcgacagtagnngnnnnnnnnnnnnnnnnn

SEQ ID NO: 107662 - DNA, 685 bp, Homo sapiens
  misc_feature: GYAE6OF01A91MC.12.1.A01.1.454.CMB.1.raw
tcagatacgacgtacacgaccggtgctcgatttagacgtctcatcaggggagtctcagtcaggacacagcatggacatggacgggtccccgctcagctccgtggggctcctgctactctggctccgaggtcgccagatgtgacatccagatcgacccagtcctccactccctccgtgtctgctatgtgagcagacagactccaccatcctacgttcggaccggacaacgtcacgaccagcgagacctagttaactttaagttttaaagttggtactacgaacggaaccgaaaccggaaaaccggaacgggtaaaccccgtaccccggttaacggtccttagtacttcgtacgtcgtccgtagtaccgttacgttaccgttaaggttaccgaacgtaaccggggttcccgtaacctagtacggttaacgtacggtagggttacggacggttacgggttcgggttacggtaacgggtacgtagtttcgtttacccacgttaccaccgtaacgtctacgacgtacgtacgtcgtaccgtacgtacgtatacgtactctactacttaactacttacgacgtaacataacgtactaccgtaccttacctacgttacggtacggaacggtacgacgtaggtacgaacgtacgtacaacggtcgaggtcgacgtcactacgtcttgtcgtac

SEQ ID NO: 107663 - DNA, 309 bp, Homo sapiens
  misc_feature: GYAE6OF01AZP1T.12.1.A01.1.454.CMB.1.raw
  modified_base (289)..(289): a, c, t, g, unknown or other
  misc_feature (289)..(289): n is a, c, g, or t
  modified_base (295)..(309): a, c, t, g, unknown or other
  misc_feature (295)..(309): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaaacagagtaacagttaccctcccacttcggcggagggaccaaggtggagatacaaaacgaactgtagctgccaccattctgtcttcacttccttcccgctatctgattacgtcgtatcgtgacgcgggtctggcaaggtcncatagnnnnnnnnnnnnnnn

SEQ ID NO: 107664 - DNA, 434 bp, Homo sapiens
  misc_feature: GYAE6OF01C43B8.12.1.A01.1.454.CMB.1.raw
  modified_base (127)..(127): a, c, t, g, unknown or other
  misc_feature (127)..(127): n is a, c, g, or t
  modified_base (400)..(400): a, c, t, g, unknown or other
  misc_feature (400)..(400): n is a, c, g, or t
  modified_base (402)..(434): a, c, t, g, unknown or other
  misc_feature (402)..(434): n is a, c, g, or t
tcagatacgacgtacacgaccggtgctcgatttagacgtctcatcagggatagaagttattcagcaggcacacaacagaggcagttccagatttcactctcaccatcagcagtctgcaactgaagtnttctgactaacttattactgtacaaacgagaacgtaaaccgactttaccccctaccctacgtttccgggaccgggaacgggaaaccgtaaggggtagggaacgtaacaaccgtaaaaacggtaactttcgggcgggtacctcgaaccctaaccctaagttcttcgttacctttacctaccgtttccccgttccccgacctaattccgttacgtaactacccggttgtaatcgtagggacggccggtcgtacgggacaagggtcgactaagagntnnnnnnnnnnnnnnnnnnnnnnnnnnnnnnnnn

SEQ ID NO: 107665 - DNA, 803 bp, Homo sapiens
  misc_feature: GYAE6OF01DF7XS.12.1.A01.1.454.CMB.1.raw
  modified_base (290)..(290): a, c, t, g, unknown or other
  misc_feature (290)..(290): n is a, c, g, or t
  modified_base (790)..(790): a, c, t, g, unknown or other
  misc_feature (790)..(790): n is a, c, g, or t
  modified_base (796)..(796): a, c, t, g, unknown or other
  misc_feature (796)..(796): n is a, c, g, or t
tcagatacgacgtacacgaccggtgctcgatttagacgtctcatcaagggaagggaaggggggcaggagtcagtctcagtcaggtcacagcatggacatggagggtccccgctcagcctccgtgggggctcctgctactctggctccggaggtgccagatgtagacactccagctacgacccagtcctccatccctccctgtctgcatctgtagagacaagtcacatcacgttcggccggacaagagtagtatcgactaacgtttaatttaaagtggtaaactacaaaanaaaagcaacggaccaaacgtacccaagtcctactagttatttagtcggcctacgaccctacgtacggttactacggtacggtaacggggtttcccgggttaccccgtaaacgtaacggggtttacccgtaaccggggttcgggttacccgggttagggtaaccgtcgggaaacggggtacgttaaacgtttaaaccgttttacctaacccgtacccgaaaccgttacgttaaccgtaacggttaacgttacccgtaaaccgtaacggttacccgtaaaggtaaagtacgtttaacgtttacgtaacctttaaacgtttactttaacgtctaaccgtacgtaacgtaaggttaacccgttacccggaccgttccctacccgtagtttaccccgttaaccggttcccgggaaaccggtaaaccgggacccgaccgggtaacccggacgtaacgggttacggttacgggaacgttaacgtcggtaccgtaccggtactaaccnccgttnttacccg

SEQ ID NO: 107666 - DNA, 342 bp, Homo sapiens
  misc_feature: GYAE6OF01EG2B8.12.1.A01.1.454.CMB.1.raw
  modified_base (323)..(342): a, c, t, g, unknown or other
  misc_feature (323)..(342): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaactttattactgtacaacagagtaacctacgttaccctccctactttcgggcggagggaccaagggtggagatacgaaaacgtaactgtggctcgacacctatcttgtccttcacgtccttcccgcatctagacttaccgtcgttaatctaggaggccggtcgtgggacaacgggcgaccgtagtagtnnnnnnnnnnnnnnnnnnnn

SEQ ID NO: 107667 - DNA, 727 bp, Homo sapiens
  misc_feature: GYAE6OF01C18ES.12.1.A01.1.454.CMB.1.raw
tcagatacgacgtacacgaccggtgctcgatttagacgtctcatcagggggcaggagtcagtctcagtcaggacacagcatggacatgacgggtccccgctcagctcctggggctcctgctactctggctccggaggtgccagatgtgacatccagatcgacccagtctccactcctccctgtctgcatctgtacgcagacagtacgtccaaccactcacgttcggccggacaagtcacgacactcgacgacagtacttaatttaagtgtatacagacgaagaacgacggaacgtaccgtacgtacgtcgactactatcgctacgactactacgtacgtacgtacgaacggtacggggtacctaacgtacgtacgttacgtacggtacggtacggtacggtacgggtcggtacggtacgtacgttacttaccgtacctaccgttacaacctacgtacgtacgacggttacgtcgttaccgtaccgtaacggtaacgtaagttacctttacgtacgtaacttaacttttaactttaacgttaccgttaaacgaaccgttaaggtaacccgttaaacccgttacccgttaccccgttttaaccccggttaccggtaaccgggggtaccggggaaaccgggtaaccggtaaaggggtaggtaaaccgtaaccgttaaacggaaccggttaaaccgggtcggttacgggtacctaccggtaccgtaacccg

SEQ ID NO: 107668 - DNA, 649 bp, Homo sapiens
  misc_feature: GYAE6OF01CMYOO.12.1.A01.1.454.CMB.1.raw
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
tcagatacgacgtacacgaccggtgctcgatttagacgtctcatcaggggagtctcagtcaggacacagcatggacagtgagggtccccgctcagctcctggggctcctgctactctggcctccgaggtgccagatgtcgacatccagatgacccagtctccatccctccctgtctgcagtctgtagcagacagacgtcaccatcactgccaggcgagtagaggactattacggtaaatttttaatggttacagtcaagaaaccagggaaacnccctaagacctcgtanacttcacgngcactaccaagtacggaatacgggtaccaaggtaggttcaggtggagtggagcgtagggacagtacttttacccgcaactatcgaagcaacgtcctagcacgtaccgtagtaacgtattccgtaagacctaaactaattactttactaggtacaaacgtagttaataaacgtacttacccgttacccgttaacgttaccgttttacgggacccggttaacgggaacctaagtccggtaggaagtaaccgtaacgaaaaaccggttctacgggtcggtaccttacggaacctaccggttaccttacttacccggttaccttaccgtaacccttcccgttaccccggtaaccc

SEQ ID NO: 107669 - DNA, 307 bp, Homo sapiens
  misc_feature: GYAE6OF01CWWL1.12.1.A01.1.454.CMB.1.raw
  modified_base (287)..(290): a, c, t, g, unknown or other
  misc_feature (287)..(290): n is a, c, g, or t
  modified_base (292)..(293): a, c, t, g, unknown or other
  misc_feature (292)..(293): n is a, c, g, or t
  modified_base (296)..(307): a, c, t, g, unknown or other
  misc_feature (296)..(307): n is a, c, g, or t
tcagatacgacgtacacgaccggtgctcgatttagacgtctcatcagggatagaagttattcagcaggcacacaacagaggcagttccagattttcaactgctcatcagcagtctgcaacctgaagattctgcaacttattactgtcaacagagtaacagttaccctcccactttcggcggagggaccaaggtggagatcaaacgaactggtggcttgcaccatctgtcttcattccttccgcctatctgatacgtgtatctgagcggtctggcaaggcgcagtagnnnnanngannnnnnnnnnnn

SEQ ID NO: 107670 - DNA, 440 bp, Homo sapiens
  misc_feature: GYAE6OF01DTB80.12.1.A01.1.454.CMB.1.raw
  modified_base (383)..(384): a, c, t, g, unknown or other
  misc_feature (383)..(384): n is a, c, g, or t
  modified_base (386)..(440): a, c, t, g, unknown or other
  misc_feature (386)..(440): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagtattctagctaacttatttactgtacaaacgaaggaactaaaccgaccgtttacccctcccgtaccgtttacgggcgggaagggacctaaaggggtggtaagacgtaacgaaaacgtacgtggtaggctagacccaacctagttcttcggttcccttactacctttccccgtcccgtacctaacgttctaagtaactacccggttgtaactcgtggaacgggtcggtcgtggaccgagggacctagaagttggcagnngnnnnnnnnnnnnnnnnnnnnnnnnnnnnnnnnnnnnnnnnnnnnnnnnnnnnnnn

SEQ ID NO: 107671 - DNA, 466 bp, Homo sapiens
  misc_feature: GYAE6OF01DWYB8.12.1.A01.1.454.CMB.1.raw
  modified_base (420)..(466): a, c, t, g, unknown or other
  misc_feature (420)..(466): n is a, c, g, or t
tcagatacgacgtacacgaccggtgctcgatttagacgtctcatcagggatagaagttattcagcaggcacacaacagaggcagttccagatttcaactgctcatcagcagtctgccaaccgtgaagattctgactaaacttattactgtacaacgagtaagtaactaccgtttaccccctccctacgtttccgggacgggacgggaaccgtaagggtggaaggtactaacgaaaaccggtaagtcgggtacggtcgtcggacctaaccctcgttcgttcgttcctttaccgtaaccttttccccgttaccccccgaccttacttccgtaaggtacgttaaccggtttccgttagtaccggtgggtaccgggccggggttacgacgggaccgtaacggggccgtacaaagtcgcgtaggnnnnnnnnnnnnnnnnnnnnnnnnnnnnnnnnnnnnnnnnnnnnnnn

SEQ ID NO: 107672 - DNA, 586 bp, Homo sapiens
  misc_feature: GYAE6OF01D2E95.12.1.A01.1.454.CMB.1.raw
  modified_base (221)..(221): a, c, t, g, unknown or other
  misc_feature (221)..(221): n is a, c, g, or t
  modified_base (279)..(279): a, c, t, g, unknown or other
  misc_feature (279)..(279): n is a, c, g, or t
  modified_base (300)..(300): a, c, t, g, unknown or other
  misc_feature (300)..(300): n is a, c, g, or t
  modified_base (455)..(455): a, c, t, g, unknown or other
  misc_feature (455)..(455): n is a, c, g, or t
  modified_base (544)..(544): a, c, t, g, unknown or other
  misc_feature (544)..(544): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtccacatcacttggccggganaagtcagaccatcagcagcttaatttaattggtatcagacagaaaaccgagggaaacncccgtaaggtcctgatctagngctgactagtacctagtttcgacgtaaggtccggggtacctaacgtcgtaacggttcgaggtacggcgtacggtgggtacgttcgggactaaggtctttcgactccgtaccaccatacagtcaagttcctagacctaactaggactattccgtanactaaacgtttataccttagtaccaagaggtaaacgtacctacgttaccccttaccgtacgtttccggaacgggtacggtaacagggtnaaacggtacacgaaacgtacgttacggtgacgtcgctaaccg

SEQ ID NO: 107673 - DNA, 732 bp, Homo sapiens
  misc_feature: GYAE6OF01DN9ND.12.1.A01.1.454.CMB.1.raw
  modified_base (201)..(201): a, c, t, g, unknown or other
  misc_feature (201)..(201): n is a, c, g, or t
  modified_base (282)..(282): a, c, t, g, unknown or other
  misc_feature (282)..(282): n is a, c, g, or t
tcagatacgacgtacacgaccggtgctcgatttagacgtctcatcaggggggcaggagtcagtctcagtcaggacacagcatggacatgacgggtccccgctcagctcctggggctcctgctactctggctccggaggtgccagatgtgacatccagatcgaccctagtcctccactccctccctgtcctgctatctgtancagacagactccaccatccacgttcggaccgggactaaaggtcaacgaccagtcagacagtactttaatttaaagttgtancgagacaaacgaaaaccggagggaaaccgaccccgttaacggtcctagtacgtactagtcgacgtcgactactccgttagtttacgacgtaaagggtccgggtacctaagtacgtaacggtcgaggtacggcgtagggttcgggtacggtggaactagttactttccacgttaccctacctaaccgtactacgaacgtcctagttaccgtacggaacctaacggtaagtaacgttcttagtaccgtaactttaacgtttagttaccgtagtaacccgtaaacgtacggttaaaccttaacccgtacccgtttaccccgtaacccggtttacgggttacccggggtaccggggtaaccggtaaaccgggtagggttaaacggtaagtaaacccggtaaacgaaaaccgggtccggttacggtaccggttacgtaacccgtccgtaaacccg

SEQ ID NO: 107674 - DNA, 644 bp, Homo sapiens
  misc_feature: GYAE6OF01DA50R.12.1.A01.1.454.CMB.1.raw
  modified_base (108)..(108): a, c, t, g, unknown or other
  misc_feature (108)..(108): n is a, c, g, or t
  modified_base (155)..(155): a, c, t, g, unknown or other
  misc_feature (155)..(155): n is a, c, g, or t
  modified_base (262)..(262): a, c, t, g, unknown or other
  misc_feature (262)..(262): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (480)..(480): a, c, t, g, unknown or other
  misc_feature (480)..(480): n is a, c, g, or t
  modified_base (499)..(499): a, c, t, g, unknown or other
  misc_feature (499)..(499): n is a, c, g, or t
tcagatacgacgtacacgaccggtgctcgatttagacgtctcatcaaggaaggagggggcaggagtcagtctcagtcaggtcacagcatggacatgacgggtccccgntcagctccgtggggcctcctgactactctggctccgaggtcgccagntgtgacatccagctacgacccagtcctacctactccctcctgtcctagcatcgtaggaaggacgaactaacgtccaccatcctacgttcggaccgggtactaacggntacgttatcgaccttaagttaatttaagtgtaataacgaaacaaagcgaagactaaacgacccaagtcctacgtataatttcgngctcgaccctacgngtccngacggtacgggtccgttccaggtagtccacggtggccgtagactacggaggtaactattaacgtttccactactaactgtacttagtacctcgaagcgttcaagattgttacttnttaaccttattactggtanacacgacgtacggtaccttcccggcccttacctacccgtaattccgttaaccggcggaaacccgagggacctaccggaccgtataaggggtaccgttggaaacccggtcgttacggtcggaccaccgttaactaccgtcgtttcc

SEQ ID NO: 107675 - DNA, 286 bp, Homo sapiens
  misc_feature: GYAE6OF01EQHA9.12.1.A01.1.454.CMB.1.raw
  modified_base (264)..(264): a, c, t, g, unknown or other
  misc_feature (264)..(264): n is a, c, g, or t
  modified_base (280)..(286): a, c, t, g, unknown or other
  misc_feature (280)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgactgtggctgcaccatctgtcttcatcttcccgctatctgatacgtcgtatctgagcggntggcaaggcgcatagnnnnnnn

SEQ ID NO: 107676 - DNA, 622 bp, Homo sapiens
  misc_feature: GYAE6OF01A6AK2.12.1.A01.1.454.CMB.1.raw
  modified_base (90)..(90): a, c, t, g, unknown or other
  misc_feature (90)..(90): n is a, c, g, or t
  modified_base (269)..(269): a, c, t, g, unknown or other
  misc_feature (269)..(269): n is a, c, g, or t
  modified_base (449)..(449): a, c, t, g, unknown or other
  misc_feature (449)..(449): n is a, c, g, or t
tcagatacgacgtacacgaccggtgctcgatttagacgtctcatcagggagtctcagtcaggacacagcatggacatggagggtccccgntcgagctcctggggctcctgctactctggctccgaggtgccagatgtgacatccagatcgacccagtctccatccctccctgtctgcatctgtagcagacagagtcaccatcacttgccgggcaagtcagaccatccagcagtcttaatttaatggtatcagcaagaaaccaggaaacnccctaaggtcctagattctatcgctgctatccgtagtttacgacgtaaacggttcgggtaccctagttaccgaaggtttacaggtggacgtaggtcgggttacaggggactaggttactttacaccgttcttaccacctagtccgtagccttaggtctaccgactaaaccgtgaacgttnttaccgtacgtaccttaaacgttttctaaccgtttagaacgaaacctaggtaacgtaacccgttaccgttaacccctccttaacgtttcggacggttaacgtaacggaccgtaaagggtgtaaacgtattaaccgaaacgtagttggacgactacacgtaactcgttgttacg

SEQ ID NO: 107677 - DNA, 721 bp, Homo sapiens
  misc_feature: GYAE6OF01AP1UA.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatccctccctgtctgcatctgtagcagacagacgtccaccatcacgttcggccgggcaagtcacgaccagtcagcagtcttaatttaaattggtatcagacaacgaaaacgagggaaacgccccgtaaggtcagtactctatgcctgctactcctaggtttacgacgtaaagggttccgggtacctaagtaccgtaaaggttcagggtcggacgtagggtcgggttagtacggggtactacgttacgtttcctaaccgttcctacctacctacgttacgacgtacgtacgttcctcggaccgtaaccgtaggtaactgtttaccgacgtaaccgttaaactttacgttaacgtttacgtaacgtaaaaccgtacggtaaaccgttacccggtttaaccctttaacccccgttaaccgttacccgtttcggaaacccgttccggggaaacgggttaccggtaaagggtaccggaacggttaaaccctaaccggtaaaacggttacggtacggtttaccggaccgttacggaaccccgaacccgtttagtttacccgtttccgg

SEQ ID NO: 107678 - DNA, 831 bp, Homo sapiens
  misc_feature: GYAE6OF01ACSW7.12.1.A01.1.454.CMB.1.raw
  modified_base (221)..(221): a, c, t, g, unknown or other
  misc_feature (221)..(221): n is a, c, g, or t
tcagatacgacgtacacgaccggtgctcgatttagacgtctcatcaggggagtctcagtcaggacacagcatggacatgagggtcaccgctcagctcctggggctcctgctactctggctccgaggtgccagatgtgacatccagatcgacccagtctccatccctccctgtctgcatctgtacgcagactagctccacctatctacgttcggccgggtanaacgtcacgacctagtcagacctagtactttaaagttttaaacgttcggtaatccgaacggaccgaaaacggtaaaacccgaacgggggtaacctacccccgttaaacgggtccttacgtaactaccttaagttcgacgttacgaccgttaacgttcccggttaaggtttacgaacgggttaaacggggttccgggtacccaaggttaccggtaacgggttcgtacgggtacggtacggttaggggttcgggttacggtagggtaaccttaggttacctttaccgtacccgtttacacctaccgtacgtttacgacggttcggttaccgtttacggaacccgtaaacccgttaaacggtaacggtttaaccgttacttacccgggttaacgttaaacccttttaacgttttaacgttaaccgtaccggtttaaaaccaaacgggttaaccgtaaaccgttaaaccccgttttccccgtaaccccgtttacccggttacggggtttacccgggaaacgggttaccgggaaacccgtaaggggttacgaaaccgttacgtaaacggtaaaccgtcgttacggcgaccgttaacgaccgtctttcgtgttccc

SEQ ID NO: 107679 - DNA, 352 bp, Homo sapiens
  misc_feature: GYAE6OF01EGS2M.12.1.A01.1.454.CMB.1.raw
  modified_base (303)..(352): a, c, t, g, unknown or other
  misc_feature (303)..(352): n is a, c, g, or t
tcagatacgacgtacacgaccggtgctcgattttagacgtctcatcaggggataagaagttattcagcaggcacacaacagaggcagttccagatttcactctcaccatcagcagtctgcaacctgaagattctgcaacttattactgtcaacagagtaacacgttaccctcccacgtttcggcggagggaccaagggtggagagtacgaaacgtaacgtaggtggctgcaccatctgtcttcactcttccgctatctgattacgtcgtatctgaggcggctggacgaaggcgctagtagtgnnnnnnnnnnnnnnnnnnnnnnnnnnnnnnnnnnnnnnnnnnnnnnnnnn

SEQ ID NO: 107680 - DNA, 391 bp, Homo sapiens
  misc_feature: GYAE6OF01E38HJ.12.1.A01.1.454.CMB.1.raw
  modified_base (319)..(320): a, c, t, g, unknown or other
  misc_feature (319)..(320): n is a, c, g, or t
  modified_base (330)..(391): a, c, t, g, unknown or other
  misc_feature (330)..(391): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaactttattactgtcaacagagtaacagttacccctccactttcggcggagggaccaaggtggagatcaaacgactgtggctgcacctatcttgtccttacacttccttcccgcctaattctaggataccggtcgtatccgtggaggccggggcttagggctaaaggggccgtactaacgtaggcnncgatctgctnnnnnnnnnnnnnnnnnnnnnnnnnnnnnnnnnnnnnnnnnnnnnnnnnnnnnnnnnnnnnn

SEQ ID NO: 107681 - DNA, 711 bp, Homo sapiens
  misc_feature: GYAE6OF01CJPM1.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatccctccctgtctgcatcgtgtagcaagacagagtcaccatcacgttggccgggacaagtcacgaccatcgagcagtacttaatttaaagttggtaactcgaagaccaaaggaaaccgaacggggtaaaccgccccgtaaggtcctagtatctagtcgctgactacttcctagttacgacgtaaacggttccgggtaccaacgttcgtaacggttcgagggtggtacgtaaggtcggggtacgtaacggggtactaagttacgtttacccacgtttacctaccaaccttaacgtaccgtaacgtccgtaacggttccctaggaaccctaaaccgtaggtaactactttaacgacgttaaccttaacttttacgttaacctcgttaaacgaaacgttaagtaaccggttaacccttacccgtttaaccccttcccggttaacggttcccgggaacggtaaccgggtaaccgtaggggtacgaaacgtaaccgtaaacgtaaacggtaaccgttggtaccggctaccgtaccaccgttattccgtctttaccg

SEQ ID NO: 107682 - DNA, 722 bp, Homo sapiens
  misc_feature: GYAE6OF01DZ695.12.1.A01.1.454.CMB.1.raw
  modified_base (153)..(153): a, c, t, g, unknown or other
  misc_feature (153)..(153): n is a, c, g, or t
  modified_base (386)..(386): a, c, t, g, unknown or other
  misc_feature (386)..(386): n is a, c, g, or t
  modified_base (512)..(512): a, c, t, g, unknown or other
  misc_feature (512)..(512): n is a, c, g, or t
  modified_base (521)..(521): a, c, t, g, unknown or other
  misc_feature (521)..(521): n is a, c, g, or t
tcagatacgacgtacacgaccggtgctcgatttagacgtctcatcagggggcaggagtcagtctcagtcaggacacagcatggacatgacggtccccgctcagctccgtggggcctcctgctactcgtggctccggaggtgccagatgtgacnctccagatccgaccctagtcctccacttccctcccgtagtcctgacctagtcgtagtagaccaaggaccaggtacctccaaccgtactaccgtacggttaccggaccgggtacaaccgtcaaccgacctataccgacggtacgtaacgttacttttaaagtttaagtcggtactacgacgtaacgaaaccggtaaacgaacgggtaacctacccggttaagtctgtaaccttntagtcgactcgactcgtacgtagttacggaacggttacggtccgtacctagtagtaacgttggagggtcgcggttagggtacggttaccgagtaacgtttacgttaccctactaccgtacccgtanaacccgttnacccaggtctaacgtcgaaccgtacttagtacggtactttaccgtataggtaaccctttagtaacgtactacgacgtaacgtaactacggttaaccttcccaacccggttacgttccgggacggaaaccgggtacgtaaccgggttaggaacgtaccaacggttaaaccgacggtagtcgttaacgcctccggtaaactcg

SEQ ID NO: 107683 - DNA, 744 bp, Homo sapiens
  misc_feature: GYAE6OF01BI7EF.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtcctccatccctccctgtcctgctatctgtagcagacagagtccaccatcgtacgttcggacccgggacaaagtcaacgaccatccagcagtacttaatttaaagttggtatcgagacaagaaaccgaggaaacgaccccgtaaggtcctagactactagtcgctacgacctacgttccgtaaggtttacgaacggtaaacgggtccgggtaacccatacggtaaggttccgaggtcggacgagggttgggacgtacggggtaacaagttacttaccgtactcctaccgaacctataccggagtaccgtacgtaccgtacggtaacctaaacccgtaaggtaaccgttattaccgtacgtaacccgtttaactttaacttaaccgttaagtaaccgtaaacgtaaacgtaaaccgttaaacccgtttaacccgtttaacccccccgttaaccgttacccgggtttaccggggaaaccgggtaaccgggtaaaccgggtaagggtaacggtaaccgtaaagtaacccgtaaacggtaaccgtcgggtaccgtacgtacgacccgtaaccttacgttaccgtcgtttaaccg

SEQ ID NO: 107684 - DNA, 283 bp, Homo sapiens
  misc_feature: GYAE6OF01BNCWE.12.1.A01.1.454.CMB.1.raw
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (275)..(283): a, c, t, g, unknown or other
  misc_feature (275)..(283): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatacaaacgactgtggctgcaccatctgtctcatctccgcatctgatacgtntatcctgagcggctggcaaggcnatgnnnnnnnnn

SEQ ID NO: 107685 - DNA, 674 bp, Homo sapiens
  misc_feature: GYAE6OF01DRSS4.12.1.A01.1.454.CMB.1.raw
tcagatacgacgtacacgaccggtgctcgatttagacgtctcatcaaggaagggaaggggggcaggagtcagtctcagtcaggtcacagcatggacatgggggtccccgctcagctcctggggctcctgctactctggctccgaggtgccagatgtgacatccagctgacccagtctccatcctcctgtctgcatcgtgtaggagacaaagtcaccatcacgttcggccgggactaacgagagttatcgacctacgttaatttaagttggtaatacaaaacaaaagcaaggacaaacgtcccaaagtcctacctagtaatttagtcgtactcgacccacctagttctaggtaccggtaaggggttccgggtttaccctagttaacggttaccacgttacgggcccggtaggtactacggacgggtaactaggttaactttacctaccgtacaacctatacgtaagttacgtacctacgacgtaccgtagaaacgtattacgttcgtaccttttaacgttatttacgtagtacaacgtacgtaacgtaccggttacccgacgtcccttacccgtacttccgtaccggttacggaaccgtaaaccgggaccacccggtacgacgtaacgtaggttacggaacgtacgtggcggtacaccgtaccactgttcttacg

SEQ ID NO: 107686 - DNA, 743 bp, Homo sapiens
  misc_feature: GYAE6OF01AMP8H.12.1.A01.1.454.CMB.1.raw
  modified_base (89)..(89): a, c, t, g, unknown or other
  misc_feature (89)..(89): n is a, c, g, or t
  modified_base (533)..(533): a, c, t, g, unknown or other
  misc_feature (533)..(533): n is a, c, g, or t
tcagatacgacgtacacgaccggtgctcgatttagacgtctcatcaggggagtctcagtcaggacacagcatggacatgaggtccccgntcagctcctggggctcctgctactctggctccgaggtgccagatgtgacatccagatgacccagtctccattcctcctgtctgcatctgtagcagacagacgtccactagtccacttcggcccgggactaaaggttccaggaccctaatcaaggcctacggtactttaattttaaagttcgggtaacttaccgaagaccgtaaacggaaaaccgaaggggtaaaaccgtcccccgttaaaaggggtcccctaggtaaacttccttaagttacggccttacggacctacttacccgtaggtttttacgaaccgttaaacggggtttcgggtacccctaggttacccgtaaacgggtttccgaacggttcggacgtagggttcggggttacgtcggggtacctaggtactttcgaccttactacacccgtattaccggacgtaccncggttcctaggaccctaaaccgttgaacgttactttccgagttaacctaatttactttacgtaacgtacgaaacgtacggaacttaacccgtaaccttaaccccgtacgtaccggtttaccgggacggtacggaccggttacgtaggacgtactaacggtaacgtacgtggtaccggaccttacggacctacgtacttcgtccggttacc

SEQ ID NO: 107687 - DNA, 804 bp, Homo sapiens
  misc_feature: GYAE6OF01DO2CM.12.1.A01.1.454.CMB.1.raw
  modified_base (645)..(645): a, c, t, g, unknown or other
  misc_feature (645)..(645): n is a, c, g, or t
  modified_base (750)..(750): a, c, t, g, unknown or other
  misc_feature (750)..(750): n is a, c, g, or t
  modified_base (791)..(791): a, c, t, g, unknown or other
  misc_feature (791)..(791): n is a, c, g, or t
tcagatacgacgtacacgaccggtgctcgatttagacgtctcatcaagggaagggaagggggcaggagtcagtctcagtcaggtcacagcatggacagtgacgggtccccgctcacgcctccgtggggcctccgtgctacgtcgtcggctccggaggtcgccagtagtgtcgacactccacgtctcgaccctgtcctaccacgttccctcccgtgtactcgactacgttcgtaggtaggacgaacgtaactccaacctactacctaccgttacggaccgggtacgttaacggagtacgttattcggacccttaaggtttaatttaaacgttcggtaactaaacgaaaacgtaaaacggtcgaacggtacctaaaccggttacccgaaacgttccttacgtagtttaccttacggtccgtacctaccgtacccgtaccgtagttacggttacggaaccggttaaccggggtttcccggttaacccgtacggttaaacggttccgacgggtccggggtacgtaggacgtaccggtaacggacttaacggtttacttccacgtacctacgtagtacgtacgttacgttacctaacgacggttacgtaaggtaacttacgttagtacgttacctttacgttacttacgngttacgagtacggttacgtaccggtacccgtacgtcccgttacccgtacgttacccgggtacgtaacccggcggtaaacggcccgtacggaccgtaagtaccggngggttaacccggacttcggtacggtacgtcccgactaccgnttcccggttaccg

SEQ ID NO: 107688 - DNA, 711 bp, Homo sapiens
  misc_feature: GYAE6OF01D53AV.12.1.A01.1.454.CMB.1.raw
tcagatacgacgtacacgaccggtgctcgatttagacgtctcatcaggggggtcgaggagtcagtctcagtcaggacacagcatggacatgacggtccccgctcagctccgtgggctcctgctactctggctccgaggtgccagtatgtgactatccaagatcgaaccctcgtcctccactccctcctgtcctgctagtctagacgcagacagaccgtccaacctactcctaacgttcggaccggtactaacgtcaacgacctatcaagtacagttactttaaagtttaagtcggtaactacgaacggtaacgaaaaccggaaaacccgaggggtaaaacccttccccgttaaagggtccctaaggtactttacgtgtcgtcgtcgacgtaccgtcggttaacggttacgaaaccggttacggtacccggtaccagtacggttaagtcgaagggtcggtacgtaggttggtcggacgtaactagttaccttacgacctacctacgtacctacgtacgtacgacttacgtacgtcgaacttaacggtaacgtacgtttcttacgacttaaaccgtactttcgtacgttacgaacgtaacgttaacgtaccgttaaccttaccgacccttacggtcggtaacgggacggtaacggcggttaagggcgtaaacgtcgaaacaacggtagtcggtaaccgctaccgtacgtaccg

SEQ ID NO: 107689 - DNA, 372 bp, Homo sapiens
  misc_feature: GYAE6OF01CM0Q9.12.1.A01.1.454.CMB.1.raw
  modified_base (346)..(372): a, c, t, g, unknown or other
  misc_feature (346)..(372): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgctaacttattactgtcaaacagagtaacacgttacccctcctacgttcgggacggacgggaccaagggtggagactacgaaaacgacgtgacggctgacctaccattctgttcttacacttccgttcccgacctatccttagacgttaccgttacgtaacttcgtagggacgggcccgggtacgtcgggaacgaacgggccgacaagtaggcannnnnnnnnnnnnnnnnnnnnnnnnnn

SEQ ID NO: 107690 - DNA, 810 bp, Homo sapiens
  misc_feature: GYAE6OF01ELX74.12.1.A01.1.454.CMB.1.raw
tcagatacgacgtacacgaccggtgctcgatttagacgtctcatcagggggagtctcagtcaggacacagcatggacatgagggtccccgctcagctcctggggctcctgctactctggctccgaggtcgccagatgtgacatccagatcgacccagtcctaccactccctcctgtctgctatcgtgtagcagacagacgtcaccatccacgttcggccgggacaacgtcacgaccatcgagctagtacttaatttaagttggtatccgaagacgtaaacggaaaccgaggaaccctccgtaagtccgtagactcgtagcgtcctagactacgttacgtaggtttacgacggtaagggtccggtacctagtacggtaaggtttcgacggtaggtaccgtagggttcgggaaccgtaggggtaacctagttacttaccctacgtacctaccgtaaccgcgtaccgaagtaccgttacgttacgacccgtaacgtaacgttaacggtaacgttaccgttacgttaacgggtaacccttttaacgtttacttaacccgggtactaacggttaaaccgtaaccggtttaacccgttaaacccgttaaaccccgtttaccccgttacccgggtttaacggtttcccggggaaaacccggggttaaccgggtaaccggtaaacggggtaaaccggaacggtttaaacccgtaaaccgggtaaaaccggtttcccgggtacgggtttaacccgggtacccgttaccgggaaacccctttacgggttaccttttccccggggttccgttttaaacccg

SEQ ID NO: 107691 - DNA, 781 bp, Homo sapiens
  misc_feature: GYAE6OF01BFU3F.12.1.A01.1.454.CMB.1.raw
tcagatacgacgtacacgaccggtgctcgatttagacgtctcatcagggagtctcagtcaggacacagcatggacatgacgggtccccgctcagctcctgggctcctgctactctggctccgaggtgccagatgtgacatccagatcgacccagtcctccatccctccctgtctgcatctgtagcagacagagtcacatcacttgccggataaacggtcaggtacccaagtcaaggtctacgtaccgttaagttttaaaacgttcggttaacttacgtaacggtaacgtaaaaccgggaaaaaccgtaacggggaaaacccggtacccccgttaaaaacggggttcccttaacgggtaaaccttccgttaaacgttaccggttaccgtcggtacccgtaacgttacccgttaagttttaccgtaacggtaaaacgggttccggggttaaccccttaaggttaaccggtaaaccggttttacgaacgggtacggtaccggtaagggttcgggtacggtacggggtaacctacggtactttaccggaccttaccgtaactacccgtaagttaccgaagtcccgtaacgttccgtaacggtaaccgtaaacgtaggtaacgttacttactacgtacttaacgtttacgttacgtacgtaacaagtacggtaaccgtaacctaccgtccccgttactcgggtacggtacgacggtaacggtcgtaccgtagtaccgtaacgaacggtcggtacgacgtctacgactaagttcgttacgtgtaccc

SEQ ID NO: 107692 - DNA, 588 bp, Homo sapiens
  misc_feature: GYAE6OF01BYAOP.12.1.A01.1.454.CMB.1.raw
  modified_base (184)..(184): a, c, t, g, unknown or other
  misc_feature (184)..(184): n is a, c, g, or t
  modified_base (275)..(275): a, c, t, g, unknown or other
  misc_feature (275)..(275): n is a, c, g, or t
  modified_base (516)..(516): a, c, t, g, unknown or other
  misc_feature (516)..(516): n is a, c, g, or t
  modified_base (579)..(579): a, c, t, g, unknown or other
  misc_feature (579)..(579): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtcctccatccctccctgtctgcatctgtancagacagatcaccatcacttggcccggacaagtcaagaccatcagcagtacttaatttaaagtggtatcagacaagaaaccgagggaaacnccccgtaaggtcctagactctatcggctgcatccgtagtttgacgtaaggttcgggtacccattacgaaggttcaaggtggacgtaagggttgggtacgtaggggactagttactttccaactcctacaacctagtccgaagtcctagtcgtacgtacctaaaccgttagaacgttacttcgtacgtacttaaccgtttacttacgtacgtacaaacgaagtacgtaactaccgttacccncgttacgtcggcgaaggcctaaggtacgagtactacgaaacggtctggtacgctgactacgtntcgtgtacc

SEQ ID NO: 107693 - DNA, 679 bp, Homo sapiens
  misc_feature: GYAE6OF01AFSCK.12.1.A01.1.454.CMB.1.raw
  modified_base (664)..(664): a, c, t, g, unknown or other
  misc_feature (664)..(664): n is a, c, g, or t
tcagatacgacgtacacgaccggtgctcgatttagacgtctcatcaggggggcaggagtcagtctcagtcaggacacagcatggacatggagggtccccgctcagctcctggggctcctgctactctggctccggaggtcgccagatgtgacatccagatcgacccagtcctaccactccctccctgtctgcatctgtacgcagacagactacaccatcctacgttcggaccgggacaacggtcacgaccatcgacgcagtactttaaagtttaacgttggtaactcgaagaacgaaacggtaaaacccggaacgggggtaaaccgtaccccgttaacggttacctagtacttacgtaatcgtcgtacgtactacgtacgttagttacgacgtaacgggtcggtaccagtacgtaggtcgaggtcgcgtagggtcggtacggtggactcgtacttcgtactctacgactactacgacgtcgtacgtcgtacgtacctaacgtacgtataccttacgtacgtaacttaactttaacgttacgtacgtaacgtaacgtacgttaacttaaccgttacccgttacccgtaccgtacggttacgggaaccgggtacggtaaccggtagggtacggacggtacgtaaacggaaccggtacgtacggtanccgtacgccgtaacg

SEQ ID NO: 107694 - DNA, 372 bp, Homo sapiens
  misc_feature: GYAE6OF01CDDY2.12.1.A01.1.454.CMB.1.raw
  modified_base (303)..(303): a, c, t, g, unknown or other
  misc_feature (303)..(303): n is a, c, g, or t
  modified_base (317)..(317): a, c, t, g, unknown or other
  misc_feature (317)..(317): n is a, c, g, or t
  modified_base (328)..(329): a, c, t, g, unknown or other
  misc_feature (328)..(329): n is a, c, g, or t
  modified_base (331)..(372): a, c, t, g, unknown or other
  misc_feature (331)..(372): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgctaactttattactgtacaaacagaacgtaactacgttaacccctccctacgtttcggcgggagggaacctaaagggtggagaactacaaaaacggaactggtggctgccaacctattctgtaccttcattcccttccgcctatctagatacgtcgtaatcgtgaggcggtncggacaagggtacncaatggcatcnngnnnnnnnnnnnnnnnnnnnnnnnnnnnnnnnnnnnnnnnnnn

SEQ ID NO: 107695 - DNA, 746 bp, Homo sapiens
  misc_feature: GYAE6OF01EZ3DE.12.1.A01.1.454.CMB.1.raw
  modified_base (183)..(183): a, c, t, g, unknown or other
  misc_feature (183)..(183): n is a, c, g, or t
tcagatacgacgtacacgaccggtgctcgatttagacgtctcatcaggggagtctcagtcaggacacaacatggacatgagggtccccgctcagttcctggggctcctgctactctggctccgaggtgccagatgtgacatccagatgacccagtctccatcctccctgtctgcatctgtacncgtaagacgagagtccaacctatcctacgttgcccgggactaagtcacgaccatcagaccagtaacttaatttaaagttggtatacgaagaccaacggaaaaccgaagggaaaccgacccggtagtaccctagtacttcgtagtcgtcgtagacctacgttacccgtagtttacgaaccggttaaacgggtaccggggtaccctaacgttaacggtaacgggtttaccgaagggtttcggacggttacgggttcgggtacggtaacggggtaacttaggttaaccgtttacctacccggttactaccctaccaccgttacacgactaacggtctaccgtacctaaccgtagtaacgtacgttcttaaacggtacctttaaactttaacgttactacgtaacaacgtaagtacgtaacgtacccgttaacccgtccgttaccgttacgggaccgggtaacggtaaccgtaaggggtacgaaacgtacgttaaacgtaaaccgtacggttaggtccgttaccggaccaaccgtacttacttcgtttacgtccttacgttaccccg

SEQ ID NO: 107696 - DNA, 753 bp, Homo sapiens
  misc_feature: GYAE6OF01AYK3Q.12.1.A01.1.454.CMB.1.raw
  modified_base (148)..(148): a, c, t, g, unknown or other
  misc_feature (148)..(148): n is a, c, g, or t
  modified_base (728)..(728): a, c, t, g, unknown or other
  misc_feature (728)..(728): n is a, c, g, or t
tcagatacgacgtacacgaccggtgctcgatttagacgtctcatcaggggagtctcagtcaggacacagcatggacatgagggtcccccgctcagctccctggggctcctgctactctggctccgaggtgccagatgtgacatccagntcgacccagtctccatccctccctgtctgctatctgtagcagacagtacgtccaaccatccctagttccggcccggggtactaacggttaccaacggaccaactcgagccgagtacttaattttaaagttcggtaactacgtaacgaccgtaaacggaaacccggaacggggtaacctacccccggttaacggtccttacggtacttcgtacgtcgtcccgtacaccgtaccgtacgtaggtttacgacgtaacgggtacccgggtaccctagttaacgtacggtacgtacggtacggtcgtaagggtcgggtacgtacgggacgttagttaccgtttaccaccgttccgtaccctactacgtaccgtacgtacctacggtccctacgtaccgtacgtaagtaccgttataccgtacgttaacttaccctttaacgtcgttaacgtaacctaaaggtaactaacccgggtttaacctacccgtttcccccgaacgtttaccgtaccgggggaacggaaccggtacctaaaccggtggtaacgggtactaaccggaacgtaaccggagttcgccggtaacncctacccggtatccgttgttacccg

SEQ ID NO: 107697 - DNA, 293 bp, Homo sapiens
  misc_feature: GYAE6OF01BO9PA.12.1.A01.1.454.CMB.1.raw
  modified_base (284)..(293): a, c, t, g, unknown or other
  misc_feature (284)..(293): n is a, c, g, or t
tcagatacgacgtacacgaccggtgctcgatttagacgtctcatcagggatagaagttattaagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcacatctgtcttcatcttcccgccatctgatacgtcgtatctgagcgggctggccaaggcgtcatagnnnnnnnnnn

SEQ ID NO: 107698 - DNA, 314 bp, Homo sapiens
  misc_feature: GYAE6OF01E3TC1.12.1.A01.1.454.CMB.1.raw
  modified_base (287)..(314): a, c, t, g, unknown or other
  misc_feature (287)..(314): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccagtttcggcggagggaccaaggtggagatcaaacgactgtggctgcacctatctgtctcatccttccgcatctgactacgtgtactctgagtcgggctggacaagggccgacatagnnnnnnnnnnnnnnnnnnnnnnnnnnnn

SEQ ID NO: 107699 - DNA, 967 bp, Homo sapiens
  misc_feature: GYAE6OF01D6B64.12.1.A01.1.454.CMB.1.raw
  modified_base (151)..(151): a, c, t, g, unknown or other
  misc_feature (151)..(151): n is a, c, g, or t
  modified_base (180)..(180): a, c, t, g, unknown or other
  misc_feature (180)..(180): n is a, c, g, or t
tcagatacgacgtacacgaccggtgctcgatttagacgtctcatcgaggggggcaggagtcagtctcagtcaggacacagcatggacatggacgggtccccgctcagctccgtggggctcctgctactcgtggctccgaggtcgcagatgngactatccagatcgaccctagtcctaccnccttcccttccgttcgtctcgcctacgttcgttagacgacacgaacgacggtacgtacctaacctaccttaccgtaaccggttccggacccgggaacgtaacggtaccgaacggaacctacgttacgacggtaacgtaaccgtttaacgttttaaaagttttaaaacggttacggtaactaccggtaaaacggaacctaaaaaaccggggggaaacccggggtaaaaccggggtaacccccgggtacccccgggtttaaacggggttaaccccgtagttaaccggtttactaccggttacggtaccggttaccgtaccttacgttttaacccggggttaggttttaaaccggaaaccgggggttaaaccgggtttacccgggggtaaccttaacgggttaacggtttaccgggttaggtaacggggttacggtaagggtttacgggggtacgggttacggttaacggggtaaaactttaccggtttacctttacccgtaacccgttacccggtaccttaaccggaacgttacggaaaccgttacggtaacccgttaacgggtacctaacccgggttaaacgttacgtacgtttaaccgtaccgtttacgtaaaccttacgtttaaccgttaagtaaccgtaaccgtaaagtaaccgttaacgttaccccgtacccggtttacccgtaccggtacccggggttaccgggaacggtaaccggggaacgtagggtaacggtactaaaccggtaacggttaaacggacgttcgtaaggcctacgtactacg

SEQ ID NO: 107700 - DNA, 812 bp, Homo sapiens
  misc_feature: GYAE6OF01AQZSU.12.1.A01.1.454.CMB.1.raw
  modified_base (91)..(91): a, c, t, g, unknown or other
  misc_feature (91)..(91): n is a, c, g, or t
  modified_base (223)..(223): a, c, t, g, unknown or other
  misc_feature (223)..(223): n is a, c, g, or t
  modified_base (587)..(587): a, c, t, g, unknown or other
  misc_feature (587)..(587): n is a, c, g, or t
  modified_base (672)..(672): a, c, t, g, unknown or other
  misc_feature (672)..(672): n is a, c, g, or t
  modified_base (774)..(774): a, c, t, g, unknown or other
  misc_feature (774)..(774): n is a, c, g, or t
  modified_base (789)..(789): a, c, t, g, unknown or other
  misc_feature (789)..(789): n is a, c, g, or t
tcagatacgacgtacacgaccggtgctcgatttagacgtctcatcaggggagtctcagtcaggacacagcatggacatgacgggtccccgntcagctccgtggggcctcctgactactctggcctccgaggtcgccagattggtagacatccagactcgacccagtcctccactcccgtcctgtcctgacctatcgttaggacgcaacgacagtactccaacnctaccgtacgttccggaccggactaaggtccaacgacctaagtccaagcctaaaggttaccttttaaaggttttaaacgttcggtaataccggaacgtaaccgaaaacgggtaaccggaaaccggggaaccctacccggtttaacggggtacctaacgtattaccggtaacgtcggtaccgtacgaccgttaacgttccggttaaggggtttacccaacgggtttaaaccgggggttccggtaaaccctaacggttaacgggttaaaccgggtttgaacccgggggttcgggttaacgtcgggggttacgtaaccgtaggggacctaagtttacgtttacccgacctttcgaaccacgttaacncggtaaccgtacgttacgtccgtaacgtaacgtacgtacgttaactaccggttactctaacgttaactttacgtactaccgtaanaacgtaacgttaaccggtaccttacccttaccgttaccgtacgggtaccggcggaacccggttaacgtcggtaacgtaaccgaaccgtaacgtacgggtaancgttaaccgggtacnccgtacacggtcttcgtcgtccg

SEQ ID NO: 107701 - DNA, 380 bp, Homo sapiens
  misc_feature: GYAE6OF01ET2FK.12.1.A01.1.454.CMB.1.raw
  modified_base (278)..(278): a, c, t, g, unknown or other
  misc_feature (278)..(278): n is a, c, g, or t
  modified_base (346)..(346): a, c, t, g, unknown or other
  misc_feature (346)..(346): n is a, c, g, or t
  modified_base (348)..(380): a, c, t, g, unknown or other
  misc_feature (348)..(380): n is a, c, g, or t
tcagatacgacgtacacgaccggtgctcgatttagacgtctcatcagggatagaagttattcagcaggcacacaacagagggcagttccagatttcaactgctcatcagcagtctgcaacctgaagattcgtgactaacttattactgtcaactagacgtaaacacgtttaacccctcccctaacgttttccgggcggtagggaccctaagggtcggagatacgaaaacgaactggtacggctcggaccacctatcctgttccttcacttccgtcccncctatcgtacgcttaccggtgttactcgtaggacggcgggcgtggaccgtaaaggccgtactaatgangnnnnnnnnnnnnnnnnnnnnnnnnnnnnnnnnn

SEQ ID NO: 107702 - DNA, 638 bp, Homo sapiens
  misc_feature: GYAE6OF01B8IRZ.12.1.A01.1.454.CMB.1.raw
  modified_base (233)..(233): a, c, t, g, unknown or other
  misc_feature (233)..(233): n is a, c, g, or t
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgagacatccagatcgacccagtcctccactccctccctgtctgcacttctgtagcgagacgagtacgtacaaccatcacttcggccgganaagcgagaccatcagcacgtattaatttaaagttgtancagacaaggtaaaccgacgggaaacncccctaaggtccttagacttactatcgacgctacacttccgtacgtttacgacgtaaacggttcgggtaaccctagtaccgtaaggtttcgaaggtcggagtacggtggtacggtacggacgtagtactttacgactcgttacacctagtcctaagcgtagtaccaggaaccttaacgtacggtaattacctactttcgaaccttaactttattaacccgagtaccaaagacgtaaacgttaaccttaccccgtacccttaccgtaaccgtagggtacggacccgggtaacagggtcgaagttaccgaaactaacgggacttaggacgtcgtacacgtacc

SEQ ID NO: 107703 - DNA, 822 bp, Homo sapiens
  misc_feature: GYAE6OF01BBACT.12.1.A01.1.454.CMB.1.raw
tcagatacgacgtacacgaccggtgctcgatttagacgtctcatcagggggcaggagtcagtctcagtcaggacacagcatggacatgacgggtccccgctcagctccgtggggcctcctgctactctggctccggaggtgccagatgtgacactccagtatcgaccctagtcctccactccctcctgtctgctatcgtgacacgagacagtacgtaccacctatccgtacgttccggaccggactacgtacaacgtactactcgagacgtaagttactttaaagttttaacggttgtaactacgaacgaccgaaacgtaaaccgggaaaccgggtaaccctacccggttaacggtaccgtacgtaacgtttacgtacgtcggtctacgtaacgtaccttacggttacggtttacggaacggttaaccggtccggtaccctaggttacgtacgggttacgtagacggtacgtacggggttaggtacggtaggacgttacttacttaccgtacttaccgaccgtaacgtaccgtacgtaacgtccgtacgttacccgtaaccgtaacgtaacgtaagtaacgttccgttaacttaccgttaaaccgttttaattccgtttaacgtaaccgtaaccgtaacgttaaccggttaacggttaacccttaacccccgtttacccgggtacccttaccggggttaacccgggtaaaccgggtaacccggttaacggggtaaagggtaccggtaaaccgtaaaccggttaaacccggtaacgggttacggtaccggttccggtaaaccgggtcccaacccgggtttacc

SEQ ID NO: 107704 - DNA, 833 bp, Homo sapiens
  misc_feature: GYAE6OF01AV70H.12.1.A01.1.454.CMB.1.raw
  modified_base (215)..(215): a, c, t, g, unknown or other
  misc_feature (215)..(215): n is a, c, g, or t
tcagatacgacgtacacgaccggtgctcgatttagacgtctcatcaagggaagggaagggggcaggagtcagtctcagtcaggtcacagcatggacatgacgggtccccgctcagcctccgtggggctcctgctactctggctccggaggtgccagatgtgacactccagctcgacccacgtccccatccctccctgtctgctatcgtgtagganaacaaacgtccaccatccacgttggcccgggtactaacggagtacgtattcgacctaacgttaattttaaagtcggtaactaacgaaaacaaaagtcgaaggtaaccaaacggtaccccaaaagtccttaccgtagttactttacgtcgccgttaccgcctaacccgtacgtacgtacggtacggttaacgggttccgggttacccgttaacggttaaccggttccgtaaccgggttacgggtacccggttaagggtaacccgtacgggtaacggtaaaccgtaacggtttaaacctttttaccgtacccttaccgtaacctacgttacgtaacggttaccgttaccgtaaccgtaacgtaccccggttaagtaaacgttaacgtttaacgtttacccggttaacttttaacccgtttaagttttaccggttagtaccgttagtaaccgttaaccgggttaccgtttaaccccgcgtttaaccccccttaccgtaaccgttacccgtttaaccgggtacccggaaccggttaaacgggaccctacccggaccggtacgtacgtagggttaacgacgtacggtcgtcggtacaccgggtaccaacgttcgtcgttaccg

SEQ ID NO: 107705 - DNA, 435 bp, Homo sapiens
  misc_feature: GYAE6OF01DL6OV.12.1.A01.1.454.CMB.1.raw
  modified_base (167)..(167): a, c, t, g, unknown or other
  misc_feature (167)..(167): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (376)..(435): a, c, t, g, unknown or other
  misc_feature (376)..(435): n is a, c, g, or t
tcagatacgacgtacacgaccggtgctcgatttagacgtctcatcagggatagaagttattcagcaggcacacaacagaggcagttccagatttcactctcaccatcagcagtctgcacctgaagtattctgacctaatttattactagtacaaactagaataaacncgttacccctccctacgtttcgggcggaagggaccgaaggtggagatacgaaaacgacgtggtagctagacctacctaattccgtcgttacctttctaccttcccttcccgcctagttccgtagaaacttaccggttcttacgtcgtaggaacgggcgggtaactgggacgaaggccgacgtagtaggcagctagtcagntgcngattnnnnnnnnnnnnnnnnnnnnnnnnnnnnnnnnnnnnnnnnnnnnnnnnnnnnnnnnnnnn

SEQ ID NO: 107706 - DNA, 427 bp, Homo sapiens
  misc_feature: GYAE6OF01CE1A4.12.1.A01.1.454.CMB.1.raw
  modified_base (73)..(73): a, c, t, g, unknown or other
  misc_feature (73)..(73): n is a, c, g, or t
  modified_base (255)..(255): a, c, t, g, unknown or other
  misc_feature (255)..(255): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (366)..(371): a, c, t, g, unknown or other
  misc_feature (366)..(371): n is a, c, g, or t
  modified_base (374)..(386): a, c, t, g, unknown or other
  misc_feature (374)..(386): n is a, c, g, or t
  modified_base (388)..(427): a, c, t, g, unknown or other
  misc_feature (388)..(427): n is a, c, g, or t
tcagatacgacgtacacgaccggtgctcgatttagacgtctcatcagggatagaagttattcagcaggcacanaacagaggcagttccagatttcactctcaccatcagcagtctgaccaaccttgaaagattcctggctaacttaattactgtcaaagagaagtaactacgttacccctccctaacgttttcgggccggaagggaccgtaaggtaggagaactacgaaaacgaacgtgtaggctacggcaaccnttacggtcttacttccgaatttcccgttccggcctacttcgaggtaacttacgggtacgtatctgggaacggtcgggactggaccgaggcgtcaagtagcngatgacncgnnnnnnagnnnnnnnnnnnnnannnnnnnnnnnnnnnnnnnnnnnnnnnnnnnnnnnnnnnn

SEQ ID NO: 107707 - DNA, 398 bp, Homo sapiens
  misc_feature: GYAE6OF01B7Q3B.12.1.A01.1.454.CMB.1.raw
  modified_base (136)..(136): a, c, t, g, unknown or other
  misc_feature (136)..(136): n is a, c, g, or t
  modified_base (370)..(372): a, c, t, g, unknown or other
  misc_feature (370)..(372): n is a, c, g, or t
  modified_base (375)..(398): a, c, t, g, unknown or other
  misc_feature (375)..(398): n is a, c, g, or t
tcagatacgacgtacacgaccggtgctcgattttagacgtctcatcagggatagaagttattcagcaggcacacaacagaggcagttccagatttcactctcaccatcagcagtctgacaacgtgaaagtctttcngactaactttattactgtacaaacgagtaactaacgtacctttacccctcccgttaagtttcgggacggtaagtacggaaaccgtaagggtcggaataacgtaacgaaaacggtactgggttcgcctagaccaaccttgttccgttcttccttactacttccccgttccgactatcgtagtacttcgtcgtatcggtggacggtcggtacgagggcgaacggccgtaatacgannngtnnnnnnnnnnnnnnnnnnnnnnnn

SEQ ID NO: 107708 - DNA, 913 bp, Homo sapiens
  misc_feature: GYAE6OF01E5KTL.12.1.A01.1.454.CMB.1.raw
tcagatacgacgtacacgaccggtgctcgatttagacgtctcatcaggggagtctcagtcaggacacagcatggacatggagggtccccgctcagctcccgtgggggcctcctgctactctggctccgaggtgcagatgtagacatccagatcgacccagtcctccactccctcctgtcgtgactatcgtagtagacgagacacgactaccacctactacctacgttccgggaccggtacaaccgtaccaaccgaccacgtacgaacgtacgtaacgttaaccttttaaagtttaaacgtttcggttaacaccggaacgtaaccggaaaaccggaaaccgggtaaaccgggtaaccccgtaccccgttaacggtcctagtaccttacgagtctacgtacgtaccgtaccgtttacggttacgttaacggtaaaccgggtaccggttacccggtaacttaacggtaccggttaaggttaccggtacggggtacgggttacgggttaccggggttcgggtaaccggtaacggttaaccgtacggtttaaccccttacccgtacccgttacctaacccgttaccgacgtaccggtaccgtaccgttaccgttaacccgtaaccggtaacccgttaaggttaaccgttaaccttacgtttaacccgttaaccgtttaaccgtttaacgtttaccgtaacgtaaccgtaaaccgttaacgtaaaccgttaacccgttaccccgtttaacccgtttaacccccggttacgggttacccggggtaaccggggaaccggtaacggggtaaccggtaaacgggtaaccgaacggttaaacccgtaaacggtacggttacgtacggtaccccgtaccggtacccttaccgtaacccgtttcgtttccgttacccgttaccccg

SEQ ID NO: 107709 - DNA, 342 bp, Homo sapiens
  misc_feature: GYAE6OF01DB5MV.12.1.A01.1.454.CMB.1.raw
  modified_base (323)..(342): a, c, t, g, unknown or other
  misc_feature (323)..(342): n is a, c, g, or t
tcagatacgacgtacacgaccggtgctcgatttagacgtctcatcagggatagaagttattcagcaggcacacaacagaggcagttccagatttcactctcaccatcagcagtctgcaacctgagattctgctaacttattactgtacaacagagtaactacgttaccctccctactttcgggcggaacgggacctaagggtggagatcgaaaacgactgtaggctgcaccatctgtctcgtacttccttccgctacttctagaacgttcgtaccgttactcgttaggacggtcggggcttggctaaacggcgacctagtagnnnnnnnnnnnnnnnnnnnn

SEQ ID NO: 107710 - DNA, 416 bp, Homo sapiens
  misc_feature: GYAE6OF01CJ3M0.12.1.A01.1.454.CMB.1.raw
  modified_base (124)..(124): a, c, t, g, unknown or other
  misc_feature (124)..(124): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (366)..(366): a, c, t, g, unknown or other
  misc_feature (366)..(366): n is a, c, g, or t
  modified_base (370)..(416): a, c, t, g, unknown or other
  misc_feature (370)..(416): n is a, c, g, or t
tcagatacgacgtacacgaccggtgctcgatttagacgtctcatcagggatagaagttattcagcaggcacacaacagaggcagttccagatttcaactgctcatcagcagtctgcaactgaanttctgctaacttattactgtacaacgagacgtaactcgtttaaccccctccctaacgtttccggggacgggaacgggaaccgtaagggtcgggaagtactaacgaaacgtaaccgtggtacgggcttcgaccnccatccttgtaccttntaccttcccgttcccgcctattcgtcgtaaccttacggtcgttatccgtaggccggcgggtacgtggacccgaaggcgacctagtaggctagngctnnnnnnnnnnnnnnnnnnnnnnnnnnnnnnnnnnnnnnnnnnnnnnn

SEQ ID NO: 107711 - DNA, 314 bp, Homo sapiens
  misc_feature: GYAE6OF01BBPBV.12.1.A01.1.454.CMB.1.raw
  modified_base (216)..(216): a, c, t, g, unknown or other
  misc_feature (216)..(216): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (298)..(301): a, c, t, g, unknown or other
  misc_feature (298)..(301): n is a, c, g, or t
  modified_base (304)..(314): a, c, t, g, unknown or other
  misc_feature (304)..(314): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgctaacttagttactgtcaacgagtagtaactacgttacccctccacgtttcggcggaggaccaggtggagatcgaaacgagtgnggctgaccaccatctgtctcacttcctcccgacatctaggactacggtntntcgngacggcggactggacgaggcgacatgnnnngannnnnnnnnnn

SEQ ID NO: 107712 - DNA, 781 bp, Homo sapiens
  misc_feature: GYAE6OF01D6O9U.12.1.A01.1.454.CMB.1.raw
  modified_base (92)..(92): a, c, t, g, unknown or other
  misc_feature (92)..(92): n is a, c, g, or t
  modified_base (158)..(158): a, c, t, g, unknown or other
  misc_feature (158)..(158): n is a, c, g, or t
tcagatacgacgtacacgaccggtgctcgatttagacgtctcatcaggggtagtctcagtcaggacacagctatggacatgagggtccccgntcagctcctggggctccgtgctactcgtgctccgaggtgcagagtgtgacatccagtatcgacccngtctccgatcctccgtgtactgctagtcgtgtacggacagaacaggtacgtaccaaccgtagtactacggttcgaccggactaacgtcacgtaccaagtccgtagcgtaacgtactttaagtttaaggttacgtacgtacccaaggtaccgaaacggtaaacccggtaggtaaacccgtaccccggttaacggtacccgtagtaactaccgttaagtcgtaccgtgacgtattaccgtagttacgacgtaacgggttcgtacccgtatacggtaacgtcgtaaggtcgtagaggttcgggtactcggtaaactacgttaccttcgaaccgttccgaactaacgtacgtacgtaaccggtcgtaccggttacgtacgaccgttaacgtacggtaacgttaacgttaccgtacgttaaccgtttacgttaacgttaccgttacctacgtaaccgtaacggtaacgtaccgttaaccgttacccgttaaccgttaccggttaccgggacggttaacggtaaccggtaaccggtaacggtaacggtttacgaaccggttaaaccggtaacggttacggtacggtaccgttaacggtacccgtacttacgttaccgtacgttaacccg

SEQ ID NO: 107713 - DNA, 522 bp, Homo sapiens
  misc_feature: GYAE6OF01B6IWZ.12.1.A01.1.454.CMB.1.raw
  modified_base (113)..(113): a, c, t, g, unknown or other
  misc_feature (113)..(113): n is a, c, g, or t
  modified_base (439)..(439): a, c, t, g, unknown or other
  misc_feature (439)..(439): n is a, c, g, or t
  modified_base (448)..(449): a, c, t, g, unknown or other
  misc_feature (448)..(449): n is a, c, g, or t
  modified_base (451)..(451): a, c, t, g, unknown or other
  misc_feature (451)..(451): n is a, c, g, or t
  modified_base (453)..(457): a, c, t, g, unknown or other
  misc_feature (453)..(457): n is a, c, g, or t
  modified_base (459)..(461): a, c, t, g, unknown or other
  misc_feature (459)..(461): n is a, c, g, or t
  modified_base (463)..(522): a, c, t, g, unknown or other
  misc_feature (463)..(522): n is a, c, g, or t
tcagatacgacgtacacgaccggtgctcgattttagacgtctcatcaggggatagaagttattcagcaggcacacaacagaggcagttccagtatttcactctccaccatcancagtctgaccaaccttagaagtactttcgagtaccttaaactttaacttacgttagtaaccaaaacgtaaggtaaccgttaaacccttaccgtttaacccccccttaccccgttaaccggttttccgggaacggggaaccgggaaccgtaagggtacgggaacgtactaaccgaaaacgtacgtgggtagctacgaccaacgtacttcttcgtaccttacctaccttcccgttaccccgaccttcgtacctagtaccgttaccgtacgttacgtaccggtaggaccgggtccggtacggacggacggaccggacgtacgtaagtgntagccgagnngncnnnnngnnngnnnnnnnnnnnnnnnnnnnnnnnnnnnnnnnnnnnnnnnnnnnnnnnnnnnnnnnnnnnn

SEQ ID NO: 107714 - DNA, 414 bp, Homo sapiens
  misc_feature: GYAE6OF01BSAXO.12.1.A01.1.454.CMB.1.raw
  modified_base (341)..(342): a, c, t, g, unknown or other
  misc_feature (341)..(342): n is a, c, g, or t
  modified_base (350)..(352): a, c, t, g, unknown or other
  misc_feature (350)..(352): n is a, c, g, or t
  modified_base (354)..(414): a, c, t, g, unknown or other
  misc_feature (354)..(414): n is a, c, g, or t
tcagatacgacgtacacgaccggtgctcgatttagacgtctcatcagggatagaagttattcagcaggcacacaaacagaggcagttccagatttcaactgctcatcagcagtctgcaaacctgaaagattctgactaaacttattactgtacaaacagaagtaaacacgttacccctaccctacgtttccgggcgggaacgggaccaaagggtggaagaactaccgaaaaacggaactggtaggctgaccaaccatcttacgtccttacactaccttcccgacctatcagtactacgtctaatcgaggacgcgggctgggacgaacggcgacaagtacgnnactagatnnnannnnnnnnnnnnnnnnnnnnnnnnnnnnnnnnnnnnnnnnnnnnnnnnnnnnnnnnnnnnn

SEQ ID NO: 107715 - DNA, 715 bp, Homo sapiens
  misc_feature: GYAE6OF01D644W.12.1.A01.1.454.CMB.1.raw
  modified_base (389)..(389): a, c, t, g, unknown or other
  misc_feature (389)..(389): n is a, c, g, or t
  modified_base (443)..(443): a, c, t, g, unknown or other
  misc_feature (443)..(443): n is a, c, g, or t
  modified_base (451)..(451): a, c, t, g, unknown or other
  misc_feature (451)..(451): n is a, c, g, or t
  modified_base (613)..(613): a, c, t, g, unknown or other
  misc_feature (613)..(613): n is a, c, g, or t
  modified_base (681)..(681): a, c, t, g, unknown or other
  misc_feature (681)..(681): n is a, c, g, or t
  modified_base (687)..(687): a, c, t, g, unknown or other
  misc_feature (687)..(687): n is a, c, g, or t
tcagatacgacgtacacgaccggtgctcgatttagacgtctcatcaggggagtctcagtcaggacacagcatggacatgagggtccccgctcagctcctggggctcctgctactctgctccgaggtcgccagatgtcgacatccagactcgaccacgtctccacttccctccttgtctgcctagtcgtagtacgcgaacgacgacggtactccaacctacgtacctaacggtttcgggacccgggaacgtaacggtaccaacgaaccgtagtaccgacggtacctagttaaccttttaaagttttaaacgttggtaactacgaacgtaacgaaaaccgggtaaaccgaacgggtaaccctaccccggttaaggtcctagtacttacgtntgctacgacctagttcgtagttacgagtaacggtcgtactacgtcgacggttancggtcggngtcggttacggtcgacggactagttacgttaccaacgtctacctaacgtcgtacgtcgactcggtcaacgtaactacgtaagtacgttctacggtacttaacttaacgttactttacgaacgtagttaaactaacggttaacccttactacccggtttaccncccggtttaacgggtcggaaacggtacggaaccgtaggggtacaaacggtacgtaacgtaggtaccgnggtacnccgtacgcctacgtacttcgtgtaaccc

SEQ ID NO: 107716 - DNA, 727 bp, Homo sapiens
  misc_feature: GYAE6OF01DLTTK.12.1.A01.1.454.CMB.1.raw
  modified_base (91)..(91): a, c, t, g, unknown or other
  misc_feature (91)..(91): n is a, c, g, or t
  modified_base (222)..(222): a, c, t, g, unknown or other
  misc_feature (222)..(222): n is a, c, g, or t
tcagatacgacgtacacgaccggtgctcgatttagacgtctcatcagggggagtctcagtcaggacacagcatggacatgagggtccccgntcagctcctggggctcctgctactctggctccgaggtgccagatgtgacatccagatcgacccagtctccactccctccctgtctgcatctgtagcagacgagacgtccaccattccacttcggccggganacgtcaacgtaccactcgagacagtactttaaagttttaagttaggttactacgaagacaaacggaaaaccgaaacgggaaccgtaccccggttaaggtccgtacgtatactatcggacgtgacctactacgtaggttacgacgtaacgggtccgggtacctagttacgtaaggtcagggtgacggtggtcgggtacgtaggactacgttacttaccgtcctacgtaccactaacgtcgaaccgtacacggttacgtacgaaccgtaaaccgttacgtaacgtacgtttctacgtaaccttttaacttttaacctacttaaccgtactaaacgtaacgttaaaccgttaaccgttacccgtttacccctaccggttaccggggttcccggaaccggggtaaccggttaaacgggaccggttaggtaaccgttaaccgaaacggtaacggttacggtacggtacggtaccgttcaacgtaccctttaagtccgttaggttaccccg

SEQ ID NO: 107717 - DNA, 704 bp, Homo sapiens
  misc_feature: GYAE6OF01B80AL.12.1.A01.1.454.CMB.1.raw
  modified_base (75)..(75): a, c, t, g, unknown or other
  misc_feature (75)..(75): n is a, c, g, or t
  modified_base (279)..(279): a, c, t, g, unknown or other
  misc_feature (279)..(279): n is a, c, g, or t
  modified_base (383)..(383): a, c, t, g, unknown or other
  misc_feature (383)..(383): n is a, c, g, or t
  modified_base (643)..(643): a, c, t, g, unknown or other
  misc_feature (643)..(643): n is a, c, g, or t
tcagatacgacgtacacgaccggtgctcgatttagacgtctcatcagggcacagcatggacatgagggtccccgntcagctcctggggctcctgctactctggctccgaggtgccagatgtgacatccagatcgacccagtctccatccctccctgtctgctatctgtagcagacagagtcaccatccgacgttggccgggacaacggtcacgacctataccagcctagtactttaattttaaagttggtatcgagacgaacgaaaccgaagggaaccncccgttaaggtcctagtactcttagtcgctcgactacgttaccgtaggtttcgaaccgtaaagggttcgggtaccctaagtacgttaacggttcagggtacggnggtaaggttcgggtacgtagggacctaaggttactttacaccgtactacaaacgtaactaccacgtacgtccctagccgtacgtaccgttaaggaacgttttacgtttacgaaccgttaacttttaacgttaccgtaagtaacctaaagtttacggttttactttaaccgtttacccgtacgtttacgttccgggacccgttaggacccgtaatacggtaagtaactacgtaacgtaacgtagttcggtaacgtccgtanaccccgttaacttggtccctatttacccgttactaccttacccggtccaccttaggttccg

SEQ ID NO: 107718 - DNA, 785 bp, Homo sapiens
  misc_feature: GYAE6OF01BUGNO.12.1.A01.1.454.CMB.1.raw
  modified_base (759)..(759): a, c, t, g, unknown or other
  misc_feature (759)..(759): n is a, c, g, or t
  modified_base (777)..(777): a, c, t, g, unknown or other
  misc_feature (777)..(777): n is a, c, g, or t
tcagatacgacgtacacgaccggtgctcgatttagacgtctcatcagggggcaggagtcagtctcagtcaggacacagcatggacagtgagggtccccgctcagctccgtggggctcctgctactcgtggctccgaggtcgccagatgtgacatccagatcgaccctagtctcccacttccctccgtgtctgctatcgtgtacgcgaagacgagtcgtacccaacgtattaccgtaccgttcggaccggtactaacgtccaacgacctaactcgaacgtacgtaacgtacttttaaagttttaaaggttgtaacgtacaacggaacgaaaacgtaaaccggaaccgggtaacctacccggtaaggttcctagtactaccgtatcgtacgtacgtaccttacgtaccgttagtttccgaaaccggttaacggtccggtaaccctagtttaccggaacggtttcggtaacggtcggtacgggtacgggttcgggtaacggtacggtacttacgtttccttaccgtacgttaccaaccctaagtaccggttacacgggttaccctacgtttacccgaacgtaacttaaaccggttagtaaccgtttcgtttaaccaacggttaaccctttaaggtttaacctacggtactaaaccgaacgtacttaaaccgtttacccgtaccccgttaccggttaccgtaccgggtaccgggacggttaacgacccgggtaaggacggtaaactaccgtaaccggtaacgngttacccgtagcgtaacncccgtacg

SEQ ID NO: 107719 - DNA, 728 bp, Homo sapiens
  misc_feature: GYAE6OF01B16PS.12.1.A01.1.454.CMB.1.raw
  modified_base (134)..(134): a, c, t, g, unknown or other
  misc_feature (134)..(134): n is a, c, g, or t
  modified_base (174)..(174): a, c, t, g, unknown or other
  misc_feature (174)..(174): n is a, c, g, or t
  modified_base (475)..(475): a, c, t, g, unknown or other
  misc_feature (475)..(475): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtcgccagntgtgacatccagatcgacccagtcctccattccctccctntctgctatctgtacgcaacgacagacgtaccacgatcctacgtcggacccgggacaaggtcacgaccatcgacgacgagtaacttaagtttaagtgttacacgagacgtaaacgaaaccggaggtaacccgaccccgttaaggtcctaggtactcgtagtacgtctacggactacgttacgttagttacgaacggtaacgggttccggtaccctacggttaacgtacggttacggaggtacggcgttacgggtcgggtacgtacgggtactagttaccttacgtacctcctaccgtaaccngtacctacggtacctacggtaccgtacgtaacctaacggttagtacgttacttaccggtacttaacccgtttaacttacgttaccgtacgtaaaccacggtaacgttaccgttaacccgttacccgttaccccgttacggttaccggtacggggtaaccggtaccgggtacgtagggtaaccggaagtaaccgtaaccgaaacggttcggacggtcgttacgtacgtaccgttactcgttacgcgtttacccg

SEQ ID NO: 107720 - DNA, 722 bp, Homo sapiens
  misc_feature: GYAE6OF01ALB8W.12.1.A01.1.454.CMB.1.raw
  modified_base (230)..(230): a, c, t, g, unknown or other
  misc_feature (230)..(230): n is a, c, g, or t
tcagatacgacgtacacgaccggtgctcgatttagacgtctcatcagggggcaggagtcagtctcagtcaggacacagcatcggacatgagggtccccgctcagctcctgggctcctgctactctggctccggaggtgccagatgtgtacatccagattcgacccagtctccatcctcctgtctgcatctgtacgcagacacgcgtccaccgctcacgttcggccggganaacgtcaacgaccatcgagacctacgtacttaattttaaagttggtatcgacgtacgaaacgaaacccgaacggggaaccgtacccctaagggtacctggtacttctagttcgctacgactaactccgttagttcgacgtaaacgggttcggtacccagttacgtaaggtttcgaggtggacgttggtcgggttacgtggaacgtagttaacttccgacgttccacctaacctactacgaacgtcgtacgtccgtacgtaaccttaacgtacgtaagtacctttacgtgtaacccttttaagtttaccgttacgtacgtaaccgtaaacgtaacggttaccttaaaccgtttaccccgtttaccccttacccggttacggttacccggggaacgggtaaccggggaaaccgttaggggttaggtaacgttacccgtaaaccggtaaaccggttacggttacggtacgggtaccctcggaacccgttaacccg

SEQ ID NO: 107721 - DNA, 452 bp, Homo sapiens
  misc_feature: GYAE6OF01DCNCJ.12.1.A01.1.454.CMB.1.raw
  modified_base (113)..(113): a, c, t, g, unknown or other
  misc_feature (113)..(113): n is a, c, g, or t
  modified_base (216)..(216): a, c, t, g, unknown or other
  misc_feature (216)..(216): n is a, c, g, or t
  modified_base (376)..(376): a, c, t, g, unknown or other
  misc_feature (376)..(376): n is a, c, g, or t
  modified_base (381)..(452): a, c, t, g, unknown or other
  misc_feature (381)..(452): n is a, c, g, or t
tcagatacgacgtacacgaccggtgctcgatttagacgtctcatcagggatagaagttattcagcaggcacacaacagaggcagttccagatttcaatgctcatcagcagtcngcaactgaagtattctgactaactttattactgtacaaacagaagtaacctacgttacccctccctacgttccggggcggaagggaccgtaaagggtcggaanaacgtaacgaaaacgtaggtgtacggctacggacctaaccgtcttacgttcgttacttccgactttccctcccgaccttagttcctagtaaccgttacgttccgtattccggtaggccgggccgggtcgtacgggacgtaaccgggcctagtaagtacgntcacnnnnnnnnnnnnnnnnnnnnnnnnnnnnnnnnnnnnnnnnnnnnnnnnnnnnnnnnnnnnnnnnnnnnnnnn

SEQ ID NO: 107722 - DNA, 288 bp, Homo sapiens; identical to SEQ ID NO: 107383
  misc_feature: GYAE6OF02F6R0W.12.1.A01.1.454.CMB.1.raw
  modified_base (283)..(288): a, c, t, g, unknown or other
  misc_feature (283)..(288): n is a, c, g, or t

SEQ ID NO: 107723 - DNA, 283 bp, Homo sapiens
  misc_feature: GYAE6OF02GT25H.12.1.A01.1.454.CMB.1.raw
  modified_base (281)..(283): a, c, t, g, unknown or other
  misc_feature (281)..(283): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggagggaccaaggtggagatcaaacgactgtggctgacaccatctgtcttcatcttccgccatctgatacgtcgtatctgagtcgggctggcaaggcgcatagnnn

SEQ ID NO: 107724 - DNA, 285 bp, Homo sapiens; identical to SEQ ID NO: 107400
  misc_feature: GYAE6OF02G8AZA.12.1.A01.1.454.CMB.1.raw
  modified_base (282)..(285): a, c, t, g, unknown or other
  misc_feature (282)..(285): n is a, c, g, or t

SEQ ID NO: 107725 - DNA, 286 bp, Homo sapiens; identical to SEQ ID NO: 107379
  misc_feature: GYAE6OF02HT2N7.12.1.A01.1.454.CMB.1.raw
  modified_base (283)..(286): a, c, t, g, unknown or other
  misc_feature (283)..(286): n is a, c, g, or t

SEQ ID NO: 107726 - DNA, 287 bp, Homo sapiens
  misc_feature: GYAE6OF02GF9IB.12.1.A01.1.454.CMB.1.raw
  modified_base (282)..(287): a, c, t, g, unknown or other
  misc_feature (282)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtggagatcaaacgaactgtggctgcaccatctgtcttcatcttcccgccatctgatacgtcgtatctgagcgggctggcaaggcgcatagnnnnnn

SEQ ID NO: 107727 - DNA, 285 bp, Homo sapiens; identical to SEQ ID NO: 107400
  misc_feature: GYAE6OF02GP32X.12.1.A01.1.454.CMB.1.raw
  modified_base (282)..(285): a, c, t, g, unknown or other
  misc_feature (282)..(285): n is a, c, g, or t

SEQ ID NO: 107728 - DNA, 286 bp, Homo sapiens
  misc_feature: GYAE6OF02H6RRX.12.1.A01.1.454.CMB.1.raw
  modified_base (281)..(286): a, c, t, g, unknown or other
  misc_feature (281)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcaccatctgtcttcatcttcccgcatctgatacgtcgtatctgagcgggctggcaaggcgcatagnnnnnn

SEQ ID NO: 107729 - DNA, 288 bp, Homo sapiens
  misc_feature: GYAE6OF02HK2JD.12.1.A01.1.454.CMB.1.raw
  modified_base (283)..(288): a, c, t, g, unknown or other
  misc_feature (283)..(288): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaaccgtggctgcaccatctgtcttcatcttcccgccatctgatacgtcgtatctgagcgggctggcaaggcgcatagnnnnnn

SEQ ID NO: 107730 - DNA, 287 bp, Homo sapiens
  misc_feature: GYAE6OF02HH27D.12.1.A01.1.454.CMB.1.raw
  modified_base (281)..(287): a, c, t, g, unknown or other
  misc_feature (281)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcgggctggcaaggcgcatagnnnnnnn

SEQ ID NO: 107731 - DNA, 287 bp, Homo sapiens; identical to SEQ ID NO: 107404
  misc_feature: GYAE6OF02FPBOG.12.1.A01.1.454.CMB.1.raw
  modified_base (283)..(287): a, c, t, g, unknown or other
  misc_feature (283)..(287): n is a, c, g, or t

SEQ ID NO: 107732 - DNA, 310 bp, Homo sapiens
  misc_feature: GYAE6OF02IA0D3.12.1.A01.1.454.CMB.1.raw
  modified_base (286)..(310): a, c, t, g, unknown or other
  misc_feature (286)..(310): n is a, c, g, or t
tcagatacgacgtacacgaccggtgctcgatttagacgtctcatcagggatagaagttagttcagcaggcacacaacagaggcagttccagatttcactctccaccatcagcaggtctgcaacctgaagattctgcaacttattactgtcaacagagtaacagttaccctccactttcggcgagggaccaaggtcggagatcaaacgaactgtggctgcaccatctgtcttcatcttcccgcatctgatacgtcgttatctgagcgggctggacaaggcgcatagnnnnnnnnnnnnnnnnnnnnnnnnn

SEQ ID NO: 107733 - DNA, 484 bp, Homo sapiens
  misc_feature: GYAE6OF02GVM02.12.1.A01.1.454.CMB.1.raw
  modified_base (323)..(323): a, c, t, g, unknown or other
  misc_feature (323)..(323): n is a, c, g, or t
  modified_base (470)..(470): a, c, t, g, unknown or other
  misc_feature (470)..(470): n is a, c, g, or t
tcagatacgacgtacacgaccggtgctcgatttagacgtctcatcagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtggttcccgtnaaggttcactggccgtggatcaggacagaatttactctcaccatcagtagtctacagcctgaagatattgcttacttattactgtcagcagagttaccgcgctcccatcactttcggcaagggacacgacgcagattggacgaatgngctgcacatctgtc

SEQ ID NO: 107734 - DNA, 288 bp, Homo sapiens; identical to SEQ ID NO: 107456
  misc_feature: GYAE6OF02GZLO7.12.1.A01.1.454.CMB.1.raw
  modified_base (282)..(288): a, c, t, g, unknown or other
  misc_feature (282)..(288): n is a, c, g, or t

SEQ ID NO: 107735 - DNA, 288 bp, Homo sapiens; identical to SEQ ID NO: 107383
  misc_feature: GYAE6OF02JEOKO.12.1.A01.1.454.CMB.1.raw
  modified_base (283)..(288): a, c, t, g, unknown or other
  misc_feature (283)..(288): n is a, c, g, or t

SEQ ID NO: 107736 - DNA, 286 bp, Homo sapiens
  misc_feature: GYAE6OF02ITEG9.12.1.A01.1.454.CMB.1.raw
  modified_base (281)..(286): a, c, t, g, unknown or other
  misc_feature (281)..(286): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcgggctggcaaggcgcatagnnnnnn

SEQ ID NO: 107737 - DNA, 286 bp, Homo sapiens; identical to SEQ ID NO: 107445
  misc_feature: GYAE6OF02I20C6.12.1.A01.1.454.CMB.1.raw
  modified_base (282)..(286): a, c, t, g, unknown or other
  misc_feature (282)..(286): n is a, c, g, or t

SEQ ID NO: 107738 - DNA, 299 bp, Homo sapiens
  misc_feature: GYAE6OF02F7LYX.12.1.A01.1.454.CMB.1.raw
  modified_base (263)..(263): a, c, t, g, unknown or other
  misc_feature (263)..(263): n is a, c, g, or t
  modified_base (287)..(299): a, c, t, g, unknown or other
  misc_feature (287)..(299): n is a, c, g, or t
tcagatacgacgtacacgaccggtgctcgatttagacgtctcatcagggagtagaagttattcagcaggcacacgaacagaggcagttccagatttcaactgctcactcagcagtctgcaacctgaagattctgcaacttattactgtcaacagagtaacagttaccctcccatttcggcggagggacccaaggtgagatcaaacggaactgtggctgcaccatctgtcttcatcttcccgcatctgatacgtcgtatctgancgggctagggccaaggcgcatagnnnnnnnnnnnnn

SEQ ID NO: 107739 - DNA, 285 bp, Homo sapiens; identical to SEQ ID NO: 107558
  misc_feature: GYAE6OF02GQW96.12.1.A01.1.454.CMB.1.raw
  modified_base (281)..(285): a, c, t, g, unknown or other
  misc_feature (281)..(285): n is a, c, g, or t

SEQ ID NO: 107740 - DNA, 490 bp, Homo sapiens
  misc_feature: GYAE6OF02HQ24W.12.1.A01.1.454.CMB.1.raw
  modified_base (471)..(471): a, c, t, g, unknown or other
  misc_feature (471)..(471): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaaccagggaaagcccctaaggtccctgatctatgctgcatccagtttgcaaagtggggtcccatcaaggttcagtggcagtgggtctgggacagatttcatctcaccatcagcagtctgcaactgaagattctgctaacttattactgtacaacagagtaacagttaccctcccaactttcggacggagggaccaggtggaagataccaaacgactagnggctgcaccatctgttacc

SEQ ID NO: 107741 - DNA, 310 bp, Homo sapiens
  misc_feature: GYAE6OF02GYY7U.12.1.A01.1.454.CMB.1.raw
  modified_base (282)..(283): a, c, t, g, unknown or other
  misc_feature (282)..(283): n is a, c, g, or t
  modified_base (285)..(310): a, c, t, g, unknown or other
  misc_feature (285)..(310): n is a, c, g, or t
tcagatacgacgtacacgaccggtgctcgatttagacgtctcatcagggataggaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatcttcccgcatctgatacgtcgtatctgagcgggctggcaaggcgcatagnngnnnnnnnnnnnnnnnnnnnnnnnnnn

SEQ ID NO: 107742 - DNA, 304 bp, Homo sapiens
  misc_feature: GYAE6OF02ICH11.12.1.A01.1.454.CMB.1.raw
  modified_base (279)..(279): a, c, t, g, unknown or other
  misc_feature (279)..(279): n is a, c, g, or t
  modified_base (285)..(304): a, c, t, g, unknown or other
  misc_feature (285)..(304): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattacttgtcaacagagttaacagttaccctcccactttcggcggagggaccaaggtggagatcaaaacgactggtggctgcaccatcgtgtcttcatccttcccgcatctgatacgtctatctgagcggctggcaaggcncatagnnnnnnnnnnnnnnnnnnnn

SEQ ID NO: 107743 - DNA, 288 bp, Homo sapiens
  misc_feature: GYAE6OF02JHHE4.12.1.A01.1.454.CMB.1.raw
  modified_base (281)..(288): a, c, t, g, unknown or other
  misc_feature (281)..(288): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcaccatctgtcttcatcttcccgcatctgatacgtcgtatctgagcgggctggcaaggcgcatagnnnnnnnn

SEQ ID NO: 107744 - DNA, 286 bp, Homo sapiens
  misc_feature: GYAE6OF02H0JA1.12.1.A01.1.454.CMB.1.raw
  modified_base (280)..(286): a, c, t, g, unknown or other
  misc_feature (280)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccatttcggcggagggaccaaggtggagatcaaacgactgtggctgcaccatctgtcttcatcttcccgcatctgatacgtcgtatctgagcgggctggcaaggcgcatagnnnnnnn

SEQ ID NO: 107745 - DNA, 503 bp, Homo sapiens
  misc_feature: GYAE6OF02IDU7P.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccaggaaagccctaaggtcctgatctatgctgcatccagtttgcaaagtggggtcccatcaagttcagtggcagtgggtctgggacagatttcactctcaccatcagcagtctgcaacctgaagattctgactaattattactgtacaacagaataacagttaccctccctactttccggcggacggtaaccgaaggtcggaagacgttacgaaacgtactacggtaggactggctaaccg

SEQ ID NO: 107746 - DNA, 289 bp, Homo sapiens; identical to SEQ ID NO: 107371
  misc_feature: GYAE6OF02GBI0H.12.1.A01.1.454.CMB.1.raw
  modified_base (283)..(289): a, c, t, g, unknown or other
  misc_feature (283)..(289): n is a, c, g, or t

SEQ ID NO: 107747 - DNA, 287 bp, Homo sapiens; identical to SEQ ID NO: 107404
  misc_feature: GYAE6OF02F5QT7.12.1.A01.1.454.CMB.1.raw
  modified_base (283)..(287): a, c, t, g, unknown or other
  misc_feature (283)..(287): n is a, c, g, or t

SEQ ID NO: 107748 - DNA, 288 bp, Homo sapiens; identical to SEQ ID NO: 107383
  misc_feature: GYAE6OF02G8YZS.12.1.A01.1.454.CMB.1.raw
  modified_base (283)..(288): a, c, t, g, unknown or other
  misc_feature (283)..(288): n is a, c, g, or t

SEQ ID NO: 107749 - DNA, 472 bp, Homo sapiens
  misc_feature: GYAE6OF02GP4Y2.12.1.A01.1.454.CMB.1.raw
  modified_base (383)..(383): a, c, t, g, unknown or other
  misc_feature (383)..(383): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctattaaattggtatcagcagaaaccagggaaagcccctaaggtcctgatctatgctgcatccagtttgcaaagtgggtcccatcaaggttcagtggcagtgggtctgggacagatttcactctcaccatcagcagtctgcaacctgaagattcngcaacttattactgtacaacagagtaacagttaccctccacttcggcgaggaccaggtgagatacaaacgatgtggctgcacatctgtc

SEQ ID NO: 107750 - DNA, 285 bp, Homo sapiens
  misc_feature: GYAE6OF02I7AT8.12.1.A01.1.454.CMB.1.raw
  modified_base (278)..(285): a, c, t, g, unknown or other
  misc_feature (278)..(285): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatcttccgcatctgatacgtcgtatctgagcggctggcaaggcgcatagnnnnnnnn

SEQ ID NO: 107751 - DNA, 287 bp, Homo sapiens; identical to SEQ ID NO: 107397
  misc_feature: GYAE6OF02FYIZL.12.1.A01.1.454.CMB.1.raw
  modified_base (282)..(287): a, c, t, g, unknown or other
  misc_feature (282)..(287): n is a, c, g, or t

SEQ ID NO: 107752 - DNA, 496 bp, Homo sapiens
  misc_feature: GYAE6OF02HP5WR.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgactaacttattactgtacaacagaagtaacagttaaccctccctacctttcggacggtaggaccagggtggagatacgaaacgaactgaggctacggcaccattctgttc

SEQ ID NO: 107753 - DNA, 286 bp, Homo sapiens; identical to SEQ ID NO: 107445
  misc_feature: GYAE6OF02GIWZ5.12.1.A01.1.454.CMB.1.raw
  modified_base (282)..(286): a, c, t, g, unknown or other
  misc_feature (282)..(286): n is a, c, g, or t

SEQ ID NO: 107754 - DNA, 287 bp, Homo sapiens; identical to SEQ ID NO: 107397
  misc_feature: GYAE6OF02GVABE.12.1.A01.1.454.CMB.1.raw
  modified_base (282)..(287): a, c, t, g, unknown or other
  misc_feature (282)..(287): n is a, c, g, or t

SEQ ID NO: 107755 - DNA, 288 bp, Homo sapiens; identical to SEQ ID NO: 107396
  misc_feature: GYAE6OF02HFG6J.12.1.A01.1.454.CMB.1.raw
  modified_base (282)..(288): a, c, t, g, unknown or other
  misc_feature (282)..(288): n is a, c, g, or t

SEQ ID NO: 107756 - DNA, 282 bp, Homo sapiens
  misc_feature: GYAE6OF02HUZX7.12.1.A01.1.454.CMB.1.raw
  modified_base (278)..(282): a, c, t, g, unknown or other
  misc_feature (278)..(282): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatcttccgcatctgatacgtcgtatctgagcggctggcaaggcgcatagnnnnn

SEQ ID NO: 107757 - DNA, 287 bp, Homo sapiens
  misc_feature: GYAE6OF02F7P1G.12.1.A01.1.454.CMB.1.raw
  modified_base (282)..(287): a, c, t, g, unknown or other
  misc_feature (282)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcaccatctgtcttcatcttcccgccatctgatacgtcgtatctgagcgggctggcaaggcgcatagnnnnnn

SEQ ID NO: 107758 - DNA, 283 bp, Homo sapiens
  misc_feature: GYAE6OF02H6T9O.12.1.A01.1.454.CMB.1.raw
  modified_base (280)..(283): a, c, t, g, unknown or other
  misc_feature (280)..(283): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggagggaccaaggtggagatcaaacgaactgtggctgcaccatctgtcttcatcttcccgcatctgatacgtcgtatctgagcgggctggcaaggcgcatagnnnn

SEQ ID NO: 107759 - DNA, 288 bp, Homo sapiens
  misc_feature: GYAE6OF02F1R2G.12.1.A01.1.454.CMB.1.raw
  modified_base (282)..(287): a, c, t, g, unknown or other
  misc_feature (282)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcgcatagnnnnnna

SEQ ID NO: 107760 - DNA, 286 bp, Homo sapiens
  misc_feature: GYAE6OF02I4P73.12.1.A01.1.454.CMB.1.raw
  modified_base (279)..(286): a, c, t, g, unknown or other
  misc_feature (279)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgactgtggctgcaccatctgtcttcatcttcccgcatctgatacgtcgtatctgagcggctggcaaggcgcatagnnnnnnnn

SEQ ID NO: 107761 - DNA, 484 bp, Homo sapiens
  misc_feature: GYAE6OF02GSAUZ.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtccatcaaggttcagtggcagtgggtctgggacagatttcactctcaccatcagcagtctgcaacctgaagtattctgcaacttattactgtacaacagagtaacacgttaccctcctactttcggacggaggaccaggtcggagatacaaacgactgtgctgccacatctgttacc

SEQ ID NO: 107762 - DNA, 285 bp, Homo sapiens; identical to SEQ ID NO: 107393
  misc_feature: GYAE6OF02IIU3E.12.1.A01.1.454.CMB.1.raw
  modified_base (281)..(285): a, c, t, g, unknown or other
  misc_feature (281)..(285): n is a, c, g, or t

SEQ ID NO: 107763 - DNA, 488 bp, Homo sapiens
  misc_feature: GYAE6OF02HZ7SB.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctattaaattggtatcagcagaaaccagggaaagcccctaaggtcctgatctatgctgcatccagtttgcaaagtggggtcccatcaaggtcagtggcagtgggtctgggacagatttcactctcaccatcagcagtctgaccaacctgaagattctgcctaacttattactgtacaacagattaacagttaccctcctactttcggcggaggaccaggtggagatacaacgaactgtaggctgctaaccg

SEQ ID NO: 107764 - DNA, 287 bp, Homo sapiens
  misc_feature: GYAE6OF02I5QPF.12.1.A01.1.454.CMB.1.raw
  modified_base (281)..(287): a, c, t, g, unknown or other
  misc_feature (281)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggagggaccaaggtggagatcaaacgaactgtggctgcaccatctgtcttcatcttcccgccatctgatacgtcgtatctgagcgggctggcaaggcgcatagnnnnnnn

SEQ ID NO: 107765 - DNA, 508 bp, Homo sapiens
  misc_feature: GYAE6OF02F6LXB.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaaattggtatcagcagaaaccagggaaagcccctaaaggtcctgatctatgctgcatccagtttgcaaagtggggtcccatcaaggttcagtggcagtgggtctgggacagatttcacttctcaccatcagcagtctgcaactgaagattctgcaacttatactgtcaacagaagtaacacgttaccctccctacgtttcggacggtagggaaccctaagggtggaacgtatacgaaacggaacttgtcggactgactaacccg

SEQ ID NO: 107766 - DNA, 575 bp, Homo sapiens
  misc_feature: GYAE6OF02FO18S.12.1.A01.1.454.CMB.1.raw
tcagatacgacgtacacgaccggtgctcgatttagacgtctcatcaggggagtctcagtcaggacacagcatggacatgacggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtccatcaaggttcagtggcagtgggtctgagacagagttcactctcacatcagcactctacagcctgaagtattttgctaaactttattatttgttactaaactaaaggtttatagtaacgtaccccttagaccctaaccgttttccgggacccctttagggggaaccctaacgttaacgggttacgggtaacgttaagttacggaaaaaccggtaaaccgtttcggttacggggtaccttagggacccttaaccccgagtttacccg

SEQ ID NO: 107767 - DNA, 291 bp, Homo sapiens
  misc_feature: GYAE6OF02GG420.12.1.A01.1.454.CMB.1.raw
  modified_base (275)..(275): a, c, t, g, unknown or other
  misc_feature (275)..(275): n is a, c, g, or t
  modified_base (281)..(291): a, c, t, g, unknown or other
  misc_feature (281)..(291): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtggagatcaaacgaactgtggctgcaccatctgtcttcatcttccgcatctgatacgtcgtatctgagtcgggctggcaaggcncatagnnnnnnnnnnn

SEQ ID NO: 107768 - DNA, 315 bp, Homo sapiens
  misc_feature: GYAE6OF02HQ86R.12.1.A01.1.454.CMB.1.raw
  modified_base (290)..(315): a, c, t, g, unknown or other
  misc_feature (290)..(315): n is a, c, g, or t
tcagatacgacgtacacgaccggtgctcgatttagacgtctcatctagggtagtagaagttattcagcacggcacacaacagaggcagttccagatttcactctcaccatcagcagtctagcaacctgaagattctgccaacttattactgtcaacagagtaacaggttaaccctccactttccggcggagggaccaaggtggagatcaaaacgactgtggctgcaccatctgtcttcatcttccgccatctgatacgtcgtatctgagcgggctggcaaggcgcatagnnnnnnnnnnnnnnnnnnnnnnnnnn

SEQ ID NO: 107769 - DNA, 286 bp, Homo sapiens; identical to SEQ ID NO: 107379
  misc_feature: GYAE6OF02FXKP6.12.1.A01.1.454.CMB.1.raw
  modified_base (283)..(286): a, c, t, g, unknown or other
  misc_feature (283)..(286): n is a, c, g, or t

SEQ ID NO: 107770 - DNA, 287 bp, Homo sapiens
  misc_feature: GYAE6OF02I6U0E.12.1.A01.1.454.CMB.1.raw
  modified_base (280)..(287): a, c, t, g, unknown or other
  misc_feature (280)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggaggaccaaggtggagatcaaacgactgtggctgcaccatctgtcttcatccttcccgccatctgatacgtcgtatctgagcgggctggcaaggcgcatagnnnnnnnn

SEQ ID NO: 107771 - DNA, 285 bp, Homo sapiens
  misc_feature: GYAE6OF02GLHHZ.12.1.A01.1.454.CMB.1.raw
  modified_base (282)..(285): a, c, t, g, unknown or other
  misc_feature (282)..(285): n is a, c, g, or t
tcagatacgacgtacacgaccggtgctcgatttagacgtctcatcagggatagaagttattcagcaggcacacaacagaggcagttcaagatttcaactgctcatcagcagtctgcaacctgaagattctgcaacttattactgtcaacagagtaacagttaccctcccactttcggcggagggaccaaggtggagatcaaacgaactgtggctgcaccatctgtctttatcttcccgccatctgatacgtcgtatctgagcgggctggcaaggcgcatagnnnn

SEQ ID NO: 107772 - DNA, 483 bp, Homo sapiens
  misc_feature: GYAE6OF02H0W9Q.12.1.A01.1.454.CMB.1.raw
  modified_base (284)..(284): a, c, t, g, unknown or other
  misc_feature (284)..(284): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaaattggtatcagcagaaaccagggaaagcccctaaggtcctgatctangctgcatccagtttgcaatcagggtcccatctcgttcagcggcagtgatctgggacagagttcactctcaccatcagcagctgcagcctgaagatgttgcaacttattactagtactaaaagtataactacgtcgccccttcaccttcggaccaacggacacgactaggagtattagacgtaactggtggctgctaacc

SEQ ID NO: 107773 - DNA, 494 bp, Homo sapiens
  misc_feature: GYAE6OF02F6STI.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctgggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagttgcaaagtgggtccatcaaggttcagtggcagtgggtctgggacagatttcactctcaccatcagcagtctgctaacctgaagattctgactaacttattactgtacaacagttaataataactctacccgtactactttcggaccgtacggggaccaaggtctggagatacgaaacgaactgtggctacg

SEQ ID NO: 107774 - DNA, 476 bp, Homo sapiens
  misc_feature: GYAE6OF02GXGW8.12.1.A01.1.454.CMB.1.raw
  modified_base (423)..(423): a, c, t, g, unknown or other
  misc_feature (423)..(423): n is a, c, g, or t
  modified_base (465)..(465): a, c, t, g, unknown or other
  misc_feature (465)..(465): n is a, c, g, or t
tcagatacgacgtacacgaccggtgctcgatttagacgtctcatcaggggagtctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaatttttagcctggtatcagcagaaaccagggaaagttccacacctcctgatctatgctgcatccgctttgcaatcagggtcccatctcggttcagcggcagtggatctgggacagagttcactctcaccatcagcagcctgcagcctgagatgttgcaacttattactgtacaaagtataacagttcgccccttanacccttcggacccaagggcacggactggatagtagacgatgnggctgctaccg

SEQ ID NO: 107775 - DNA, 480 bp, Homo sapiens
  misc_feature: GYAE6OF02IF0OY.12.1.A01.1.454.CMB.1.raw
  modified_base (407)..(407): a, c, t, g, unknown or other
  misc_feature (407)..(407): n is a, c, g, or t
  modified_base (478)..(478): a, c, t, g, unknown or other
  misc_feature (478)..(478): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaaggtccctggtctatgctgcatccagtttgcaaagtgggggtcccatcaaggttcagtggcagtgggtctgggacagatttcactctcaccatcagcagtctgcaacctgaagattctgcaacttattactgtcaanagagtaacagttaccctccactttcggcgaggaccaaggtgagatcaaacgactgtgctgcaccatctgtntc

SEQ ID NO: 107776 - DNA, 284 bp, Homo sapiens
  misc_feature: GYAE6OF02GVHLI.12.1.A01.1.454.CMB.1.raw
  modified_base (279)..(284): a, c, t, g, unknown or other
  misc_feature (279)..(284): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatcttcccgcatctgatacgtcgtatctgagcggctggcaaggcgcatagnnnnnn

SEQ ID NO: 107777 - DNA, 284 bp, Homo sapiens
  misc_feature: GYAE6OF02HGZKZ.12.1.A01.1.454.CMB.1.raw
  modified_base (281)..(284): a, c, t, g, unknown or other
  misc_feature (281)..(284): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcggctggcaaggcgcatagnnnn

SEQ ID NO: 107778 - DNA, 290 bp, Homo sapiens; identical to SEQ ID NO: 107390
  misc_feature: GYAE6OF02JBBKJ.12.1.A01.1.454.CMB.1.raw
  modified_base (283)..(290): a, c, t, g, unknown or other
  misc_feature (283)..(290): n is a, c, g, or t

SEQ ID NO: 107779 - DNA, 480 bp, Homo sapiens
  misc_feature: GYAE6OF02GX3FO.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtccctgatctatgctgcatccagtttgcaaagtggggtccatcaaggttcagtggcagtgggtctgggacagatttcactctcaccatcagcagtctgcaacctgaagattctgctaacttattactgtcaacagagtaacacgttaccctcctactttcggcgaggaccaggtggagatacaaacgactgtaggctgcacatctgtc

SEQ ID NO: 107780 - DNA, 285 bp, Homo sapiens
  misc_feature: GYAE6OF02IICHT.12.1.A01.1.454.CMB.1.raw
  modified_base (279)..(285): a, c, t, g, unknown or other
  misc_feature (279)..(285): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcacatctgtcttcatcttcccgcatctgatacgtgtatctgagcgggctggcaaggcgcatagnnnnnnn

SEQ ID NO: 107781 - DNA, 285 bp, Homo sapiens
  misc_feature: GYAE6OF02JSIFK.12.1.A01.1.454.CMB.1.raw
  modified_base (277)..(285): a, c, t, g, unknown or other
  misc_feature (277)..(285): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgactagtggctgcaccatctgtcttcatcttccgcatctgatacgtcgtatctgagcggctggcagcgcatagnnnnnnnnn

SEQ ID NO: 107782 - DNA, 289 bp, Homo sapiens
  misc_feature: GYAE6OF02IKSM7.12.1.A01.1.454.CMB.1.raw
  modified_base (283)..(289): a, c, t, g, unknown or other
  misc_feature (283)..(289): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaaacgaactgtggctgcaccatctgtcttcatcttcccgcatctgatacgtcgtatctgagcgggctggcaaggcgcatagnnnnnnn

SEQ ID NO: 107783 - DNA, 288 bp, Homo sapiens
  misc_feature: GYAE6OF02FVO36.12.1.A01.1.454.CMB.1.raw
  modified_base (282)..(288): a, c, t, g, unknown or other
  misc_feature (282)..(288): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcaccatctgtcttcatcttcccgccatctgatacgtcgtatctgagcgggctggcaaggcgcatagnnnnnnn

SEQ ID NO: 107784 - DNA, 289 bp, Homo sapiens; identical to SEQ ID NO: 107371
  misc_feature: GYAE6OF02F3X3X.12.1.A01.1.454.CMB.1.raw
  modified_base (283)..(289): a, c, t, g, unknown or other
  misc_feature (283)..(289): n is a, c, g, or t

SEQ ID NO: 107785 - DNA, 283 bp, Homo sapiens
  misc_feature: GYAE6OF02I2UMJ.12.1.A01.1.454.CMB.1.raw
  modified_base (278)..(283): a, c, t, g, unknown or other
  misc_feature (278)..(283): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggaggaccaaggtggagatcaaacgactgtggctgcaccatctgtcttcatcttccgccatctgatacgtcgtatctgagcggctggcaaggcgcatagnnnnnn

SEQ ID NO: 107786 - DNA, 476 bp, Homo sapiens
  misc_feature: GYAE6OF02FF5FZ.12.1.A01.1.454.CMB.1.raw
  modified_base (384)..(384): a, c, t, g, unknown or other
  misc_feature (384)..(384): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgcctgcatctgtagcagacagagtcaccatcacttgccgggcaagtcagaccatcagcagctatttaaattggtatcagcagaaaccagggaagcccctaaggtcctgatctatgctgcatccagtttgcaaagtgggtccatcaaggttcagtgcagtggtctgggacagatttcactctcaccatcagcagtctgcaactgaagnttctgcaactttattactgtcaacagagtaacacgttaccctccactttcgcggaggaccaaggtcggagatacaacgactgtgctgctacg

SEQ ID NO: 107787 - DNA, 287 bp, Homo sapiens; identical to SEQ ID NO: 107397
  misc_feature: GYAE6OF02F7RFC.12.1.A01.1.454.CMB.1.raw
  modified_base (282)..(287): a, c, t, g, unknown or other
  misc_feature (282)..(287): n is a, c, g, or t

SEQ ID NO: 107788 - DNA, 283 bp, Homo sapiens
  misc_feature: GYAE6OF02HXXQX.12.1.A01.1.454.CMB.1.raw
  modified_base (279)..(283): a, c, t, g, unknown or other
  misc_feature (279)..(283): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatcttcccgcatctgatacgtcgtatctgagcgggctggcaggcgcatagnnnnn

SEQ ID NO: 107789 - DNA, 286 bp, Homo sapiens; identical to SEQ ID NO: 107379
  misc_feature: GYAE6OF02F033Q.12.1.A01.1.454.CMB.1.raw
  modified_base (283)..(286): a, c, t, g, unknown or other
  misc_feature (283)..(286): n is a, c, g, or t

SEQ ID NO: 107790 - DNA, 294 bp, Homo sapiens
  misc_feature: GYAE6OF02GBINA.12.1.A01.1.454.CMB.1.raw
  modified_base (285)..(294): a, c, t, g, unknown or other
  misc_feature (285)..(294): n is a, c, g, or t
tcagatacgacgtacacgaccggtgctcgatttagacgtctcatcagggatagaaggttattcagcaggcacacaacagaggcagttccagatttcactctcaccatcagcagtctgcaacctgagattctgcaacttattactgtcaacagagtaacagttaccctcccactttcggcgagggaccaaggtcggagatcaaacgaactgtggctgcaccattctgtcttcatcttccgccatctgatacgtcgtatctgaacgcgggctggcaaggcgcatagnnnnnnnnnn

SEQ ID NO: 107791 - DNA, 287 bp, Homo sapiens; identical to SEQ ID NO: 107520
  misc_feature: GYAE6OF02HFRJE.12.1.A01.1.454.CMB.1.raw
  modified_base (282)..(287): a, c, t, g, unknown or other
  misc_feature (282)..(287): n is a, c, g, or t

SEQ ID NO: 107792 - DNA, 284 bp, Homo sapiens
  misc_feature: GYAE6OF02HZQIH.12.1.A01.1.454.CMB.1.raw
  modified_base (278)..(284): a, c, t, g, unknown or other
  misc_feature (278)..(284): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgactgtggctgcaccatctgtcttcatctcccgcatctgatacgtcgtatctgagcggctggcaaggcgcatagnnnnnnn

SEQ ID NO: 107793 - DNA, 288 bp, Homo sapiens; identical to SEQ ID NO: 107456
  misc_feature: GYAE6OF02IJIFZ.12.1.A01.1.454.CMB.1.raw
  modified_base (282)..(288): a, c, t, g, unknown or other
  misc_feature (282)..(288): n is a, c, g, or t

SEQ ID NO: 107794 - DNA, 288 bp, Homo sapiens; identical to SEQ ID NO: 107383
  misc_feature: GYAE6OF02GH6Y7.12.1.A01.1.454.CMB.1.raw
  modified_base (283)..(288): a, c, t, g, unknown or other
  misc_feature (283)..(288): n is a, c, g, or t

SEQ ID NO: 107795 - DNA, 498 bp, Homo sapiens
  misc_feature: GYAE6OF02I9P00.12.1.A01.1.454.CMB.1.raw
  modified_base (348)..(348): a, c, t, g, unknown or other
  misc_feature (348)..(348): n is a, c, g, or t
  modified_base (383)..(383): a, c, t, g, unknown or other
  misc_feature (383)..(383): n is a, c, g, or t
  modified_base (397)..(397): a, c, t, g, unknown or other
  misc_feature (397)..(397): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcttctgtcggagacagagtcaccatcacttgccaggcgagtgaggacattcggaaatttttaatggtttcagcagaaaccagggaaagcccctagactcctgattcacgaggcatccaattcggaaatgggtccacgaagttcagtggaggtggagctgggacagtatttacccnaccatcagcagcctgcagcctgaagatcttgcaanatattactgtcaanagtataataatctccgtactactttggccagggaccaagctagagtatacgaacgactgtaggctgacacatcgtagtcttacagtccttcccgactatcg

SEQ ID NO: 107796 - DNA, 285 bp, Homo sapiens
  misc_feature: GYAE6OF02JBN3T.12.1.A01.1.454.CMB.1.raw
  modified_base (282)..(285): a, c, t, g, unknown or other
  misc_feature (282)..(285): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcgcatagnnnn

SEQ ID NO: 107797 - DNA, 288 bp, Homo sapiens
  misc_feature: GYAE6OF02G9CYK.12.1.A01.1.454.CMB.1.raw
  modified_base (284)..(288): a, c, t, g, unknown or other
  misc_feature (284)..(288): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatccttcccgccatctgatacgtcgtatctgagcgggctggcaaggcgcatagnnnnn

SEQ ID NO: 107798 - DNA, 295 bp, Homo sapiens
  misc_feature: GYAE6OF02G4SEJ.12.1.A01.1.454.CMB.1.raw
  modified_base (283)..(284): a, c, t, g, unknown or other
  misc_feature (283)..(284): n is a, c, g, or t
  modified_base (286)..(295): a, c, t, g, unknown or other
  misc_feature (286)..(295): n is a, c, g, or t
tcagatacgacgtacacgaccggtgctcgatttagacgtctcatcagggagtagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatccttccgccatctgatacgtcgtatctgagcgggctggcaaggcgcatagnngnnnnnnnnnn

SEQ ID NO: 107799 - DNA, 287 bp, Homo sapiens
  misc_feature: GYAE6OF02HW47U.12.1.A01.1.454.CMB.1.raw
  modified_base (269)..(269): a, c, t, g, unknown or other
  misc_feature (269)..(269): n is a, c, g, or t
  modified_base (275)..(287): a, c, t, g, unknown or other
  misc_feature (275)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaactgaagattctgtcaacttattactgtcaacagagtaacagttaccctccactttcggcggagggaccaaggtgagatcaaacgactgtgctgcaccatctgtcttcatcttcccgcatctgactacgtctatctgagcggctggcaggcncatagnnnnnnnnnnnnn

SEQ ID NO: 107800 - DNA, 525 bp, Homo sapiens
  misc_feature: GYAE6OF02HCG23.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaagcccctaaggtcctgatctatgctgcatccagtttgctaaagtcggggtacccagtcaaggttcagtggcagtgggtctgggacagtatttcactctcacatcagcagtctgcaacctgaagattctgactaacttattactgtacaaacgagaagtaactacgttaccctcctacgtttcgggacggaacgggaccgtaagggtggaagtacgtaacgaaaccggtaacgttggtacggcgttacggctaaccg

SEQ ID NO: 107801 - DNA, 286 bp, Homo sapiens
  misc_feature: GYAE6OF02HVS23.12.1.A01.1.454.CMB.1.raw
  modified_base (280)..(286): a, c, t, g, unknown or other
  misc_feature (280)..(286): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccatttcggcggagggaccaaggtggagatcaaacgaactgtggctgcaccatctgtcttcatcttcccgcatctgatacgtcgtatctgagcgggctggcaaggcgcatagnnnnnnn

SEQ ID NO: 107802 - DNA, 478 bp, Homo sapiens
  misc_feature: GYAE6OF02GUK9J.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaaggtcctgatctatgctgcatccagtttgcaaagtgggtccatcaaggttcagtgcagtgggtctgggacagatttcactctcaccatcagcagtctgcaacctgaagattctgctaacttattactgtcaacagagtaacagttaccctccactttcggacggaggaccaggtggagatacaaacgactgtgctgcacctatctgtc

SEQ ID NO: 107803 - DNA, 291 bp, Homo sapiens
  misc_feature: GYAE6OF02H3JOR.12.1.A01.1.454.CMB.1.raw
  modified_base (282)..(291): a, c, t, g, unknown or other
  misc_feature (282)..(291): n is a, c, g, or t
tcagatacgacgtacacgaccggtgctcgatttagacgtctcatcagggatagaagttattcagcaggcacacaacagaggcagttccagatttcactctcaccatcagcagtctgcaactgaagattctgcaacttattactgtcaacagagtaacagttaccctcccactttcggcggagggaccaaggtggagatacaaacgaactgtggctgcaccatctgtcttcatcttcccgcatctgatacgtcgtatctgagcgggctggcaggcgacatagnnnnnnnnnn

SEQ ID NO: 107804 - DNA, 288 bp, Homo sapiens
  misc_feature: GYAE6OF02GNQBX.12.1.A01.1.454.CMB.1.raw
  modified_base (282)..(288): a, c, t, g, unknown or other
  misc_feature (282)..(288): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcggctggcaaggcgcatagnnnnnnn

SEQ ID NO: 107805 - DNA, 286 bp, Homo sapiens; identical to SEQ ID NO: 107417
  misc_feature: GYAE6OF02GGJSD.12.1.A01.1.454.CMB.1.raw
  modified_base (282)..(286): a, c, t, g, unknown or other
  misc_feature (282)..(286): n is a, c, g, or t

SEQ ID NO: 107806 - DNA, 487 bp, Homo sapiens
  misc_feature: GYAE6OF02IUC4O.12.1.A01.1.454.CMB.1.raw
tcagatacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacaggatttcactctcaccatcagcagtctgcaactgaagattctgctaacttattactgtcaacagacgtaacacgttaccctccactttcggacggacgggaccaaggtcggagatacaacgactgtggctgcaccatctgtcttcatcttcccgctacg

SEQ ID NO: 107807 - DNA, 535 bp, Homo sapiens
  misc_feature: GYAE6OF02IXC5D.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaatggtatcagcagaaaccagggaaagccctaaggtcctgatctatgctgcatccagtttgcaaagtgggtcccatcaaggttcagtggcagtgggtctgggacagatttcactctcaccatcagcagtctgcaacctgaagtattctagactaaactttattactagtacaaacgagtaagtaaccacgtttaaccctaccctacgtttccggacgggtaacgggaccgtaagggtacggaggtaataccgaaaacgtaacgtacggtggcgtacggaccacctacgttccgtgttacc

SEQ ID NO: 107808 - DNA, 521 bp, Homo sapiens
  misc_feature: GYAE6OF02H7M3P.12.1.A01.1.454.CMB.1.raw
  modified_base (377)..(377): a, c, t, g, unknown or other
  misc_feature (377)..(377): n is a, c, g, or t
  modified_base (395)..(395): a, c, t, g, unknown or other
  misc_feature (395)..(395): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgcggcaagtcagaccatcagcagctaatttaatggtatcagcaagaaaccagggaaagcccctaaggtcctgatctatgctgcatccagtttgacaaagtcggggtccatcaaggttcagtggcagtgggtctgggacagtatttcactctcaccatcagcagtntgaccaactgaatattcngactaacttacttacttgtacaacagtaacgtaactagttacccctaccgtacgtttccgggacgggtacgggacctaagggtggaacgtaactacgaacgaactggtacggactcgactaacccg

SEQ ID NO: 107809 - DNA, 565 bp, Homo sapiens
  misc_feature: GYAE6OF02IUDS6.12.1.A01.1.454.CMB.1.raw
  modified_base (262)..(262): a, c, t, g, unknown or other
  misc_feature (262)..(262): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattattaaattggtatcagcagaaaccagggaaancccctaaatcctgatctatcatgaatccagtttgcgaagtggagtcccatcaaggttcagtgcactgggtctgagacagagttcactctacacatcagcactctacagcctagaagtatttgactaaactttattatttcgtactaaactaaagttatacgtaacgtaccccttagtccctaacgtttccgggccccttaggggaaccctaagttacggtagtattagttacggaaaccgtaacgttacggtaggtccttacggactaacccgtattccgttgttaccttccgtacttccccg

SEQ ID NO: 107810 - DNA, 288 bp, Homo sapiens
  misc_feature: GYAE6OF02JJRIK.12.1.A01.1.454.CMB.1.raw
  modified_base (257)..(257): a, c, t, g, unknown or other
  misc_feature (257)..(257): n is a, c, g, or t
  modified_base (281)..(288): a, c, t, g, unknown or other
  misc_feature (281)..(288): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcaccatctgtcttcatcttcccgcatctgatacgtcgtatcngagcgggctggcaaggcgcatagnnnnnnnn

SEQ ID NO: 107811 - DNA, 288 bp, Homo sapiens
  misc_feature: GYAE6OF02H60XP.12.1.A01.1.454.CMB.1.raw
  modified_base (281)..(288): a, c, t, g, unknown or other
  misc_feature (281)..(288): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggccaaggtggagatcaaacgaactgtggctgcaccatctgtcttcattttccgccatctgatacgtcgtatctgagcgggctggcaaggcgcatagnnnnnnnn

SEQ ID NO: 107812 - DNA, 472 bp, Homo sapiens
  misc_feature: GYAE6OF02G1SPV.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccaggaaagcccctaaggtcctgatctatgctgcatccagtttgcaaagtgggtccatcaaggttcagtgcagtggtctgggacagattcactctcaccatcagcagtctgcaactgaagattctgcaattattactgtcaacagagtaacagttaccctccactttcggcgacggacaggtggagatacaaacgaactgtggctagcaccatctgtac

SEQ ID NO: 107813 - DNA, 342 bp, Homo sapiens
  misc_feature: GYAE6OF02J3NIY.12.1.A01.1.454.CMB.1.raw
  modified_base (128)..(128): a, c, t, g, unknown or other
  misc_feature (128)..(128): n is a, c, g, or t
  modified_base (156)..(156): a, c, t, g, unknown or other
  misc_feature (156)..(156): n is a, c, g, or t
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (307)..(308): a, c, t, g, unknown or other
  misc_feature (307)..(308): n is a, c, g, or t
  modified_base (311)..(342): a, c, t, g, unknown or other
  misc_feature (311)..(342): n is a, c, g, or t
tcagatacgacgtacacgaccggtgctcgatttagacgtctcatcagggatagaagttattcagcaggcacacaacagaggcagttccagatttcaactgctcatcagcagtctgcaactgagattcngctaacttatactgcaacagacgtaacncgttaccctcccgtagttcgggcggaggaccaaggtgganatacgaaacgatgtggctgaccactatctgtcttcacttccttccgcctatcgtagtacttcgtactgtcgtcggacggtccggganacgggacgaacggtcctatagcgnngannnnnnnnnnnnnnnnnnnnnnnnnnnnnnnn

SEQ ID NO: 107814 - DNA, 291 bp, Homo sapiens; identical to SEQ ID NO: 107457
  misc_feature: GYAE6OF02G4IC1.12.1.A01.1.454.CMB.1.raw
  modified_base (283)..(291): a, c, t, g, unknown or other
  misc_feature (283)..(291): n is a, c, g, or t

SEQ ID NO: 107815 - DNA, 556 bp, Homo sapiens
  misc_feature: GYAE6OF02H6YVZ.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctaatttaaattggtatcagcaagaaaaccagggaaacgaccccgtaaagggtcctaggatctaatgctgcatccagtttgacaaagtcggggtaccatcaaggtttcagtggctagtgggtctgggacagtatttcactctcactatcagcacgtctgacctaacctagaacgtattctgacctaactttactttacgtgtacaacagtaacgtaaacacgtttaacccctaccgtacctttcgggaccgggaacggtaccggtaagggtggaagtaactaccgaaacgtaacgtcggtacggctacggtactaaccg

SEQ ID NO: 107816 - DNA, 288 bp, Homo sapiens
  misc_feature: GYAE6OF02FWP85.12.1.A01.1.454.CMB.1.raw
  modified_base (244)..(244): a, c, t, g, unknown or other
  misc_feature (244)..(244): n is a, c, g, or t
  modified_base (283)..(288): a, c, t, g, unknown or other
  misc_feature (283)..(288): n is a, c, g, or t
tcagatacgacgtacacgaccggtgctcgatttagacgtctcatcagggataggaagttattcagcaggcacacaacagaggcagttccagatttcactctcaccatcagcagtctgcaacctgaagattctgcaacttattactgtcaacagagtaacagttaccctcccactttcggcgagggaccaaggtggagatcaaacgaactgtggctgcaccatctgtctcatcttcccgccatcngatacgtcgtatctgagcgggctggcaaggcgcatacgnnnnnn

SEQ ID NO: 107817 - DNA, 288 bp, Homo sapiens; identical to SEQ ID NO: 107383
  misc_feature: GYAE6OF02F0Z9P.12.1.A01.1.454.CMB.1.raw
  modified_base (283)..(288): a, c, t, g, unknown or other
  misc_feature (283)..(288): n is a, c, g, or t

SEQ ID NO: 107818 - DNA, 569 bp, Homo sapiens
  misc_feature: GYAE6OF02HQOMG.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgacaaagtggggtacccatcaaggttcagtggcagtgggtctgggacagtatttcactctcaccatcagcagtctgccaacctgaagtattctagacctaactttattacttacgtacaaacgtaagtaagttaaacctacgttaacccctaccctaaccgttttccgggaccggtaacggggtaacccgtaaggggttcggaacggtaacgttaaccgaaaccggtaacgttacggtacgggaccttacggaccctaacccg

SEQ ID NO: 107819 - DNA, 285 bp, Homo sapiens
  misc_feature: GYAE6OF02HHIZK.12.1.A01.1.454.CMB.1.raw
  modified_base (280)..(285): a, c, t, g, unknown or other
  misc_feature (280)..(285): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatcttcccgccatctgatacgtcgtatctgagcggctggcaaggcgcatagnnnnnn

SEQ ID NO: 107820 - DNA, 285 bp, Homo sapiens
  misc_feature: GYAE6OF02J0BED.12.1.A01.1.454.CMB.1.raw
  modified_base (277)..(285): a, c, t, g, unknown or other
  misc_feature (277)..(285): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgaaacttattactgtcaacagagtaacagttaccctccactttcggcggaggaccaaggtgagatcaaacgactgtggctgcaccatctgtcttcatcttcccgcatctgatacgtcgtatctgagcgggctggcaaggcgcatagnnnnnnnnn

SEQ ID NO: 107821 - DNA, 305 bp, Homo sapiens
  misc_feature: GYAE6OF02HKFFH.12.1.A01.1.454.CMB.1.raw
  modified_base (286)..(305): a, c, t, g, unknown or other
  misc_feature (286)..(305): n is a, c, g, or t
tcagatacgacgtacacgaccggtgctcgatttagacgtctcatcagggagtaagaagttattcagcaggcacacaacagaggcagttccagatttcactctcacccatcagcagtctgcaacctgaagattctgcaacttattactgtcaacagagtaacagttaccctcccactttcggcggagggaccaaggtggagatcaaacgactgtggctggcaccatctgtcttcatcttcccgccatctgatacgtcgtatctgagcgggctggcaaggcgcatagnnnnnnnnnnnnnnnnnnnn

SEQ ID NO: 107822 - DNA, 503 bp, Homo sapiens
  misc_feature: GYAE6OF02F1FIR.12.1.A01.1.454.CMB.1.raw
  modified_base (384)..(384): a, c, t, g, unknown or other
  misc_feature (384)..(384): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcaagaaaccaagggaaacgcccctaaggtcctggactctatgctgcatccagtttgcaaagtggggtcccatccaaggttcagtggcaggtgggtctgggacagatttcactctcacatcagcagtcngcactgaagatctnctaacttatactgtcaangaagtaacacgttaccctacctactttacgggcggtacgggaccaaggtcggaacgactacgaacgactagtcggctacgctaaccg

SEQ ID NO: 107823 - DNA, 286 bp, Homo sapiens; identical to SEQ ID NO: 107445
  misc_feature: GYAE6OF02GAX6S.12.1.A01.1.454.CMB.1.raw
  modified_base (282)..(286): a, c, t, g, unknown or other
  misc_feature (282)..(286): n is a, c, g, or t

SEQ ID NO: 107824 - DNA, 292 bp, Homo sapiens
  misc_feature: GYAE6OF02IZLMO.12.1.A01.1.454.CMB.1.raw
  modified_base (243)..(243): a, c, t, g, unknown or other
  misc_feature (243)..(243): n is a, c, g, or t
  modified_base (282)..(292): a, c, t, g, unknown or other
  misc_feature (282)..(292): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggaggaccaaggtggagatcaaacgaactgtggctgcaccatctgtcttcatcttcccgccatcngatacgtcgtatctgagcgggctggcaaggcgcagtagnnnnnnnnnnn

SEQ ID NO: 107825 - DNA, 307 bp, Homo sapiens
  misc_feature: GYAE6OF02IHUEZ.12.1.A01.1.454.CMB.1.raw
  modified_base (280)..(307): a, c, t, g, unknown or other
  misc_feature (280)..(307): n is a, c, g, or t
tcagatacgacgtacacgaccggtgctcgatttagacgtctcatcagggataggaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcacatctgtctcatcttcccgcatctgatacgtcgtatctgagcgggctggcaaggcgcatgnnnnnnnnnnnnnnnnnnnnnnnnnnnn

SEQ ID NO: 107826 - DNA, 286 bp, Homo sapiens; identical to SEQ ID NO: 107736
  misc_feature: GYAE6OF02GRNCR.12.1.A01.1.454.CMB.1.raw
  modified_base (281)..(286): a, c, t, g, unknown or other
  misc_feature (281)..(286): n is a, c, g, or t

SEQ ID NO: 107827 - DNA, 520 bp, Homo sapiens
  misc_feature: GYAE6OF02FVP39.12.1.A01.1.454.CMB.1.raw
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaatggtatcagcagaaaccagggaaagcccctaaggtcctgatctatgctgcatccagtttgcaagtgggtcccatcaaggttcagtgcagtgggtctgggacagatttcgactctcaccatcagcagtctgcaacctgaagnttcngactaacttattactgtacaacagaacgttaacagtttacccctcctactttccggacggtacgggacccagggttcggaaggtacttacgaaaacgtaacttggtacggcttacggaccaccgattccgtagttacc

SEQ ID NO: 107828 - DNA, 292 bp, Homo sapiens
  misc_feature: GYAE6OF02G4E6H.12.1.A01.1.454.CMB.1.raw
  modified_base (283)..(292): a, c, t, g, unknown or other
  misc_feature (283)..(292): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcgcatagnnnnnnnnnn

SEQ ID NO: 107829 - DNA, 290 bp, Homo sapiens
  misc_feature: GYAE6OF02F390W.12.1.A01.1.454.CMB.1.raw
  modified_base (284)..(290): a, c, t, g, unknown or other
  misc_feature (284)..(290): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaaacgaactgtggctgcaccatctgtcttcatcttcccgccatctgatacgtcgtatctgagcgggctggcaaggcgcatagnnnnnnn

SEQ ID NO: 107830 - DNA, 580 bp, Homo sapiens
  misc_feature: GYAE6OF02IKFDW.12.1.A01.1.454.CMB.1.raw
tcagatacgacgtacacgaccggtgctcgatttagacgtctcatcagggggcgaggagtcagtctcagtcaggacacagcatggacatgagggtccccgctcagctcctggggctcctgctactctggctccgaggtgccagatgtgacatccagatgacccagtctccatcctcctgtctgcatctgtagcagacagagtcaccatcacttgccgggcaagtcagaccatcagcagctaattaatgtatcagcagaaaccaggaaacgccctaaaggtcctagatctatgctgcatcctagtttagactaaaggtcggggtacccagtcaaggttcaggtggctagtgggtctgggacagtactttcgaactcgtacaaccatacagtcagtctagaccaaccttagaaacgtacttacgtcgaacttaaactttaacgtttactacgttacgaaacctaggaaacgttaaactacgttaacccctcccgtacgtttaccgggacggaacgggaaccgaagggtcgaacggtaccttaacgaaaaccgtacgtacggttacgtaccgtagcctaaaccg

SEQ ID NO: 107831 - DNA, 571 bp, Homo sapiens
  misc_feature: GYAE6OF02F96RX.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctgggctcctgctactctggctccgaggtgccagatgtgacatccagatgacccagtctccatcctccctgtctgcatctgtagcagacagagtcaccatcacttgccggcaagtcagaccatcagcagctatttaaattggtatcagcagaaaccagggaaacgccccgtaaggtcctagatctatgctgcatccagtttgactaaaggtcggggtaccatcgaaggtttcaggtgcgagtggtcgtgggacagtatttcactctacaccatcagctacgtctcgactaaccgtgtaacgtagttactcgacttaactttattaactgtacaacgtagaacgttaaacctacgttaacccctacccgtaccgtttaccgggaccgggtaacgggtaacccgtaacgggtaggaacgtaacgtaaccaaaaccggtacgttggtacgggccttaggccctaaccg

SEQ ID NO: 107832 - DNA, 526 bp, Homo sapiens
  misc_feature: GYAE6OF02HIMZE.12.1.A01.1.454.CMB.1.raw
  modified_base (394)..(394): a, c, t, g, unknown or other
  misc_feature (394)..(394): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatccctccctgtctgcatctgtagcagacagagtcaccatcacttgccgggcaagtcagaccatcagcagctatttaaatggtatcagcagaaaccagggaaagcccctaaaggtcctagatctatgctgcatccagtttgcaaagtggggtccatcaaggttcagtggcagtgggtctgggacagtatttcactctcaccatcagcagtctcgcaacctgaagtnttctgcaaatttattactgtacaactagaactaacacgttacccctaccgtacttttccgggacggtacgggaacccaagggttcggaacgtagtaccgaaacggtaacttggtcggacttggacctaaccg

SEQ ID NO: 107833 - DNA, 284 bp, Homo sapiens
  misc_feature: GYAE6OF02IAPV6.12.1.A01.1.454.CMB.1.raw
  modified_base (244)..(244): a, c, t, g, unknown or other
  misc_feature (244)..(244): n is a, c, g, or t
  modified_base (280)..(284): a, c, t, g, unknown or other
  misc_feature (280)..(284): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggagggaccaaggtggagatcaaacgaactgtggctgcaccatctgtcttcatcttccgccatctgntacgtcgtatctgagcgggctggcaaggcgcatagnnnnn

SEQ ID NO: 107834 - DNA, 717 bp, Homo sapiens
  misc_feature: GYAE6OF02JB1RB.12.1.A01.1.454.CMB.1.raw
  modified_base (92)..(92): a, c, t, g, unknown or other
  misc_feature (92)..(92): n is a, c, g, or t
tcagatacgacgtacacgaccggtgctcgatttagacgtctcatcaggggagtctcagtcaggacaccagcatggacatgagggttccccgnttcagctcctggggctcctgctactctggctccgaggtgccagtagtgtgacatccgtagattgacccagttactccgatcctcctgtctgcatctgtagcagacgagagtcgaccatcacgttgcccggcaacgtcagaccatcagccagtcgttatttaacttggtatcagtcgaagaaaccgagggaaacgccccgttaaggtccctacggatctagtggctaggctatccgtagtttcggcgttaaaggttcgggtaccctagttaccgtaagggttacgaaggttacggacgtaacggttacggggttccgtacggggtaacgtaaggtacgtttacgaccgttccttaccaacctacttaccgacgtccaaggttacctacgtaacctaaacccgtaagaacgttactttacgtacgtaaccgtaactttaacgttaccgtacgtaaccgtaaacgtacggtaaccgtaacgtaccgtttacccctacccgttacgtttaccggaccgggttaacgggttacccgtaagggttacggaacgtaacgttaaccgaaacggttaacgttacggtacggtacgttacggtaccgtaaccgtacgtttaccttacggtttacc

SEQ ID NO: 107835 - DNA, 579 bp, Homo sapiens
  misc_feature: GYAE6OF02FVF0H.12.1.A01.1.454.CMB.1.raw
  modified_base (263)..(263): a, c, t, g, unknown or other
  misc_feature (263)..(263): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaatggtatcagcagaaaccagggaaacncccctaaggtcctgatctatgctgcatccagtttgactaaaggtgggtcccagtcaaggttcagtggctaggtgggtctggggacaggtatttcgactctcaccatcagcagtctgactaaccgtgaagtacttcgagtactaactttattacctagtacctaaacgagtaacgtaaacgtacgtttaaccccttccgtaaggttttccggacgttacgggaacgggtaccgtaagggtacgggtaacgtaacgttaaccgaaaacggtaacgttggtacggtaccgtacggacctaacccgtagttccgttacgg

SEQ ID NO: 107836 - DNA, 287 bp, Homo sapiens; identical to SEQ ID NO: 107404
  misc_feature: GYAE6OF02FKNSJ.12.1.A01.1.454.CMB.1.raw
  modified_base (283)..(287): a, c, t, g, unknown or other
  misc_feature (283)..(287): n is a, c, g, or t

SEQ ID NO: 107837 - DNA, 288 bp, Homo sapiens; identical to SEQ ID NO: 107383
  misc_feature: GYAE6OF02GBY3A.12.1.A01.1.454.CMB.1.raw
  modified_base (283)..(288): a, c, t, g, unknown or other
  misc_feature (283)..(288): n is a, c, g, or t

SEQ ID NO: 107838 - DNA, 526 bp, Homo sapiens
  misc_feature: GYAE6OF02GRU9B.12.1.A01.1.454.CMB.1.raw
  modified_base (219)..(219): a, c, t, g, unknown or other
  misc_feature (219)..(219): n is a, c, g, or t
  modified_base (364)..(364): a, c, t, g, unknown or other
  misc_feature (364)..(364): n is a, c, g, or t
  modified_base (441)..(441): a, c, t, g, unknown or other
  misc_feature (441)..(441): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggnaagtcagaccatcagcagctatttaaattggtatcagcagaaaccagggaaagcccctaaggtcctgatctatgctgcatccagtttgcaaagtggggtcccatcaaggttcagtggcagtgggtctgggacagtatttcactcncaccatcagcagtctgcaacctgaagtattctgactaacttattactgtacaacgagaagttaacacgttaaccccnccctacgtttccggacggtacgggaaccaagggtcggaacgagttaccgaaaacgtacgttaggtacggtactacgacctaaccg

SEQ ID NO: 107839 - DNA, 288 bp, Homo sapiens; identical to SEQ ID NO: 107396
  misc_feature: GYAE6OF02GWL6I.12.1.A01.1.454.CMB.1.raw
  modified_base (282)..(288): a, c, t, g, unknown or other
  misc_feature (282)..(288): n is a, c, g, or t

SEQ ID NO: 107840 - DNA, 630 bp, Homo sapiens
  misc_feature: GYAE6OF02IOZTU.12.1.A01.1.454.CMB.1.raw
  modified_base (271)..(271): a, c, t, g, unknown or other
  misc_feature (271)..(271): n is a, c, g, or t
tcagatacgacgtacacgaccggtgctcgatttagacgtctcatcagggggcaggagtcagtctcagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccggccagtcaggacattagcaattattaggactggtatcagcagaagccaaggaacncccctaagtcctgatctatggtgcatccatttgacagtagtcggtcccatcaaggttcagcggcagtagatcgtaggacagtaattacgactcgtacaactaactcaacctacgccttagcacgacctagtaacgtattttacggactaactttacttacgtagtaccgtaaagttacggtttttaacttaacttttaaccccgttaggtttaaccgttttttaccgggccccgtttacgggggtaaaccccttaaccggttaaacgggtttagtaaaccgtttaacgttaacccgtaaaaccggttaacgtttaaccggtcggttaaccggttaccgtaccggttaaccccttaacgg

SEQ ID NO: 107841 - DNA, 287 bp, Homo sapiens; identical to SEQ ID NO: 107397
  misc_feature: GYAE6OF02FGO11.12.1.A01.1.454.CMB.1.raw
  modified_base (282)..(287): a, c, t, g, unknown or other
  misc_feature (282)..(287): n is a, c, g, or t

SEQ ID NO: 107842 - DNA, 291 bp, Homo sapiens
  misc_feature: GYAE6OF02GXCOS.12.1.A01.1.454.CMB.1.raw
  modified_base (284)..(291): a, c, t, g, unknown or other
  misc_feature (284)..(291): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaaacgaactgtggctgcaccatctgtcttcatcttcccgccatctgatacgtcgtatctgagcgggctggcaaggcgcatagnnnnnnnn

SEQ ID NO: 107843 - DNA, 286 bp, Homo sapiens; identical to SEQ ID NO: 107392
  misc_feature: GYAE6OF02G7Q4Q.12.1.A01.1.454.CMB.1.raw
  modified_base (281)..(286): a, c, t, g, unknown or other
  misc_feature (281)..(286): n is a, c, g, or t

SEQ ID NO: 107844 - DNA, 505 bp, Homo sapiens
  misc_feature: GYAE6OF02FJTAA.12.1.A01.1.454.CMB.1.raw
  modified_base (372)..(372): a, c, t, g, unknown or other
  misc_feature (372)..(372): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcancagtctgctaacctgaagtacttctgactaaacttattactgtacaaacagataaacacgttaccctccctactttcggacggtacgggaaccaaggtggaacgtatacgaaacgactggtggctgcctaacc

SEQ ID NO: 107845 - DNA, 284 bp, Homo sapiens
  misc_feature: GYAE6OF02F3YIA.12.1.A01.1.454.CMB.1.raw
  modified_base (279)..(284): a, c, t, g, unknown or other
  misc_feature (279)..(284): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtggagatcaaacgaactgtgctgcaccatctgtcttcatccttcccgccatctgcgtcgtatctgagcgggctggcaaggcgcatagnnnnnn

SEQ ID NO: 107846 - DNA, 512 bp, Homo sapiens
  misc_feature: GYAE6OF02I5FH9.12.1.A01.1.454.CMB.1.raw
  modified_base (263)..(263): a, c, t, g, unknown or other
  misc_feature (263)..(263): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaancccctaaggtcctgatctatgctgcatccagtttgcaaagtgggtcccatcaaggttcagtggcagtgggtctgggacagatttcactctcaccatcagcagtctgcaacctgaagtattctgactaactttacttactagtacaaacgagtaagtaacctacgtttacccctccctaacgtttcgggacggagggacccagggtggaagatacaaacgaacgtgtggctcggaccacattctgttacc

SEQ ID NO: 107847 - DNA, 283 bp, Homo sapiens
  misc_feature: GYAE6OF02FGCBD.12.1.A01.1.454.CMB.1.raw
  modified_base (278)..(283): a, c, t, g, unknown or other
  misc_feature (278)..(283): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcaccatctgtcttcatcttcccgccatctgatacgtcgtgagcgggctggcaaggcgcatagnnnnnn

SEQ ID NO: 107848 - DNA, 519 bp, Homo sapiens
  misc_feature: GYAE6OF02HUMRX.12.1.A01.1.454.CMB.1.raw
  modified_base (209)..(209): a, c, t, g, unknown or other
  misc_feature (209)..(209): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctcctgtctgcatctgtagcagacagagtcaccatcacttgccgggnaagtcagaccatcagcagctaatttaaattggtatcagcagaaaccagggaaagcccctaaggtccctgatctatgctgcatcctagtttgacaaaggtggggtacccatcaaggttcaggtggcaggtggtcgtgggactagatttcactctcacatcagcagtctgacaacctgaatattctagactaaacgtttattactacgtacaaacagtaacgtaactacgttaccctacctacgtttcggacggtacggaccagggtgacgaatacaaacgtacgtagtaggctcgacacctatctcgttac

SEQ ID NO: 107849 - DNA, 508 bp, Homo sapiens
  misc_feature: GYAE6OF02F70Q0.12.1.A01.1.454.CMB.1.raw
  modified_base (219)..(219): a, c, t, g, unknown or other
  misc_feature (219)..(219): n is a, c, g, or t
  modified_base (425)..(425): a, c, t, g, unknown or other
  misc_feature (425)..(425): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggnaagtcagaccatcagcagctatttaaatggtatcagcagaaaccagggaaacgcccctaaggtcctgatctatgctgcatccagtttcgactaaaggtcggggtacccatcgaaggtttcaggtggcgaggtgggtctgggacagtatttcactctcacctatcagcagtctgcaactgatattctgctaacttatactgtacaanagtagtaactacgttaccctaccgtacgttcggacggagggaaccaaggtggagtatacgaaacgtactggtagctgactacg

SEQ ID NO: 107850 - DNA, 290 bp, Homo sapiens
  misc_feature: GYAE6OF02HA60E.12.1.A01.1.454.CMB.1.raw
  modified_base (283)..(290): a, c, t, g, unknown or other
  misc_feature (283)..(290): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatccttcccgccatctgatacgtcgtatctgagcgggctggcaaggcgcatagnnnnnnnn

SEQ ID NO: 107851 - DNA, 522 bp, Homo sapiens
  misc_feature: GYAE6OF02HDAZQ.12.1.A01.1.454.CMB.1.raw
tcagatacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagtatttcactctcaccatcagctagtctgcaacctgaagtattctgactaacttattacttgtacaacgagtagtaactacgttaccctcctacgtttccggacgggacgggacctaagggtcggaactagaccgaaacgactggtggcttgactacctagtcgttcgtcttccacttccttaccccgctaccg

SEQ ID NO: 107852 - DNA, 645 bp, Homo sapiens
  misc_feature: GYAE6OF02G2MC2.12.1.A01.1.454.CMB.1.raw
  modified_base (269)..(269): a, c, t, g, unknown or other
  misc_feature (269)..(269): n is a, c, g, or t
  modified_base (473)..(473): a, c, t, g, unknown or other
  misc_feature (473)..(473): n is a, c, g, or t
  modified_base (491)..(491): a, c, t, g, unknown or other
  misc_feature (491)..(491): n is a, c, g, or t
  modified_base (640)..(640): a, c, t, g, unknown or other
  misc_feature (640)..(640): n is a, c, g, or t
tcagatacgacgtacacgaccggtgctcgatttagacgtctcatcaaggaagggaagggggcaggagtcagtctcagtcaggtcacagcatggacatgaggtccccgctcagctcctggggcctctgctactctggctccggtaggtcgccagtatggtgacactccagtctccgacccagtcctccactccctcccgtgtcgtgcctagtccttaggaggaagaacctaagtccaacctatcctacgttcggcccgggactaaacggngtaagttacttcgaccctaagtttaatttaaagttgtaactacaaaacaaaagcgaggaacaaaacggtacccaaagcctaccgtgtaatttacgcgtactcgccctaacgagtcgtacggacgtaagggttccgggttacccgtaagtaaacgggttcctaaggtcggtaccgtagacgtcggaagggactaagttaacttcncgtacacatcagtctcancacgtagaactatatgtacttacttagtctgtacagcagtaccgtaccgcgttcctactacttcctacgttaccggaaccgtaaggtaccacccgtacgaactaggttacgtacggaaacgtacgtaggtcggtcctaggcctaaccgnttcgg

SEQ ID NO: 107853 - DNA, 287 bp, Homo sapiens; identical to SEQ ID NO: 107404
  misc_feature: GYAE6OF02G1PQS.12.1.A01.1.454.CMB.1.raw
  modified_base (283)..(287): a, c, t, g, unknown or other
  misc_feature (283)..(287): n is a, c, g, or t

SEQ ID NO: 107854 - DNA, 294 bp, Homo sapiens
  misc_feature: GYAE6OF02F6PYS.12.1.A01.1.454.CMB.1.raw
  modified_base (168)..(168): a, c, t, g, unknown or other
  misc_feature (168)..(168): n is a, c, g, or t
  modified_base (282)..(294): a, c, t, g, unknown or other
  misc_feature (282)..(294): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaaacttattactgtcaacagagtaacagttacccncccatttcggcggaggaccaagggtggagatcaaacgactgtggctgcaccatctgtcttcatcttcccgccatctgatacgtcgtatctgagcgggctggcaaggcgcatagnnnnnnnnnnnnn

SEQ ID NO: 107855 - DNA, 285 bp, Homo sapiens
  misc_feature: GYAE6OF02H4GSL.12.1.A01.1.454.CMB.1.raw
  modified_base (280)..(285): a, c, t, g, unknown or other
  misc_feature (280)..(285): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgactgtggctgcaccatctgtcttcatcttcccgcatctgatacgtcgtatctgagcgggctggcaaggcgcatagnnnnnn

SEQ ID NO: 107856 - DNA, 556 bp, Homo sapiens
  misc_feature: GYAE6OF02H915M.12.1.A01.1.454.CMB.1.raw
  modified_base (360)..(360): a, c, t, g, unknown or other
  misc_feature (360)..(360): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctcctgtctgcatctgtagcagacagagtcaccatcacttgccgggcaagtcagaccatcagcagctatttaattggtatcagcagaaaccaggaacgccctaaggtcctgatctatgctgcatcctagttgactaaggtcgggtaccatcaaggttcagtggcaggtggtctgggacagtattcactctcacatcanctagtctcgcaaccgtgaagtacttctagtacctaacttacttactgtacaaacgtagtaacgtaaactacgtttaccctacccgttacgtttaccgggacggtacgggtaaccgacgggttaggacggtaactaaccgaaacggtaaccgttaggtaggccgtacggcctaacctacgttaccgtacgttacccg

SEQ ID NO: 107857 - DNA, 283 bp, Homo sapiens
  misc_feature: GYAE6OF02IH20S.12.1.A01.1.454.CMB.1.raw
  modified_base (263)..(263): a, c, t, g, unknown or other
  misc_feature (263)..(263): n is a, c, g, or t
  modified_base (279)..(283): a, c, t, g, unknown or other
  misc_feature (279)..(283): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggaggaccaaggtggagatacaaacgactgtggctgcaccatctgtcttcatcttcccgcatctgatacgtcgtatctgagcggntggcaaggcgcatagnnnnn

SEQ ID NO: 107858 - DNA, 285 bp, Homo sapiens
  misc_feature: GYAE6OF02HGBT2.12.1.A01.1.454.CMB.1.raw
  modified_base (281)..(285): a, c, t, g, unknown or other
  misc_feature (281)..(285): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcggctggcaaggcgcatagnnnnn

SEQ ID NO: 107859 - DNA, 501 bp, Homo sapiens
  misc_feature: GYAE6OF02F4E4R.12.1.A01.1.454.CMB.1.raw
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaaggtgggtcccatcaaggttcagtggcaggtgggtctgggacagatttcactctcaccatcagcagtctgcaacctgaagtnttcngactaacttattactgtacaacagagtaactacgttacccctcctactttcggctaggacgggaccaaggtggaagatacgaaacgtacgtgtcggctggacacctatcttacg

SEQ ID NO: 107860 - DNA, 283 bp, Homo sapiens
  misc_feature: GYAE6OF02F9TTJ.12.1.A01.1.454.CMB.1.raw
  modified_base (279)..(283): a, c, t, g, unknown or other
  misc_feature (279)..(283): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcgagggaccaaggtggagatcaaacgaactgtggctgcaccatctgtcttcatcttccgccatctgatacgtcgtatctgagcggctggcaaggcgcatagnnnnn

SEQ ID NO: 107861 - DNA, 291 bp, Homo sapiens
  misc_feature: GYAE6OF02GBKV9.12.1.A01.1.454.CMB.1.raw
  modified_base (279)..(291): a, c, t, g, unknown or other
  misc_feature (279)..(291): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggaggaccaaggtggagatcaaacgaactgtggctgcaccatctgtcttcatcttccgccatctgatacgtcgtatctgagcggctggcaaggcgcatagnnnnnnnnnnnnn

SEQ ID NO: 107862 - DNA, 556 bp, Homo sapiens
  misc_feature: GYAE6OF02JFG6W.12.1.A01.1.454.CMB.1.raw
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
  modified_base (551)..(551): a, c, t, g, unknown or other
  misc_feature (551)..(551): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagcttatttaaattggtatcagcaagaaaccagggaaacgccccgtaaggtcctgatctatgctgcatcctagtttcgacgtaaaggtcggggtaccattacgaaggttcagtgggactaggtgggtcgtaggggacagtattcactctccaccatcancagtcnacaacctgaatnttcgtgtactaacttattactgtacaacgtagtaacgtaacgtaccgtttaccctcccgttacgtttccgggacggaacgggtaaccgtagggtcgaaggtaactaaccgaaacgtacgtgtacggtcgtacgcctaactactccgtnttccg

SEQ ID NO: 107863 - DNA, 589 bp, Homo sapiens
  misc_feature: GYAE6OF02I4T4J.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaatggtatcagcaagaaacaggaagcccctaaggtcctgatctatgctgcatccgtagtttgacgtaaaggtcggggtaccccaagtacgtaaagggttcaaggttcggacgtaagggtggggttcgtagggggaacctaggtactttccactcctacaacccatccgagtactaagtctacgacctaaaccgtggaaacgtattctagtaccttaaatttacttacgtagttacaaacgtagtaacgtaaacttccgttaacccctaccttacgtttacgggacggaacggaacgaggtggacgtaataaccgaaacgtacgtggtagctacggacctactattcctgttacc

SEQ ID NO: 107864 - DNA, 811 bp, Homo sapiens
  misc_feature: GYAE6OF02JM11H.12.1.A01.1.454.CMB.1.raw
  modified_base (209)..(209): a, c, t, g, unknown or other
  misc_feature (209)..(209): n is a, c, g, or t
  modified_base (269)..(269): a, c, t, g, unknown or other
  misc_feature (269)..(269): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcacatcactgaccgggnaagtcagaccatcagcagctattaatgtatcagcagaacagggaacgccctaaggtaccngatctatgctgcatcctagtttacgacgtaaaggtcggggtacccctaagtacgtaaagggttacgtaggttacgggaccgtaagggttcgggtacgttaggggaacctaaggttaaccgtttaccgtaaccgttaccttacccgtaacctaagtaccgtaacggtaccgtaacgttaccgttacgaacccgtaaaacccgtacgggtaaaacgttacgttttaccgtaacggttaaaccctttaaaccgttttaaacgtttaaaccgtttacgtaaaccgttaaaaccgaacggtttaaaaccgttaaaaacccgttacccgttttaaccccccgttaacccgtttaaacccggttttaaccggggaacccgggggttaaacgggtaaacccccgggtaaaggggttacggggtaaaaccggttaaacggttaaaacccgtaaaaaccgggttaaacccgggttaacgggtttacgggtaacccgttacgggtaaaccccgttaacccgtaaccggtttacccgttaccggttttaccccg

SEQ ID NO: 107865 - DNA, 609 bp, Homo sapiens
  misc_feature: GYAE6OF02GZT9G.12.1.A01.1.454.CMB.1.raw
tcagatacgacgtacacgaccggtgctcgatttagacgtctcatcaggggagtctcagtcaggacacagtatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagcttaatttaaattggtatcagcaagaaaccagggaaacgccccgtaaggtcctagatctatgctgcatctagtttgacaaaggtcggggtacccagtcgtaaggttcagtggactaggttgggtcgtagggactaagtactttcaacgttcctacactataccagctagtctacgacctaaacctaggaaacgtatttaccgtagtacccttaaactttactttacttacgtaaccaactaaggtaacgttaacctaaccgtttaccccttacccgtaccgttttaccggggacggaaccgggtaccgtaaggtacgggagtaacgtaacgaaacgtacgtggtacggtactacgacctacctattcgtacgttcttaccg

SEQ ID NO: 107866 - DNA, 826 bp, Homo sapiens
  misc_feature: GYAE6OF02GSA56.12.1.A01.1.454.CMB.1.raw
tcagatacgacgtacacgaccggtgctcgatttagacgtctcatcagggattctcagtcaggacacagcatggacatgagggtccccgctcagctcctggggctcctgctactctggctccgaggtgccagatgtgacatccagatcgacccagtcctccatccctcctgtctgctatctgtacgcagacagtagtccacctatccacgttcggcccgggtactaacgtccaacggtacctatccgaagccacgtacttaaatttaaagttggtaactaccgtaagaccgaaacgaaaacccgaggggtaaacctaccccgttaaggtccctagtacttacgttagtcggtcctacgtctacgttccgtaggtttacgaacgtaaacggttccgggtacctaagtaccgtaaggtccgtaggtggaccgtaggtcgggtacgtacggggtaacctacggttaactttacccgaccgtttacgtacccgtaaccgtactaccggtaacgaccgttaacggttcgtaccggtaccgtaaaccgttagggtaaaccgttccgtttaccgacggttaccgttaaaccgttttaacgttaccgtaccggttaaccctaaaccggttaacggtaaccgtttaaacccggttaccgtttaacccccgttacccggtttaaaccgggtttcccgggaaaccgggttaaccgggtaacccggttaagggtacgggttaacgtaaccgtaaaccggtaaacccggttaaacgttcgggtaccgtaaccgtccggttaacccgtaaccgtttacgtacccggttagtttaaccccgg

SEQ ID NO: 107867 - DNA, 479 bp, Homo sapiens
  misc_feature: GYAE6OF02HFW11.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtccatcaaggttcagtggcagtgggtctgggacagatttcactctcaccatcagcagtctgcaacctgaagattctgctaacttattactgtcaacagagtaacagttaccctccactttcgcggaggaccaggtggagatacgaaacgaactgtaggctggcacatctgtc

SEQ ID NO: 107868 - DNA, 545 bp, Homo sapiens
  misc_feature: GYAE6OF02GGESR.12.1.A01.1.454.CMB.1.raw
  modified_base (256)..(256): a, c, t, g, unknown or other
  misc_feature (256)..(256): n is a, c, g, or t
  modified_base (396)..(396): a, c, t, g, unknown or other
  misc_feature (396)..(396): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaatggtatcaanagaaacagggaaagcccctaaggtcctgatctatgctgcatccagtttgactaaaggtcgggtacccatcgaaggttcagtggcagtgggtctgggacagtatttcactctcaccatcagcagtctgacaacctgaagtnttctgactaacttattactagtacaacgagtactaacgtaccgttaccctccctacgtttccggactacggaacgggtaaccaagggttacggaacgtaacgtaaccgaaaacgtacgttacggtacggtaccgtacgaccgtaacccg

SEQ ID NO: 107869 - DNA, 492 bp, Homo sapiens
  misc_feature: GYAE6OF02FXGTO.12.1.A01.1.454.CMB.1.raw
  modified_base (388)..(388): a, c, t, g, unknown or other
  misc_feature (388)..(388): n is a, c, g, or t
tcagatacgacgtacacgaccggtgctcgatttagacgtctcatcaggggagtctcagtcaggacacagcatggacatgagggtccctgctcagctcctgggactcctgctggctctggctcccagataccagatgtgacatcgagatgacccagtctccatcctccctgtctgcatctgtaggagacagagtcaccatcacttgccgggcgagtcagggcattagcaatttttagcctggtatcagcagaaaccagggaaagttccacacctcctgatctatgctgcatccgctttgcaatcagggtcccatctcggttcagcggcagtggatcgtgggacagagttcactctacaccatcagcagccctgccacgccttagaagtntgttgactaacttattactgtactaaagtataacagtcgccccttcaccgttcgaccaaggaccacgacgtggaacgtattaagacgacgtgtggctgctaccg

SEQ ID NO: 107870 - DNA, 296 bp, Homo sapiens
  misc_feature: GYAE6OF02JIN78.12.1.A01.1.454.CMB.1.raw
  modified_base (265)..(265): a, c, t, g, unknown or other
  misc_feature (265)..(265): n is a, c, g, or t
  modified_base (275)..(275): a, c, t, g, unknown or other
  misc_feature (275)..(275): n is a, c, g, or t
  modified_base (283)..(296): a, c, t, g, unknown or other
  misc_feature (283)..(296): n is a, c, g, or t
tcagatacgacgtacacgaccggtgctcgatttagacgtctcatcagggatagaagttattcagcaggcacacaacagaggcagttccagatttcactctcaccatcagcagtctgcaactgaagattctgcaacttattactgtcaacagagtaacagttaccctccactttcggcggaggaccaaggtggacatacaaagactgtggctgacaccatctgtcttcactcttcccgacatctgatacgtctatctggagcgggntggcaaggcncgataggnnnnnnnnnnnnnn

SEQ ID NO: 107871 - DNA, 288 bp, Homo sapiens
  misc_feature: GYAE6OF02HXG74.12.1.A01.1.454.CMB.1.raw
  modified_base (283)..(288): a, c, t, g, unknown or other
  misc_feature (283)..(288): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatacaaacgaactgtggctgcaccatctgtcttcatcttcccgcatctgattacgtcgtatcgtgagcggctggcaaggcgcatagnnnnnn

SEQ ID NO: 107872 - DNA, 290 bp, Homo sapiens
  misc_feature: GYAE6OF02G4XWJ.12.1.A01.1.454.CMB.1.raw
  modified_base (282)..(290): a, c, t, g, unknown or other
  misc_feature (282)..(290): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcgcatagnnnnnnnnn

SEQ ID NO: 107873 - DNA, 520 bp, Homo sapiens
  misc_feature: GYAE6OF02I63E9.12.1.A01.1.454.CMB.1.raw
  modified_base (273)..(273): a, c, t, g, unknown or other
  misc_feature (273)..(273): n is a, c, g, or t
  modified_base (362)..(362): a, c, t, g, unknown or other
  misc_feature (362)..(362): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaacncccctaaggtcctgatctatgctgcatccagtttgacaaagtgggtcccatcaaggttcagtgcagtggtctgggacagtattcactcncacatcagcagtctgcaacctgaactattctgacctaaactttattactcgtacaaacgagtaacgttaacacgttaccctccgtacgtttcggacggtaacggtacctaagggtggaagtacgtacgaaacggacgttggcggactcggactaaccg

SEQ ID NO: 107874 - DNA, 286 bp, Homo sapiens; identical to SEQ ID NO: 107379
  misc_feature: GYAE6OF02GE2UV.12.1.A01.1.454.CMB.1.raw
  modified_base (283)..(286): a, c, t, g, unknown or other
  misc_feature (283)..(286): n is a, c, g, or t

SEQ ID NO: 107875 - DNA, 522 bp, Homo sapiens
  misc_feature: GYAE6OF02IS59B.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaatggtatcagcagaaaccagggaaacgcccctaaaggtcctgatctatgctgcatccagtttgcaaagtgggtcccatcaaggttcagtggcagtgggtctgggacagatttcactctcacatcagcagtctgacaacctgaagtattctgactaaactttacttactgttacaaatagagtaactacgttaccctcctaacgtttccgggaacggacgggaccgtaaggtcgggaagactaaccgaaaacgtaacgttggtagcctagccaaccattctgttacc

SEQ ID NO: 107876 - DNA, 287 bp, Homo sapiens
  misc_feature: GYAE6OF02IUUOS.12.1.A01.1.454.CMB.1.raw
  modified_base (279)..(287): a, c, t, g, unknown or other
  misc_feature (279)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatccttcccgcatctgatacgtcgtatctgagcggctggcaggcgcatgnnnnnnnnn

SEQ ID NO: 107877 - DNA, 524 bp, Homo sapiens
  misc_feature: GYAE6OF02H6SLI.12.1.A01.1.454.CMB.1.raw
  modified_base (394)..(394): a, c, t, g, unknown or other
  misc_feature (394)..(394): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagtatttcactctcaccatcagcagtctgcaactgaagattcngactaacttattactgtacaacagtagtaacacgtttaaccctcccgtacctttccgggcggtaacgggacctaaagggtcggaacgtaactacgaaacgtaacgtacggtacgggctcggacctaaccg

SEQ ID NO: 107878 - DNA, 289 bp, Homo sapiens
  misc_feature: GYAE6OF02GMV21.12.1.A01.1.454.CMB.1.raw
  modified_base (285)..(289): a, c, t, g, unknown or other
  misc_feature (285)..(289): n is a, c, g, or t
tcagatacgacgtacacgaccggtgctcgatttagacgtctcatcagggatagaagttattcagcaggcacacaacagaggcagttccagatttcactctcaccatcagcagcctgcagtctgaagattttgcagtttattactgtcagcagtataataactggttcctgctcactttcggcgggggaccaaggtggagatcaaacgaactgtggctgcaccatctgtcttcatcttcccgccatctgatacgtcgtatctgagcgggctggcaaggcgcatagnnnnn

SEQ ID NO: 107879 - DNA, 544 bp, Homo sapiens
  misc_feature: GYAE6OF02G7ELQ.12.1.A01.1.454.CMB.1.raw
  modified_base (219)..(219): a, c, t, g, unknown or other
  misc_feature (219)..(219): n is a, c, g, or t
  modified_base (252)..(252): a, c, t, g, unknown or other
  misc_feature (252)..(252): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggnaagtcagaccatcagcagctattaatgtatcancagaaaccagggaacgccctaaggtcctgatctatgactgcatcctagtttgacgtaaaggtcggggtacccagtcaaaggtttcaggtggctaaggttgggtactgggacaggtactttcgacttctacaccatcagctagtctcgactaaaccgtgaagtattctagactaacttattactgtacaacgaagtataactacgttaccctaccgtactttcgggacggtaacggacctaagggtcggaagtacgtaacgaaacgtacgtaggtacggctacgactaacccg

SEQ ID NO: 107880 - DNA, 287 bp, Homo sapiens
  misc_feature: GYAE6OF02IOVXO.12.1.A01.1.454.CMB.1.raw
  modified_base (280)..(287): a, c, t, g, unknown or other
  misc_feature (280)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcgagggaccaaggtggagatcaaacgaactgtggctgcaccatctgtcttcatctcccgcatctgatacgtcgtatctgacgcgggctggcaaggcgcatagnnnnnnnn

SEQ ID NO: 107881 - DNA, 542 bp, Homo sapiens
  misc_feature: GYAE6OF02FW3WU.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaaggtggggtcccatcaaggttcagtggctaggtgggtctgggacaggatttcactctcaccatcagcagtctgaccaaccgtgaagtattctagctaacttattactgtacaacagtacgtaaactacgttaccctccctacttttcggacggtacgggaccgagggttcgggaagtataaccgaaaacggtaacgtacggttacggtacgtacggtacctaccgtacttccttggttacc

SEQ ID NO: 107882 - DNA, 303 bp, Homo sapiens
  misc_feature: GYAE6OF02HGP1U.12.1.A01.1.454.CMB.1.raw
  modified_base (261)..(261): a, c, t, g, unknown or other
  misc_feature (261)..(261): n is a, c, g, or t
  modified_base (298)..(303): a, c, t, g, unknown or other
  misc_feature (298)..(303): n is a, c, g, or t
tcagatacgacgtacacgaccggtgctcgatttagacgtctcatcagggatagaagttattcagcgagcacacaacagaggcagttccagtatttcactctcaccatcagcagtctgccaacctagaagtattctgactaactttattactgtacaacagagtaactacgttacccctccctactttcgggcgggaacggaccaagggtggagatacaaaacgactggtggctgcaccatctgtctcattcctccgcatcngatacgtgtatctgacgcggctgacaaggcacatagnnnnnn

SEQ ID NO: 107883 - DNA, 290 bp, Homo sapiens
  misc_feature: GYAE6OF02H3426.12.1.A01.1.454.CMB.1.raw
  modified_base (283)..(290): a, c, t, g, unknown or other
  misc_feature (283)..(290): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaaacagttaccctcccactttcggcggagggaccaaggtggagatcaaacgaactgtggctgcaccatctgtcttcatcttcccgcatctgatacgtcgtatctgagcgggctggcaaggcgacatagnnnnnnnn

SEQ ID NO: 107884 - DNA, 546 bp, Homo sapiens
  misc_feature: GYAE6OF02FXU5B.12.1.A01.1.454.CMB.1.raw
  modified_base (391)..(391): a, c, t, g, unknown or other
  misc_feature (391)..(391): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaacgcccctaaggtcctgatctatgctgcatccagtttgcaaagtggggtcccagtcaaggttcagtggcagtgggtctggggacagtatttcactctcaccatcagcagtctgacaacctgaagtattcngtactaacttattactagtacaacagtaagtaacctacgttaacccctccctaacgtttaccggaccgggaagggtacccgtaggtaggaacgtaacgtaaccgaaacggtaacgttggtacggacttagacccaccgtattccgttgtttaccc

SEQ ID NO: 107885 - DNA, 285 bp, Homo sapiens
  misc_feature: GYAE6OF02GULNE.12.1.A01.1.454.CMB.1.raw
  modified_base (282)..(285): a, c, t, g, unknown or other
  misc_feature (282)..(285): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcacatctgtcttcatccttccgccatctgatacgtcgtatctgagcgggctggcaaggcgcatagnnnn

SEQ ID NO: 107886 - DNA, 283 bp, Homo sapiens
  misc_feature: GYAE6OF02HMRNR.12.1.A01.1.454.CMB.1.raw
  modified_base (273)..(273): a, c, t, g, unknown or other
  misc_feature (273)..(273): n is a, c, g, or t
  modified_base (279)..(283): a, c, t, g, unknown or other
  misc_feature (279)..(283): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatcttcccgcatctgatacgtcgtatctgagcggctggcaggcncatagnnnnn

SEQ ID NO: 107887 - DNA, 289 bp, Homo sapiens; identical to SEQ ID NO: 107371
  misc_feature: GYAE6OF02FV90A.12.1.A01.1.454.CMB.1.raw
  modified_base (283)..(289): a, c, t, g, unknown or other
  misc_feature (283)..(289): n is a, c, g, or t

SEQ ID NO: 107888 - DNA, 515 bp, Homo sapiens
  misc_feature: GYAE6OF02GD0FB.12.1.A01.1.454.CMB.1.raw
  modified_base (263)..(263): a, c, t, g, unknown or other
  misc_feature (263)..(263): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctattaaattggtatcagcagaaaccagggaaacncccctaaggtcctgatctatgctgcatccagtttgcaaagtgggtccatcaagttcagtggcagtgggtctgggacagatttcgactctcaccatcagcagtctgcaactgaagnttcngctaacttattactgtacaaacgagacgtaacacgttaccctaccctacgtttcggacggacgggtaccgagggtcggaagaactaccgaaaacgtaacgttaggtacgcgtgacctaccattccgtgttacg

SEQ ID NO: 107889 - DNA, 286 bp, Homo sapiens; identical to SEQ ID NO: 107417
  misc_feature: GYAE6OF02IHEPA.12.1.A01.1.454.CMB.1.raw
  modified_base (282)..(286): a, c, t, g, unknown or other
  misc_feature (282)..(286): n is a, c, g, or t

SEQ ID NO: 107890 - DNA, 286 bp, Homo sapiens; identical to SEQ ID NO: 107445
  misc_feature: GYAE6OF02FRVEV.12.1.A01.1.454.CMB.1.raw
  modified_base (282)..(286): a, c, t, g, unknown or other
  misc_feature (282)..(286): n is a, c, g, or t

SEQ ID NO: 107891 - DNA, 557 bp, Homo sapiens
  misc_feature: GYAE6OF02IIU64.12.1.A01.1.454.CMB.1.raw
  modified_base (209)..(209): a, c, t, g, unknown or other
  misc_feature (209)..(209): n is a, c, g, or t
  modified_base (266)..(266): a, c, t, g, unknown or other
  misc_feature (266)..(266): n is a, c, g, or t
  modified_base (397)..(397): a, c, t, g, unknown or other
  misc_feature (397)..(397): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcacatcacttgccgganaagtcagaccatcaagcagctaatttaaattggtatcagcaagaaaccagggaaacncccctaaaggtcctagaatcctaatgactgcaatcctagtttgacaaagtcgggtccatacgaaggttcagtggactaggtgggtactgggaactaggtatttacgacttccgtacaccatacagcagtcngacaacctgaagtattctacgactaacttattactagtacaacaagaacgtaacacgttaacccctaccttaccgtttacggaccgggtaacggaaccgaggttacggagtaactaacgaaacgtaacgtgacgctacggaccaccgtatcctagttacc

SEQ ID NO: 107892 - DNA, 290 bp, Homo sapiens
  misc_feature: GYAE6OF02GOIS8.12.1.A01.1.454.CMB.1.raw
  modified_base (284)..(290): a, c, t, g, unknown or other
  misc_feature (284)..(290): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatccttcccgccatctgatacgtcgtatctgagcgggctggcaaggcgcatagnnnnnnn

SEQ ID NO: 107893 - DNA, 292 bp, Homo sapiens
  misc_feature: GYAE6OF02IRAHW.12.1.A01.1.454.CMB.1.raw
  modified_base (281)..(292): a, c, t, g, unknown or other
  misc_feature (281)..(292): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtggagatcaaacgaactgtggctgcaccatctgtcttcatcttcccgcatctgatacgtcgtatctgagcgggctggcaaggcgcatagnnnnnnnnnnnn

SEQ ID NO: 107894 - DNA, 671 bp, Homo sapiens
  misc_feature: GYAE6OF02I646A.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctgtctccgaggtgccagatgtgacatccagatgacccagtctccatcctcctgtctgcatctgtagcagacagagtccaccatcacttgccgggcaagtcagaccatcagcagctatttaattggtatcagcaagaaaccgagggaacgcccctaaggtcctgatctatgctgcatcctagtttcgacgtaaaggtcgggtacccagtacgtaaggttacgtaggtcggacgtaggtcgggtacgtaggggaactaaggtacttttaccaccgttaccgtacctaaccctagttacccgagtacctagttccgtacgaaccctaaacccgttaggaaacgttacgtttcgtacggtaccttaaacctttaactttaaccgttacgttaaccaaacgtaaggtaaccgttaaacctaaccggttttaaccccctacccgttaaccggtttaccgggaacgggtaaccgggaccgtaaggggtacggaacggtaactaaccggaaaacgtacgttacggtacggactaccggtaccaccgtacgttaccgtcgttacc

SEQ ID NO: 107895 - DNA, 288 bp, Homo sapiens; identical to SEQ ID NO: 107396
  misc_feature: GYAE6OF02HKZW7.12.1.A01.1.454.CMB.1.raw
  modified_base (282)..(288): a, c, t, g, unknown or other
  misc_feature (282)..(288): n is a, c, g, or t

SEQ ID NO: 107896 - DNA, 287 bp, Homo sapiens
  misc_feature: GYAE6OF02G3O9Y.12.1.A01.1.454.CMB.1.raw
  modified_base (280)..(287): a, c, t, g, unknown or other
  misc_feature (280)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtctcatcttcccgcatctgatacgtcgtatctgagcgggctggcaaggcgcatagnnnnnnnn

SEQ ID NO: 107897 - DNA, 590 bp, Homo sapiens
  misc_feature: GYAE6OF02IFZFK.12.1.A01.1.454.CMB.1.raw
  modified_base (264)..(264): a, c, t, g, unknown or other
  misc_feature (264)..(264): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaatggtatcagcaagaaaccagggaaacncccctaaggtcctgatctatgctgcatcctagttttcaaagtgggtccatcaaggttcagtggactagtgggtctgggacagatttcactctcaccatcagctagtctgaccaacgtgaagtacttcgtgtactaaactttacttaactcgtaaccaaacaaggtaacgtaaaccgtaacgtttaacccctcccttaacgttttccgggaacgggtacgggtaaaccgaagggtacggtaacggtaactaaccggtaaaaacgtaaccggttggtacgggtacctacggacctaacccgtacgttaccgtttcggtacctttaccg

SEQ ID NO: 107898 - DNA, 294 bp, Homo sapiens
  misc_feature: GYAE6OF02IDGWK.12.1.A01.1.454.CMB.1.raw
  modified_base (281)..(294): a, c, t, g, unknown or other
  misc_feature (281)..(294): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcgagggaccaaggtggagatcaaacgaactgtggctgcaccatctgtcttcatcttcccgcatctgatacgtcgtatctgagcgggctggcaaggcgcatagnnnnnnnnnnnnnn

SEQ ID NO: 107899 - DNA, 287 bp, Homo sapiens
  misc_feature: GYAE6OF02HR3O3.12.1.A01.1.454.CMB.1.raw
  modified_base (280)..(287): a, c, t, g, unknown or other
  misc_feature (280)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatctcccgcatctgatacgtcgtatctgagcgggctggcaaggcgcatagnnnnnnnn

SEQ ID NO: 107900 - DNA, 699 bp, Homo sapiens
  misc_feature: GYAE6OF02IH55V.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtccaccatcacttcggccgggcaagtcagaccatcagcagcttaatttaaattggtatcagcaagaaaccgagggaaacgccccgtaaggtcctagatctatgctgctatcctagtttgacgtaaacggtcggggtccctaagtacgtaaggtttcgaaggtcgggacgtacgggttggggttcgtacggggtactaacggttacttttccgacctttacctaccaaccgtactacgacgacctagttccgtacgtacctaacccgttaagaacgttaacgtttcctacggtaaccttaaacgttttaactttaccgttacgttaaccaaaacgtaacgttaaaccgttaaaccttaaccggtttaaccccccttcccgttaacccggtttaccggggaaccggtaacggggtaaacccggtaaggggtacgtaaacggtaacgttaaccggaaacggtaaccggttcgggtacggtaccgtaccggtaccctaacccg

SEQ ID NO: 107901 - DNA, 582 bp, Homo sapiens
  misc_feature: GYAE6OF02HS3YN.12.1.A01.1.454.CMB.1.raw
  modified_base (425)..(425): a, c, t, g, unknown or other
  misc_feature (425)..(425): n is a, c, g, or t
  modified_base (455)..(455): a, c, t, g, unknown or other
  misc_feature (455)..(455): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagatcaccatccacttgccgggcaagtcagaccatcagcagcttaatttaaaattggtatcagcaagaaaaccaggggaaacgacccctaaaggtccctgatctatgctgcatcctagtttgacgtaaaggtcggggtacccatcgaaaggtttcaaggtgggactaggtcggggtctaggggactaggtatttccactctccacctatcagcagtctagacctaacctagaatcttnagtacctaactttaagttactacgtacaanaagtaagtaacctacgttaaccctccttaacgtttcgggaccgggtaacgggaccgaagggttcggaagtaacgtaaccgaaaacggtaacgttggtacggtcgtagacccacgtactctgttaccc

SEQ ID NO: 107902 - DNA, 495 bp, Homo sapiens
  misc_feature: GYAE6OF02JC3L3.12.1.A01.1.454.CMB.1.raw
  modified_base (211)..(211): a, c, t, g, unknown or other
  misc_feature (211)..(211): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgcccgggnaagtcagaccatcagcagctatttaaattggtatcagcagaaaccagggaaagcccctaaggtcctgatctatgctgcatccagtttgcaaagtggggtcccatcaaggttcagtggcagtggtctgggacagatttcatctcaccatcagcagtctgcaacctgaagtattctgactaacttattactgtacaacagactaacacgttaccctcctacgttcggcgggacggaccgaggtcggagtatacaaacggactagtggctcgcaccatcctgttacc

SEQ ID NO: 107903 - DNA, 490 bp, Homo sapiens
  misc_feature: GYAE6OF02GJISQ.12.1.A01.1.454.CMB.1.raw
  modified_base (383)..(383): a, c, t, g, unknown or other
  misc_feature (383)..(383): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (485)..(485): a, c, t, g, unknown or other
  misc_feature (485)..(485): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgactaaagtgggtccatcaaggttcagtggcaggtggtcgtgggactaggatttcgactctcaccatcagcagtctgcaactaganattctagcaattattactntcaanagagtaacacgttaccctccactttcggacgacggaccgaggtggagatacaaacgtaactgtaggctcgcacattcngttcc

SEQ ID NO: 107904 - DNA, 659 bp, Homo sapiens
  misc_feature: GYAE6OF02JT6K7.12.1.A01.1.454.CMB.1.raw
  modified_base (258)..(258): a, c, t, g, unknown or other
  misc_feature (258)..(258): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaatgtatcaagcagaacaggaacncccctaaggtcctgatctatgctgccaactccgtagtttcgacgtaaaggttcgggtaccctaataccgtaaggttaccaggttcggacgtaacgggttggggttaccgtaggggtaaccgtaagggttacttttaccgaacctttccgttaccgaaccgtactaccggacgtactaacggttcctaggaacctaaaccgttggaaacgttactttccggtacgtaccttaaaactttacgttactacggtaacaaacgtagttaaccgtaacttaaccgttacccctactaccggtttccgggaaggtaaccggtaacgtaagggtcgaagtaacgtaaaccgtaaacggaaccgttcgtagggaccttggtaccgaaacccttcgttacgtagttaccg

SEQ ID NO: 107905 - DNA, 584 bp, Homo sapiens
  misc_feature: GYAE6OF02FKPNN.12.1.A01.1.454.CMB.1.raw
  modified_base (337)..(337): a, c, t, g, unknown or other
  misc_feature (337)..(337): n is a, c, g, or t
tcagatacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtcccatcaaggttcagtggcagtggtctgggacagtatttcactntcacatcagcagtctgcaactgaagattctgacaactttattactgtacaacagaagtaaccacgtttaccctccctaacgttttccgggaccggtaacgggtaacccgaaagggttacgggaacgtaacgtaacgtaaaaccgtaacgttaggttacggggtcctaggtacccgtaacccgtaacgttaccgttaccggtttactttacccgtaacctttcccgtttacccccggaccttaaccgg

SEQ ID NO: 107906 - DNA, 565 bp, Homo sapiens
  misc_feature: GYAE6OF02FZGT7.12.1.A01.1.454.CMB.1.raw
  modified_base (402)..(402): a, c, t, g, unknown or other
  misc_feature (402)..(402): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaatggtatcagcagaaaccagggaacgccctaaggtcctgatctatgctgcatccagtttgactaaaggtcggggtcccagttcgaaaggttcaaggtggactaggtgggtcgtgggactaggtactttcgactctcacctatcagctagtctgacaacctgaagtnttctagactaacttattactgtacaacagtaagtaaacctacgttaccctacccgtaacgtttcggacggaacgggtaaccgtagggtacggaacggtaactaacgaaaccggtaacgtacggttacggacttcggacctaaccgtacgttcgttagttaccc

SEQ ID NO: 107907 - DNA, 286 bp, Homo sapiens
  misc_feature: GYAE6OF02GS8VG.12.1.A01.1.454.CMB.1.raw
  modified_base (276)..(276): a, c, t, g, unknown or other
  misc_feature (276)..(276): n is a, c, g, or t
  modified_base (282)..(286): a, c, t, g, unknown or other
  misc_feature (282)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcgggctggcaaggcncatagnnnnn

SEQ ID NO: 107908 - DNA, 285 bp, Homo sapiens; identical to SEQ ID NO: 107796
  misc_feature: GYAE6OF02F1I2D.12.1.A01.1.454.CMB.1.raw
  modified_base (282)..(285): a, c, t, g, unknown or other
  misc_feature (282)..(285): n is a, c, g, or t

SEQ ID NO: 107909 - DNA, 307 bp, Homo sapiens
  misc_feature: GYAE6OF02FLYHT.12.1.A01.1.454.CMB.1.raw
  modified_base (283)..(307): a, c, t, g, unknown or other
  misc_feature (283)..(307): n is a, c, g, or t
tcagatacgacgtacacgaccggtgctcgatttagacgtctcatcagggatagaagttattcagcaggcacacaacagaggcagttccaagatttcactctcaccatcagcagtctgcaacctgaagattctgcaacttattactgtcaacagagtaacagttaccctcccactttcggcgagggaccaaggtggagatcaaacgaactgtggctgcaccatctgtcttcatcttcccgccatctgatacgtcgtatctgagcggctggcaaggcgcataggnnnnnnnnnnnnnnnnnnnnnnnnn

SEQ ID NO: 107910 - DNA, 290 bp, Homo sapiens
  misc_feature: GYAE6OF02G5TVZ.12.1.A01.1.454.CMB.1.raw
  modified_base (282)..(290): a, c, t, g, unknown or other
  misc_feature (282)..(290): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaagggtggagatcaaacgactgtggctgcaccatctgtcttcatcttcccgcatctgatacgtcgtatctgagcgggctggcaaggcgcatagnnnnnnnnn

SEQ ID NO: 107911 - DNA, 605 bp, Homo sapiens
  misc_feature: GYAE6OF02I4G4H.12.1.A01.1.454.CMB.1.raw
  modified_base (312)..(312): a, c, t, g, unknown or other
  misc_feature (312)..(312): n is a, c, g, or t
tcagatacgacgtacacgaccggtgctcgatttagacgtctcatcaaggaagggaagggggcaggagtcagtctcagtcaggtcacagcatggacatgagggtccccgctcagctcctggggctcctgctactctggctccgaggtgccagatgtgacatccagctgacccagtcctccatcctcctgtctgcatctgtagagacaaagtcaccatcacttcgccgggactaacgagagtattgacctacgtatttaaattggtaatacaaacaaaagcaaggacaaagtcccaaagcctcctagtatttangctcgccaccagtctgcgtaagggttcgggttacccgtagtaacggttcaacgttgggaccgtggaacttcgaagggtacaagtaatttactcctcaacctatacagttacgtctacgagtacctagaagtatattcgtacttaactttattactgtcagcaagtacgttaccgcgtccgtcccattcctacgtttccggaccgaaggggaccaaccggtaccgacgtaacggtaacgttacgggaacgttaacgttcggtacgggtacttaccggacctaccgtacttaccg

SEQ ID NO: 107912 - DNA, 597 bp, Homo sapiens
  misc_feature: GYAE6OF02JX1AG.12.1.A01.1.454.CMB.1.raw
  modified_base (558)..(558): a, c, t, g, unknown or other
  misc_feature (558)..(558): n is a, c, g, or t
tcagatacgacgtacacgaccggtgctcgatttagacgtctcatcaggggagtctcagtcaggacacagcatggacatgaggttccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctaattaattggtatcagcaagaaaccagggaaacgccccgtaaggtcctggatctagtcggctgacatcctagtttcgactaaaggtcgggtacccagtacgtaaggttcaaggtcggacgtaaggttcggggtactggggaactaggtaactttccgaaccgttctaccaacctactaccgacgtactacgtccttacgactaaacccgttggaaactacgttctacggtactaaccgtttattacctagttacaaacgtaggtaacgtaaacgtacgttacccctacgtacgttacggacgggaacggtaccgaggtcggaaggtanaaccgaaaggtactgtaggctacgctacagtcgtagtcc

SEQ ID NO: 107913 - DNA, 631 bp, Homo sapiens
  misc_feature: GYAE6OF02F9NOZ.12.1.A01.1.454.CMB.1.raw
  modified_base (219)..(219): a, c, t, g, unknown or other
  misc_feature (219)..(219): n is a, c, g, or t
tcagatacgacgtacacgaccggtgctcgatttagacgtctcatcagggggcaggagtcagtctcagtcaggacacagcatggacatgagggtccccgctcagctcctgggctcctgctactctggctccgaggtgccagatgtgacatccagatgacccagtctccatccctccctgtctgcatctgtagcagacagagtcaccatcacttgccgganaagtcagaccatcagcagctaatttaattggtatcagcagaaaccagggaagccccgtaaggtcctagatctatgctgcatcctagtttgacgaaagttcggggtccctagtacgtaaggttcaggtggactaggtgggtccgtaggggactagtacttttcgaccttcctaccacccgtatccgaagacctagtcctagacctaaaccgtggaaacgtattctacgtacctaactttaacttaacgttgtaccgtaaacgaagtaacgttaaactaccgtttaccccgttaacccgttaccgtttacccggacgggtaaccgggtaacccggaagggtaacgggtaacgtaacgtaaaccgtaaaccggaaccgtttacgggtacgggtaccttaccggaccgtaacccgg

SEQ ID NO: 107914 - DNA, 287 bp, Homo sapiens
  misc_feature: GYAE6OF02HS955.12.1.A01.1.454.CMB.1.raw
  modified_base (275)..(275): a, c, t, g, unknown or other
  misc_feature (275)..(275): n is a, c, g, or t
  modified_base (281)..(287): a, c, t, g, unknown or other
  misc_feature (281)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcggctggcaaggcncatagnnnnnnn

SEQ ID NO: 107915 - DNA, 282 bp, Homo sapiens
  misc_feature: GYAE6OF02HMI1P.12.1.A01.1.454.CMB.1.raw
  modified_base (278)..(282): a, c, t, g, unknown or other
  misc_feature (278)..(282): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatctcccgcattgatacgtctatctgagcgggctggcaaggcgcatagnnnnn

SEQ ID NO: 107916 - DNA, 509 bp, Homo sapiens
  misc_feature: GYAE6OF02GAU3G.12.1.A01.1.454.CMB.1.raw
  modified_base (373)..(373): a, c, t, g, unknown or other
  misc_feature (373)..(373): n is a, c, g, or t
  modified_base (432)..(432): a, c, t, g, unknown or other
  misc_feature (432)..(432): n is a, c, g, or t
  modified_base (478)..(478): a, c, t, g, unknown or other
  misc_feature (478)..(478): n is a, c, g, or t
tcagatacgacgtacacgaccggtgctcgatttagacgtctcatcagggggcaggagtcagtctcagtcaggacacagcatggacatgagggtcccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtcccatcaaggttcagtgcagtggtctgggacagatttcactctcacatcagcagtcngcaacctgaagtatctgactaactttatactgtacaactagaagtaactacgttacccncctactttcgggacggtacgggaacccaagggtcggaagtacgaanaaaccggtacgtggtaggcttggctaacccg

SEQ ID NO: 107917 - DNA, 548 bp, Homo sapiens
  misc_feature: GYAE6OF02JXFH7.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaatggtatcagcaagaaaccagggaaacgcccctaaaggtcctgactctatgctgcatccagttgacaaaggtcggggtcccatcgaaggttcagtagcgtagtgggtctggggactaggtatttcacttctcaaccatcagcagcctgactagggccgtaagacgttgtacggtcgtttaagttttactttttgactacgtactaattacttatactacttaccgtccgtactcgtaccgtttcgggacggtaacggtaccgtaagggtcgaagtactaacgaaacggtacgttggaggtccg

SEQ ID NO: 107918 - DNA, 509 bp, Homo sapiens
  misc_feature: GYAE6OF02FGY1V.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctattttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaaccgtgaagattctcgactaactttattactgtacaacagaagtaacacgttaccctccacgtttcggacggacgggaccaagggtcggagactacgaaacgtacgtagtcggacgtgacctaaccg

SEQ ID NO: 107919 - DNA, 827 bp, Homo sapiens
  misc_feature: GYAE6OF02HSYD9.12.1.A01.1.454.CMB.1.raw
  modified_base (190)..(190): a, c, t, g, unknown or other
  misc_feature (190)..(190): n is a, c, g, or t
  modified_base (278)..(278): a, c, t, g, unknown or other
  misc_feature (278)..(278): n is a, c, g, or t
tcagatacgacgtacacgaccggtgctcgatttagacgtctcatcagggggcaggagtcagtctcagtcaggacacagcatggacatgagggtcccgctcagctcctgggctcctgctactctggctccgaggtgccagatgtgacatccagatcgacccagtctccatccctcctgtctgcatctgtancagacagagtcacatcacttggccggacaagtcagaccatcagcagtcttaatttaagttggttatcagacaagaaaccgaaggaacncccgttaagtcctagtaactctatgactcgacacgttcctagtttacgacgtaaaggtccggggtaacccaagttacggtaacggtttcgaggttcgggacctagggttcggggttaccggttaggggaacctaaggtttacttttacccgaccgtttacgtttaccccgaaccgttaccgttacgaaaccggttccgtaacgtttcccgtacggtaacccgtaaacccggttaggttaaacgttaccgttttaccgtagttaaaaccccgttttaactttttaaaccgtttaaccgttaaccggttaaacccgtaaacgtaaacggttaaaccgttaaacccgttttaaaccccggtttaaccccctttaccccgggttaaaccgggtttttccccggggggaaaacccggggttaaccgggggttaaaaccccggtaaacgggggtttacggtaaaccgttaaacccggttaaaccggtaaacccgggttaccggtttagggggttaccccgttaaccggttacccggaaacccgtttaaccccggg

SEQ ID NO: 107920 - DNA, 537 bp, Homo sapiens
  misc_feature: GYAE6OF02IF1W0.12.1.A01.1.454.CMB.1.raw
  modified_base (505)..(505): a, c, t, g, unknown or other
  misc_feature (505)..(505): n is a, c, g, or t
tcagatacgacgtacacgaccggtgctcgatttagacgtctcatcagggcacagcatggacatgagggtccccgctcagctcctgggctcctgctactctggctccgaggtgccagatgtgacatccagatgacccagtctccatcctccctgtctgcatctgtagcagacagagtcaccatcacttgccgggcaagtcagaccatcagcagctattaattggtatcagcagaaaccagggaagcccctaaggtcctgatctatgctgcactcagtttgacaagtcgggtccagtcaaggttcagtggcagtgggtctgggacagtatttcgactctacacatcagcagtctgacaacctgaacgattcagtactaacttattacgtagtacaacagtataaaccacgttaccctcccgtacgtttccggacgggtacgggtaacctaagggtcggaagacgttacaaacgtacgtagtcggacctcgacgtacctattccgttntaccgtttacacgtttcctcccgaccttaacg

SEQ ID NO: 107921 - DNA, 590 bp, Homo sapiens
  misc_feature: GYAE6OF02I32NT.12.1.A01.1.454.CMB.1.raw
  modified_base (363)..(363): a, c, t, g, unknown or other
  misc_feature (363)..(363): n is a, c, g, or t
tcagatacgacgtacacgaccggtgctcgatttagacgtctcatcaggggagtctcagtcaggacacagcatggacatgagggtccccgctcagctcctgggggctcctgctactctggctccgaggtgccagatgtgacatccagatgacccagtctccatcctcctgtctgcatctgtagcagacagagtcaccatcacttggccgggcaagtcagaccatcagcagctaatttaaattggtatcagcagaaccagggaaacgcccctaaggtcctagatctatgctgcatccctagtttgactaaaggtggggtacccattacgaaggttcaaggtggcgtaggtgggtcgtggggaacngtatttcacttcgtcgacctatcagctaggtctgacaacctgaaactcttcgacgtaacctaactttacttacttcgtaaccaaagtacgtaacgttaaaccgtaccgtttaacccctccgttaaccggtttacggaccgggtaacgggtaccgtaacgggtacggacggtaataaccgaaacggtaacgtggtacggacgtctaccgacctagttcctaggttacc

SEQ ID NO: 107922 - DNA, 288 bp, Homo sapiens
  misc_feature: GYAE6OF02JR5GJ.12.1.A01.1.454.CMB.1.raw
  modified_base (281)..(288): a, c, t, g, unknown or other
  misc_feature (281)..(288): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttacccgtcccactttcggcggagggaccaaggtggagatcaaacgaactgtaggctgcaccatctgtcttcatcttccgcatctgatcgtcgtatctgagcggctggcaaggcgcatagnnnnnnnn

SEQ ID NO: 107923 - DNA, 598 bp, Homo sapiens
  misc_feature: GYAE6OF02GV6LE.12.1.A01.1.454.CMB.1.raw
  modified_base (268)..(268): a, c, t, g, unknown or other
  misc_feature (268)..(268): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatccctccctgtctgcatctgtagcagacagagtcaaccatcacttgccgggcaagtcagaccatcagcagcttatttaaattggtatcagcaagaaaccagggaaacncccctaaaggtcctagactctatgctgctatcctagtttgacgtaaaggtcggggtaccagtacgaaaggttcaggttggctaggtcgggtcgtagggacctaagtactttcgaccttctaccgaacctatcacgtctagttcctagacctaacgtagaacgtactttcgtagtacctaaactttattacgtcgttaacaaacgtaagaacgttaaacctaccgttaacccctcccgttaacgtttccggacgggtacggaaccgtagggtcggaagtaactaacgaaacgtacgtaggtagacttcgacctaacacttacgtgtttacc

SEQ ID NO: 107924 - DNA, 486 bp, Homo sapiens
  misc_feature: GYAE6OF02FF9F5.12.1.A01.1.454.CMB.1.raw
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaattggtatcagcagaaaccagggaagcccctaaggtcctgatctatgctgcatccagtttgcaaagtgggtccatcaagttcagtggcagtgggtctgggacagatttcactctcaccatcancagtctgcaacctgacattcngctaacttattactgtacaacagataactacgttaccctccctactttcggcgtaggacgaggtggagtaactacaaacggtactgtgctcggaccacatctgttcc

SEQ ID NO: 107925 - DNA, 295 bp, Homo sapiens
  misc_feature: GYAE6OF02GI1N9.12.1.A01.1.454.CMB.1.raw
  modified_base (276)..(276): a, c, t, g, unknown or other
  misc_feature (276)..(276): n is a, c, g, or t
  modified_base (282)..(295): a, c, t, g, unknown or other
  misc_feature (282)..(295): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatcgtcgtatctgagcggactggcaaggcncatagnnnnnnnnnnnnnn

SEQ ID NO: 107926 - DNA, 619 bp, Homo sapiens
  misc_feature: GYAE6OF02JHRJG.12.1.A01.1.454.CMB.1.raw
  modified_base (371)..(371): a, c, t, g, unknown or other
  misc_feature (371)..(371): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctcctgtctgcatctgtagcagacagagtcaccatcacttgccgggcaagtcagaccatcagcagctatttaaatggtatcagcagaaaccagggaaacgcccctaaaggtcctagatctatgactgcatccagtttgcaagtgggtcccatcgaagttcagtcggcagtgggtctgggacaggtatttcgacttcgtacaccatcgancgtaagtcctaggaccaactggaaatacttctgaccttaacttacgttactgtactaaacagtaacgttaaaccgtacgttaaccccgttacccttaacggttttccgggaaccgggtacgggggtaacccaagggggttacggaacggtaaacgttaacccggaaaaaccggtaccggttaccggtttaacgggcgttaccgggaacccttaacccggaacgtttacccgttacgggttttaacccc

SEQ ID NO: 107927 - DNA, 362 bp, Homo sapiens
  misc_feature: GYAE6OF02FGGY7.12.1.A01.1.454.CMB.1.raw
  modified_base (144)..(144): a, c, t, g, unknown or other
  misc_feature (144)..(144): n is a, c, g, or t
  modified_base (159)..(159): a, c, t, g, unknown or other
  misc_feature (159)..(159): n is a, c, g, or t
  modified_base (290)..(290): a, c, t, g, unknown or other
  misc_feature (290)..(290): n is a, c, g, or t
  modified_base (292)..(362): a, c, t, g, unknown or other
  misc_feature (292)..(362): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattacngtcaacagagtaacngttaccctcccactttcggcggaggaccaaggtgagatacaaacgactgtgctgcaccatctgtctcagtctcccgcatctgactacgtcgtatcgtggagtccgggctgggaccaaggccgactagtagnannnnnnnnnnnnnnnnnnnnnnnnnnnnnnnnnnnnnnnnnnnnnnnnnnnnnnnnnnnnnnnnnnnnnnn

SEQ ID NO: 107928 - DNA, 291 bp, Homo sapiens
  misc_feature: GYAE6OF02G44JH.12.1.A01.1.454.CMB.1.raw
  modified_base (278)..(278): a, c, t, g, unknown or other
  misc_feature (278)..(278): n is a, c, g, or t
  modified_base (284)..(291): a, c, t, g, unknown or other
  misc_feature (284)..(291): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatccttcccgccatctgatacgtcgtatctgagtcgggctggcaagggcncatagnnnnnnnn

SEQ ID NO: 107929 - DNA, 290 bp, Homo sapiens
  misc_feature: GYAE6OF02G9F4X.12.1.A01.1.454.CMB.1.raw
  modified_base (282)..(283): a, c, t, g, unknown or other
  misc_feature (282)..(283): n is a, c, g, or t
  modified_base (285)..(290): a, c, t, g, unknown or other
  misc_feature (285)..(290): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcgggctggcaaggcgcatagnngnnnnnn

SEQ ID NO: 107930 - DNA, 851 bp, Homo sapiens
  misc_feature: GYAE6OF02JC1XQ.12.1.A01.1.454.CMB.1.raw
tcagatacgacgtacacgaccggtgctcgatttagacgtctcatcagggggcaggagtcagtctcagtcaggacacagcatggacatgagggtccccgctcagctccgtggggctcctgctactcgtggctccgaggtgccagatgtgacatccagatcgacccagtcctccatccctcctgtctgctatctgtagcagacagacgtacaccatccacgttcggaccgggacaagtcaagaccatacagcagtacttaatttaaagttggtatacgagacaaacggaaaacccgtaggggaaacccgtaccccgttaagggtccctaggtaactacgtaacgtcggtactacgctacttaccgtaggtttacgaacgtaaggtccgggtacccaagttacgtaaggttcgaaggtcggacgtacgggttacgggtacgtacggggtaacgtacggttactttaccgacgttaccgtaccaaccgtacgttaccgaacgtcgtaaacggttccgtaaccggtaccgtaaaacccgtttaggtaaacgtttacgttttacccgaacgttaacccgtttaaacgttttaacccgttttaacgttaccgtaaacccgtaaaccggttaaacggtttaaaacccggttaaaccccgtttaaaccccggttttaaaccccccgttaaccgtttaaacccggggttttaccgggggaacccgggggttaaacccggggtaaacccgggttaaacggggtttaccgggtaaacgttaacccggttaaaccggttaaaacccggttaccggtttacgggtaaccccgggttacggttacccggtaacccgttaaccccgg

SEQ ID NO: 107931 - DNA, 566 bp, Homo sapiens
  misc_feature: GYAE6OF02FVWWR.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaacgcccctaaggtcctgatctatgctgcatcctagtttgacaagtggggtccatcaaggttcagtggcagtgggtcgtgggacagtatttcgactctacaccatcagcagtctgacaaccgtagaagtattcgtacgactaactttattacgtacgtacaaacgtagtaagttaaacctacgtttaacccctacccgttaacgtttccgggaccgggtaacgggtaacccgaaggggttaggaacgtaacgtaaccgtaaaccggtaacgttcggtacggcttacggcctaacccg

SEQ ID NO: 107932 - DNA, 599 bp, Homo sapiens
  misc_feature: GYAE6OF02FINPT.12.1.A01.1.454.CMB.1.raw
  modified_base (262)..(262): a, c, t, g, unknown or other
  misc_feature (262)..(262): n is a, c, g, or t
  modified_base (282)..(282): a, c, t, g, unknown or other
  misc_feature (282)..(282): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaatggtatcagcagaaaccagggaacncccctaaggtcctgatctangctgctatcctagtttacgcaaaggtcgggtaccatcaaggttcaggtgacagtgggtctagggactagtactttcactcacaccatcagctagtctacgaccaaccgttgaacgtattcgtacgtaccttaaacgtttacttaacgtgtaaccgtaaactaacggaacgttaaacctaccgtttaacccccttcccgtaaacttttccgggactttacgggaacgggtaccgtaaacgggtacgggtaacgtaacgtaaccggaaaccgttaaccgtaggtcggtacctacggtaccaaccctacgttccttaccg

SEQ ID NO: 107933 - DNA, 313 bp, Homo sapiens
  misc_feature: GYAE6OF02G8GYC.12.1.A01.1.454.CMB.1.raw
  modified_base (266)..(266): a, c, t, g, unknown or other
  misc_feature (266)..(266): n is a, c, g, or t
  modified_base (296)..(313): a, c, t, g, unknown or other
  misc_feature (296)..(313): n is a, c, g, or t
tcagatacgacgtacacgaccggtgctcgatttagacgtctcatcagggatagaagttattcagcaggcacacaacagaggcagttccagactttcaactgctcatcagcagtctgcaacctgaagattctgcaactttattactgtccaaacagagtaaccagtttacccctccctacgtttcggcggacgggaccaagggtcggagatcaaaacggactggtggctgacaccatctgtctcatccttccgcatctgattacgtntatctgacgcggactggacaggcgcatagnnnnnnnnnnnnnnnnnn

SEQ ID NO: 107934 - DNA, 650 bp, Homo sapiens
  misc_feature: GYAE6OF02I5IMA.12.1.A01.1.454.CMB.1.raw
  modified_base (220)..(220): a, c, t, g, unknown or other
  misc_feature (220)..(220): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccggganaagtcagaccatcagcagtctaatttaattggtatcagacagaaaccgagggaaacacccgtaaggtcctgactcgtatgctcgactactccgtagtttcgacgaaaggttcgggtacccagttcgtaaggtttcgaggtcggacgtgggtcgggtacctaggggaactaggttactttaccgaccttacacctaacccgagttacaacgtccgtaaacggtccgttacgaaccgtaaaccgttagtaaacgttacttaccgtacggtaccttaaacctttagttaactccgttaacaaaccgtagtaacgttaaacctacccgttaacccctaccgttaccgtttaccgggacgggtaacgggtaaccgtaacgggacggtaacgtacgtaacgaaccggtacgtaggtcggacgttcgacctaacccg

SEQ ID NO: 107935 - DNA, 734 bp, Homo sapiens
  misc_feature: GYAE6OF02H8RLQ.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatccctccctgtctgcatctgtagcagacagagtccaccatcacttcgccgggtacaagtccagaccatcagcagtacttaatttaatggtatcagacaagaaacgaggaaaccgtaccccgtaaggtacctagacttctaagtcgtactcgactaacgtcctagtttcgacgtaaacggtccgggtacccagtacgtaagttcgaggtacggcgtaggttcgggtcgtacgggtagtacgtagttttacgaccttacgtaccctaacctactaccgtaacgtccgtaacgttccgtaacggtaaccctaaacccggttgaaaacggtttaccttttaacgtccgtaaaccgtttaaaccttttaacgttaaccgtacgtaaaaccgtaacgaaaacggtttaacgtaaacccgttaacgtttaaccccccgtacccgttaaccggtttaccggggaaacccggtacggggtaaacccgttaaggggtaccgggtaaaccgtaacggttaccggtaaaaccgtacgggttacggttaccgggtaccttaccggacccttaaacccg

SEQ ID NO: 107936 - DNA, 717 bp, Homo sapiens
  misc_feature: GYAE6OF02FYVNT.12.1.A01.1.454.CMB.1.raw
  modified_base (265)..(265): a, c, t, g, unknown or other
  misc_feature (265)..(265): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctaatttaaattggtatcagcaagaaacagggaaacnccccgtaaggtcctgatctatgctgcatcctagtttgacgtaaaggtcgggtcctaatcgtaaggttcaggtggacgtaggtgggtcgtaggggaactagtacgtttcaccttctcaccctaatccgagcacgactaggacgtcgtagtaagttagttttgacctttaagttttacttaacgtttcgtaccgtaacggtccgtaacggttccgtaaacgtacccgttaaaccgttccggggttccccgtttaacgggtttttccccgtttaaccgggttttttacccggggaaccccggggttaaccggggggtaaaccccgttaaacggggttacccgggttaaccggggtaaaccgggttaaacccgtttaaacccggtaaaaacccgggttaaacccgggtttcgggttaacgggggtttcccctaacggggtacccccttaaacccgg

SEQ ID NO: 107937 - DNA, 660 bp, Homo sapiens
  misc_feature: GYAE6OF02GYKQP.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatccctccctgtctgcatctgtagcagacagagtcaccatccacgttcggccggacaagtcacgaccatcagcagacttaatttaaagttggtatcagacgaacgaaacgaaggaaccgtacccgtaacggtctagtactactagtgcgtgacactccgtagttacacgtaaaggtcgggtacccatacgtaacgtcgacgtggacgtaggttcgggtgtacgggactaggtactttacaccgttactccgtaacctagtcgaacggtctacggttccgtgaacccgtaaacctaggaaacttcgttcgtacgtaaccttaacgtttaactacgtacgttaacaaacgtaagttaacctaaacgttaacccgttacccctaccgttaccgttacgggaccgggtaacggtaaccgtagggtacgaacggtaacgtaaccgaaaccggtacttacgggtcgtaccgtacgtaaccgtacccgtagttccgttacggttaccc

SEQ ID NO: 107938 - DNA, 828 bp, Homo sapiens
  misc_feature: GYAE6OF02JF7TE.12.1.A01.1.454.CMB.1.raw
  modified_base (228)..(228): a, c, t, g, unknown or other
  misc_feature (228)..(228): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtcctccatccctccctgtctgcatctgtagcagacagtatccaccatccacgttcggaccggganaagtccaacgacccatcgaagccagtaccttatttaaaattggtaatcagacaaggaaaaccgaagggaaacgccccgttaaaggtcctaggactactaagtcgactcgacacgttacgtacggtttacgacgttaaaacgggttcggggtaccctaacgttaacggtaacggtttcgaacgggttacggtaccggtaaggggtttccgggttaccggtacggggtaaccgtaaggttaaccgttttaccgaaccgtttacccgtaccgtaacccgtaacgttaccaacgggtactacgggttactaccggaaccgttaaacgtacgttaaaggttccttaccgtaaggtaaaccttaaacttttaacgttaccgtaccgtttaaacccgaaacggttaaacgggtaaaccgtttaaaccgttaaccccggttttaaaccccgtacccccgtttaagggtttacccggggtaaccgggtaaacccggggtaaaacccgggtttaggggtaaaaccgggttacggaaaacccgttaaaccggttaaaaccgggtcggttaaccgggttacggtacccggttaacgcccccgtttaaaccgg

SEQ ID NO: 107939 - DNA, 553 bp, Homo sapiens
  misc_feature: GYAE6OF02IB2HO.12.1.A01.1.454.CMB.1.raw
  modified_base (211)..(211): a, c, t, g, unknown or other
  misc_feature (211)..(211): n is a, c, g, or t
  modified_base (262)..(262): a, c, t, g, unknown or other
  misc_feature (262)..(262): n is a, c, g, or t
  modified_base (395)..(395): a, c, t, g, unknown or other
  misc_feature (395)..(395): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttggccgggnaagtcagaccatcagcagctatttaaatggtatcagcagaaaccaggaacnccctaagtcctagatctatgctgcatcctagtttgacgtaaaggtcggggtaccatcgaaaggttcaggtggctaggttggcgtgggacaggtcttcactctcacatcagctagtctgacaaccgtgaaactnttcgtagtacttaactttattactagtacaacgtaagaacgtaactaccgttacccctaccgttacgttccggacggacggaaccgtagggtaggacgtaacgtaaccgaacgtaacgttcgtacggcttacggacctaacgtcttaccgtgttaccg

SEQ ID NO: 107940 - DNA, 577 bp, Homo sapiens
  misc_feature: GYAE6OF02HQFX1.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctaatttaaattggtatcagcagaaaccagggaaacgcccctaaggtcctgatctatgctgctatcctagtttacgctaaaggtcggggtacccagtccaagggtttcaagtggcaggtcgggtcgtgggactagtatttcacttctacacctatcagcagtcctgacctaaccgtgaacgttattctagtacctaaactttattaacctcgtaccaaacgagtaaacgttaactaccgtttaacccctacccgtaccgtttccgggacggtacgggaaccgtaagggtcggaagtacgtaaccgaaacggtacttcggtacggacctagaccctaaccg

SEQ ID NO: 107941 - DNA, 671 bp, Homo sapiens
  misc_feature: GYAE6OF02GQF43.12.1.A01.1.454.CMB.1.raw
  modified_base (208)..(208): a, c, t, g, unknown or other
  misc_feature (208)..(208): n is a, c, g, or t
  modified_base (277)..(277): a, c, t, g, unknown or other
  misc_feature (277)..(277): n is a, c, g, or t
  modified_base (418)..(418): a, c, t, g, unknown or other
  misc_feature (418)..(418): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctcctgtctgcatctgtagcagacagagtcacatcacttgccgggnaagtcagaccatcagcagctatttaatggtatcagcagaaacaggaacaccctaaggtcctagatctangctgcactctagtttgacgtaaaggtcgggtaccagtactaaggttcaggtggactaaggttgggtacgtagggaactaggtactttacgacttcctacgtaacctatacaggactagtcctacgacctaactagaaagtntttaccgtacgtaacttaacgtttaacttaccgtagttaaccgtaaagtaaccgttaacgtaaaccgttaccggtttaacccccttaccgtttaaccgtttcccgggtaacgtttaacgggaacccggggtaacccgttaaaggggttacgggaacgttaaaccggttaaccgaaaaccgggtttaacgttccggggttaaccggtaccggttaaccgtccggtaaacccgtagttacccgttttaacccggg

SEQ ID NO: 107942 - DNA, 286 bp, Homo sapiens
  misc_feature: GYAE6OF02G9HUR.12.1.A01.1.454.CMB.1.raw
  modified_base (281)..(286): a, c, t, g, unknown or other
  misc_feature (281)..(286): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatccttcccgcatctgatacgtcgtatctgagcgggctggcaaggcgcatagnnnnnn

SEQ ID NO: 107943 - DNA, 604 bp, Homo sapiens
  misc_feature: GYAE6OF02GY44V.12.1.A01.1.454.CMB.1.raw
  modified_base (219)..(219): a, c, t, g, unknown or other
  misc_feature (219)..(219): n is a, c, g, or t
  modified_base (414)..(414): a, c, t, g, unknown or other
  misc_feature (414)..(414): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggnaagtcagaccatcagcagcttaatttaaattggtatcagcaagaaaccgagggaaacgcccctaaggtcctgatctatgactgactactcctagtttagacgtaaaggtcggggtaccatacgtaaggttcaggtcggactagggtgggtcgtggggactagtactttcacttctaccactatcacgctagtccngcctaacgtagaacgtacttctacgtaacctaactttagttaccgtactacaaacgtacgtaaactaaccgtaccgtttaaccccttcccgtacgtttacccggggacggtaacggggtaccgtaagggttacggaacgttacgtaaccgtaaacgtacggtcggttacgggacttcggacctaacccgg

SEQ ID NO: 107944 - DNA, 283 bp, Homo sapiens
  misc_feature: GYAE6OF02GMDNW.12.1.A01.1.454.CMB.1.raw
  modified_base (239)..(239): a, c, t, g, unknown or other
  misc_feature (239)..(239): n is a, c, g, or t
  modified_base (270)..(270): a, c, t, g, unknown or other
  misc_feature (270)..(270): n is a, c, g, or t
  modified_base (276)..(283): a, c, t, g, unknown or other
  misc_feature (276)..(283): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggaggaccaaggtggagatcaaacgaactgtggctgcaccatctgtctcatctccgccatcngatacgtcgtatctgagcggctggcaaggcncatagnnnnnnnn

SEQ ID NO: 107945 - DNA, 530 bp, Homo sapiens
  misc_feature: GYAE6OF02JGLSK.12.1.A01.1.454.CMB.1.raw
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
  modified_base (370)..(370): a, c, t, g, unknown or other
  misc_feature (370)..(370): n is a, c, g, or t
  modified_base (404)..(404): a, c, t, g, unknown or other
  misc_feature (404)..(404): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccggcaagtcagaccatcagcagctattaaattggtatcagcagaaaccagggaaanccccgtaaggtcctagatctatnctgcgatccagttttgctaaagtggggtcccaagtcaaggtttcagtggcaggtggtctgggacagtagttcactcncaccatcagcagcctgcagcctagagatggttanctaacgttatacgtagtaacgtaaacgtataacacgtccgtacccgttccaccgttccggaccgaaacgggaccaccggtacgtcggaagtacgttaacggaccgtaacgttggtacggtctacgg

SEQ ID NO: 107946 - DNA, 630 bp, Homo sapiens
  misc_feature: GYAE6OF02IC7U1.12.1.A01.1.454.CMB.1.raw
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
  modified_base (424)..(424): a, c, t, g, unknown or other
  misc_feature (424)..(424): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatccctccctgtctgcatctgtagcagacagagtccaaccagtcacttggccgggacaagtcagaccatcagcagctaatttaaatggtatcagacaagaaaccaggggaacaccccgttaaggccctagatcgtatgtctgcatcctagttagactaaacggtcgggtacccagtcgaagttcgaggtcgngtaggtcggtcgtagggacaagtnttcactctacaccatacagctaggtctacgactaaacctggtaaacgtnttccgtagtaccttaaacgtttactactacggaacctaacgtacgtaaacgtttaaccctaaccgtttacccctaaccgtttaaccggtttccgggaaacgggtaacgggtaaccgttaacggggtagtacggtaacgtaacccgaaaacggtacgtccggttaggtaccctaggaaccctaccgtacgtttaccttacggttacc

SEQ ID NO: 107947 - DNA, 287 bp, Homo sapiens
  misc_feature: GYAE6OF02JFW1R.12.1.A01.1.454.CMB.1.raw
  modified_base (281)..(287): a, c, t, g, unknown or other
  misc_feature (281)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtggagatcaaacgaactgtggctgcacatctgtcttcatccttcccgcatctgatacgtcgtatctgacgcggctggcaaggcgcatagnnnnnnn

SEQ ID NO: 107948 - DNA, 305 bp, Homo sapiens
  misc_feature: GYAE6OF02I631J.12.1.A01.1.454.CMB.1.raw
  modified_base (213)..(213): a, c, t, g, unknown or other
  misc_feature (213)..(213): n is a, c, g, or t
  modified_base (285)..(285): a, c, t, g, unknown or other
  misc_feature (285)..(285): n is a, c, g, or t
  modified_base (290)..(305): a, c, t, g, unknown or other
  misc_feature (290)..(305): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgacaacttattactgtcaacagagtaacagttacccctccactttcgggcggagggaccaagggtcggagatcaaacgactgnggctgcaccatctgtcttcatccttcccgacatcctgatacgtcgtatctggaggcgggtctggacaaggcncatgnnnnnnnnnnnnnnnn

SEQ ID NO: 107949 - DNA, 522 bp, Homo sapiens
  misc_feature: GYAE6OF02FY553.12.1.A01.1.454.CMB.1.raw
  modified_base (382)..(382): a, c, t, g, unknown or other
  misc_feature (382)..(382): n is a, c, g, or t
  modified_base (399)..(399): a, c, t, g, unknown or other
  misc_feature (399)..(399): n is a, c, g, or t
  modified_base (416)..(416): a, c, t, g, unknown or other
  misc_feature (416)..(416): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccggatgacccagtctccatcctccctgtctgcatctgtagcagacagagtcaccatcacttgccggcaagtcagaccatcagcagctatttaaatggtatcagcaagaaaccagggaaacgcccctaaggtcctagatctatcgctgcatccagtttcgacgaaaggtcggggtacccagtcgaaggttcagtggcaggtgggtcgtgggacagtattcactctacactatcagcagtcncgactaacgtagaagtnttctagacttaactttntactgtacaactagtaactactaccgttaccctctacgttcggacgtacggacgaggtagagtacgtacgaaacacgtgtcgactgaccacctatcttcgtcttcg

SEQ ID NO: 107950 - DNA, 359 bp, Homo sapiens
  misc_feature: GYAE6OF02J1RZG.12.1.A01.1.454.CMB.1.raw
  modified_base (317)..(317): a, c, t, g, unknown or other
  misc_feature (317)..(317): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (336)..(336): a, c, t, g, unknown or other
  misc_feature (336)..(336): n is a, c, g, or t
  modified_base (344)..(359): a, c, t, g, unknown or other
  misc_feature (344)..(359): n is a, c, g, or t
tcagatacgacgtacacgaccggtgctcgatttagacgtctcatcagggatagaagttattcagcaggcacacaacagaggcagttccagatttcaaatgctcatcagcagtctgcaacctgaagattctgcaacttagttactgtcaacagataacagttaccctccactttcggcggaggaccaaggtggagctacaaacgaacgtgtcggctgctaccagttctgttaccttcacgttccctttccccggacctatccgttgacttaaccgtcgtatccttaggacgccggggtcttggcctaacgggccgacncgtaagtgctancngntcnagcatgcnnnnnnnnnnnnnnnn

SEQ ID NO: 107951 - DNA, 286 bp, Homo sapiens
  misc_feature: GYAE6OF02H4Z8X.12.1.A01.1.454.CMB.1.raw
  modified_base (281)..(286): a, c, t, g, unknown or other
  misc_feature (281)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaaacgactgtggctgcaccatctgtcttcatcttcccgcatctgatacgtcgtatctgagcggctggcaagggcacatagnnnnnn

SEQ ID NO: 107952 - DNA, 289 bp, Homo sapiens
  misc_feature: GYAE6OF02FWNWV.12.1.A01.1.454.CMB.1.raw
  modified_base (273)..(273): a, c, t, g, unknown or other
  misc_feature (273)..(273): n is a, c, g, or t
  modified_base (279)..(289): a, c, t, g, unknown or other
  misc_feature (279)..(289): n is a, c, g, or t
tcagatacgacgtacacgaccggtgctcgatttagacgtctcatcagggagtagaagttattcagcaggcacacaacagaggcagttccagatttcaactgctcatcagcagtctgcaacctgaagattctgcaacttattactgtcaacagagtaacagttaccctccactttcggcggagggaccaaggtggagatcaaacgaactgtggctgcaccatctgtctcatcttccgccatctgatacgtcgtatctgagcgggctggcaggcncatagnnnnnnnnnnn

SEQ ID NO: 107953 - DNA, 736 bp, Homo sapiens
  misc_feature: GYAE6OF02JAOEA.12.1.A01.1.454.CMB.1.raw
  modified_base (223)..(223): a, c, t, g, unknown or other
  misc_feature (223)..(223): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcacctatcgacttggcccgggnaaacgtcaacgaccatcagcagtcttaatttaaattggtatcagacaacgaaaccgaagggaaacgaccccgtaaggtcctacgatactatgctgtacatcctagtttacgacgtaaacggttcggggtacctagtacgtaaggtttcaaggtcggtacgtaggttcgggtaccggttagggaaccgtaagttacgtttaccgtaacctttccgtacctaacctaacgttaccgaacggtaccttaacggtccgttacgacccgtaaaccgtagtaaaacgtacgtttacgtacgtaaccttaaactttattaaccgttagtaaccgaaaacgtaacgtaacggttaaaccctaaaccgttttaaccccgtacccgtttaaccgggttttcccggggaacgggttaaccggggtaaaccccgttaaaggggtaccggtaaacggttaaccgtaaaccgttaaaaccggtaacccggttaggtacgggtaaccgttaccgacccgttaaacccg

SEQ ID NO: 107954 - DNA, 290 bp, Homo sapiens
  misc_feature: GYAE6OF02FI618.12.1.A01.1.454.CMB.1.raw
  modified_base (276)..(276): a, c, t, g, unknown or other
  misc_feature (276)..(276): n is a, c, g, or t
  modified_base (282)..(290): a, c, t, g, unknown or other
  misc_feature (282)..(290): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccatttcggcggaggaccaaggtggagatcaaacgactgtggctgcaccatcctgtcttcattccttcccgccatcctgatacgtcgtatctgagcggctggcaaggcncatagnnnnnnnnn

SEQ ID NO: 107955 - DNA, 300 bp, Homo sapiens
  misc_feature: GYAE6OF02IZYHF.12.1.A01.1.454.CMB.1.raw
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (281)..(300): a, c, t, g, unknown or other
  misc_feature (281)..(300): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccatttcggcggagggaccaaggtcggagatcaaacgacngtggctgccacntactgtcttcatccttcccgcatctgatcgtcgtatctgagcggctggcagcgcagtagcnnnnnnnnnnnnnnnnnnnn

SEQ ID NO: 107956 - DNA, 653 bp, Homo sapiens
  misc_feature: GYAE6OF02JPCU8.12.1.A01.1.454.CMB.1.raw
  modified_base (504)..(504): a, c, t, g, unknown or other
  misc_feature (504)..(504): n is a, c, g, or t
tcagatacgacgtacacgaccggtgctcgatttagacgtctcatcagggggcgaggagtcagtctcagtcaggacacagcatggacatgagggtccccgctcagctccgtggggctcctgctactctggctccgaggtgccagatgtgacatccagatgacccagtctccacttccctcctgtctgctatctgtagcagacagacgttccaaccattccaacgttcggacccggggactaacgtcgacgacccatccgagcaacgtactttaaatttaaaacttggtaactacaaacgaacgaaaaccgaacgggaaaccggtccccctaaaggtccctagtacttacctaagttcgcttgactactccgttaaggttgacgtaaagggtcggtcccaatacgaagttcgaggtcggtacgtagggtcggtagtacgggatacgtatttccgacgtttcctacactactcgtatcctacgttctacgtaccacgtagaacgttntaccgttacgacttaacttcgtaacttactacgaactaaggtacttaaccgttaccttacctacccgttagtacccgggtacgaccggtaacggtaacggttaccgaagtaacgaccgtaagtacggtgtaccgctacgtaccactacg

SEQ ID NO: 107957 - DNA, 635 bp, Homo sapiens
  misc_feature: GYAE6OF02I0IYT.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttggccgggcaagtcagaccatcagcagtcttaatttaaagttggtatcagacaacgaaaccgaagggaaacgaccccgtaaggtacctgatactagtgctgcatcctagttcgacgtaaaggtcgggtaccatacgaaggttacgagtcggcgtaggtgggtcgtgggagtacgtatttcactcctacacctatcgagctagtctcgacctaacgtagaagtattctacgtacttaacttattactacgtactaaacgtaacgtaacgttaaaccgtaaccgttaaccccttacccgtttaaccggttacgggtaccggggtaacgggtaaccgtaaggggttacgggtaacgtaacgtaaccggaaaaccggtaacgttacggggttaggtacccgttacggaccctaaccgtaactttccggtacgttacc

SEQ ID NO: 107958 - DNA, 548 bp, Homo sapiens
  misc_feature: GYAE6OF02G6DEH.12.1.A01.1.454.CMB.1.raw
  modified_base (268)..(268): a, c, t, g, unknown or other
  misc_feature (268)..(268): n is a, c, g, or t
  modified_base (355)..(355): a, c, t, g, unknown or other
  misc_feature (355)..(355): n is a, c, g, or t
tcagatacgacgtacacgaccggtgctcgatttagacgtctcatcagggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccggcaagtcagaccatcagcagctaatttaaattggtatctagacaagaaaccagggaaacnccccgtaaggtccctagatctatgctgctataccgtagttgacgaaaggtcgggtccatcgaaggttcagtgcaggtgggtctgganaggtatttcacttctacacctatcgacgtctaggtctagtaccaacctaggaagttattacgagttaactaacttattacctagacaactaagtacgtaaactcgttaccctccgtacgttcggaacggacgtacgagggtcgaagtaacacgtaaacgtacgtagtcgtacgtacgccactattcgtattcc

SEQ ID NO: 107959 - DNA, 293 bp, Homo sapiens
  misc_feature: GYAE6OF02GL11R.12.1.A01.1.454.CMB.1.raw
  modified_base (279)..(279): a, c, t, g, unknown or other
  misc_feature (279)..(279): n is a, c, g, or t
  modified_base (285)..(293): a, c, t, g, unknown or other
  misc_feature (285)..(293): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggtctggcaagggcncatagnnnnnnnnn

SEQ ID NO: 107960 - DNA, 287 bp, Homo sapiens; identical to SEQ ID NO: 107404
  misc_feature: GYAE6OF02FU8F8.12.1.A01.1.454.CMB.1.raw
  modified_base (283)..(287): a, c, t, g, unknown or other
  misc_feature (283)..(287): n is a, c, g, or t

SEQ ID NO: 107961 - DNA, 288 bp, Homo sapiens
  misc_feature: GYAE6OF02IU5QK.12.1.A01.1.454.CMB.1.raw
  modified_base (282)..(288): a, c, t, g, unknown or other
  misc_feature (282)..(288): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatcttcccgcatctgatacgtcgtatctgagcgggctgggcaaggcgacatagnnnnnnn

SEQ ID NO: 107962 - DNA, 290 bp, Homo sapiens
  misc_feature: GYAE6OF02I7ACW.12.1.A01.1.454.CMB.1.raw
  modified_base (274)..(274): a, c, t, g, unknown or other
  misc_feature (274)..(274): n is a, c, g, or t
  modified_base (281)..(290): a, c, t, g, unknown or other
  misc_feature (281)..(290): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtctcatctcccgcatctgatacgtcgtatctgacgcggctggcaaggcncagtagnnnnnnnnnn

SEQ ID NO: 107963 - DNA, 605 bp, Homo sapiens
  misc_feature: GYAE6OF02IJ9SY.12.1.A01.1.454.CMB.1.raw
  modified_base (212)..(212): a, c, t, g, unknown or other
  misc_feature (212)..(212): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagatcacatcacgttcggccggganaagtcagaccatcagcagtacttaatttaagttggtatcgagacaacgaaaccgaagggaacgaccccgttaaggtcctagactcgtatcgctgactacttccgtagtttacggaacgtaacgggtcgggtaccctagtacgtaagggttcaggtggacgtagggtcggtaggtggactagtacttcacctctacctactatcagctagtctcggactaacgtgaacgtacttctacgtacttaacttattacgtactacgaaacgagtaaacgtacctaccgttacccctccgttaccggtcgggtaccgggagggtaaccgtagggtacggtacgtaacgtaaccggaaagtacgtgtacggctacggacctacgtacgttcgtacgttcc

SEQ ID NO: 107964 - DNA, 640 bp, Homo sapiens
  misc_feature: GYAE6OF02GGFS1.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctgggctcctgctactctggctccggaggtgccagatgtgacatccagatgacccagtctccatccctccctgtctgcatctgtagcagacagagtacaccatcacttcggccgggcaagtcagaccatcagcagtacttaattttaaagttggtatcagcaagaaaccgaagggaacgtccccgtaaacgggtcctaggtatccgttaatcgtctagctacttccgtagtttcgacgtaaacggtcggggtaccctatcgtaagttcgaggtggcgtaggttcggtcgtggactagtacgtttacacgttacctacaacctacgtacgacgtctacggttctacgaccgtaacgtagtaacggttattccgtacgtaccttaatttacgttacttacgtactaaacgtacgttaactaaccgtacccgttaccccttacccgtacggttttaccgggaccggtaacggggaactaagggtacggtagtaacgtaaccgtaaacgtacggttacgtaggcgtacgaccgtaccg

SEQ ID NO: 107965 - DNA, 285 bp, Homo sapiens
  misc_feature: GYAE6OF02HD9X5.12.1.A01.1.454.CMB.1.raw
  modified_base (282)..(285): a, c, t, g, unknown or other
  misc_feature (282)..(285): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcggctggcaaggcgcatagnnnn

SEQ ID NO: 107966 - DNA, 291 bp, Homo sapiens
  misc_feature: GYAE6OF02FUBV0.12.1.A01.1.454.CMB.1.raw
  modified_base (276)..(276): a, c, t, g, unknown or other
  misc_feature (276)..(276): n is a, c, g, or t
  modified_base (282)..(291): a, c, t, g, unknown or other
  misc_feature (282)..(291): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatcttcccgccatctgatacgtcgtatctgagcgggctggcaaggcncatagnnnnnnnnnn

SEQ ID NO: 107967 - DNA, 555 bp, Homo sapiens
  misc_feature: GYAE6OF02F9IKL.12.1.A01.1.454.CMB.1.raw
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctattaatggtatcagcagaaaccagggaacgcccctaaggtcctgatctatgctgcatcctagtttgacgaaaggtcgggtacccagtcgtaaggttcaggtggcgaggtgggtctgggacagtatttcacttctcacctatcagctagtctgacaacctgaatnttcngtactaactttacttactgtacaacgagtaacgtaaacctaccgttaccccttaccctacgtttaccgggacggtaacgggaccgtagggtaggaacggtaactaaccgaaacggtaacgttcggtacggactcggacctacacgttcgtcgttacc

SEQ ID NO: 107968 - DNA, 534 bp, Homo sapiens
  misc_feature: GYAE6OF02JKCE5.12.1.A01.1.454.CMB.1.raw
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
  modified_base (528)..(528): a, c, t, g, unknown or other
  misc_feature (528)..(528): n is a, c, g, or t
tcagatacgacgtacacgaccggtgctcgatttagacgtctcatcaggggagtctcagtcaggacacagcatggacatgagggtccctgctcagctcctggggctcctgctgctctggctcccaggtgccagatgtgacatccagatgacccagtctccatcctccctgtctgcttctgtcggagacagagtcaccatcacttgcccaggcgagtgaggactagttcggaaattttaatggtttcagcagaaccaggaancccctagactacngactcacgngcatccagtacgaatacggtccagagttcagtggagtgagctgggacagtactttccnactatcancagcctagctagctagagtatctagcaactagtactacttgaaccgtaatacggtttaatacgttttaacctcggtttaacttttcccggaccctgggacctacgacgttagattacaacgtaaccgtaagtgtaacggtctacggacctcgaattcgtgtacttcacgttccttacccncgtatc

SEQ ID NO: 107969 - DNA, 721 bp, Homo sapiens
  misc_feature: GYAE6OF02G61UU.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctcctgtctgcatctgtagcagacagagtccaccatctacgttcgaccgggacaagtcaagaccatcagcagtacttaatttaaagtggtaatcgagacaacggaaaaccgaacgggaaacgtaccccgttaaggtcctaggtaactccgttaatcggaccgttacgacctacttacccgtaggttttacgaaccggtaaaggggttccggggtaacccctaagttaaccgtaagggttaccgtaggtacgggtaccgtagggttcggggtacgttacggggaactaaggttacttttccgaacctttccgtaccaccgtactacgaacgcctagttctacggacctaacgtagtaacgttcttaccgtgtaacccttaagtttacttactagttaaccaaagtaacgttaactaaaccgtaccgtttaaccctacccgtacggttaccggaacggggtaaccggtacggtaagggtaccggaaggttaaccctaaaccggaaaccgtttacgtcggtacggacttacggtaaccctacgtacttacggttccgttacc

SEQ ID NO: 107970 - DNA, 625 bp, Homo sapiens
  misc_feature: GYAE6OF02JHK7T.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctaattaattggtatcagcaagaaaccgaagggaaccgcccctaaggtcctagatctatgctgctatcctagtttgacgtaaaggtcgggtaccagtactaacggttctaggtcggacgtaggtcgggtctagggacaggttacttcactctcacctactcgagccgtagtctacgacctaaccgtagaacgttacttaccgtagtaaccttaactttacttaaccgttagttaaccaacgtaacgtaagtaacccgttaccgttaccccttaacccgttacggtttaccgggaccgggaacgggtaacccggtagggtacgggaacgtaacgtaaccgaaacggtaacgtcgggtacggtaccgtagtacccacccgtaagttccgttagttaccc

SEQ ID NO: 107971 - DNA, 735 bp, Homo sapiens
  misc_feature: GYAE6OF02HYF4I.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtcctccatccctcctgtctgcatctgtagcagacagagtcaccatcacttggccgggacaagtcagaccatcagcagcttaatttaaagttggtatcagacaacgaaaccgagggaaacgtaccccgtaaggtcctagacttactagtcgtctgctactcctagttttagacgtaaggtccgggtacctagttacgtaaggttcgaggtcggacgtagggttcgggtacggtagggaacgtagttactttctaccttcctaccgacctacgtacgacgtactacggttcctacggtaaccctaaccgtaggtaaacgttacttacgttaccgtaacgtttaaacttttaactttaacgttacggttaacctaaacgtaaggttaaaccgttaaacccttaacccgtttaacccccgttacccgtttaacccggggtttaccgggtaaccggggtaaaccggggttaacccggtaaggggtaccgggtaaacggtacctaaaccggtaaaccggtaaccgttgggttaccgggtacgttacggaacccgttaacccgtagtttacccgttacgtttaccccg

SEQ ID NO: 107972 - DNA, 622 bp, Homo sapiens
  misc_feature: GYAE6OF02F96MZ.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatccctccctgtctgcatctgtagcagacagagtcaccatcacttgccgggcaagtcagaccatcagcagctaatttaaattggtatcagcagaaaccgagggtaaacgcccctaaggtcctagactctatgctgacactcctagtttgaacgtaaaggtcggggtaccctagtaccgtaagggttacaaggtcgggacgtaggttgggtacgtagggactaggttatttctaccgtactaccgacctactcgaagcctacgttcgtacgacctaaaccgtagaacgtattctagtacctaacttattacgtacgtacaaagaacgtaagttaaccgtacgttaccccgttacccgttaaccgttacgggaccgggtaacgggaccgtaaggtacggtaacgaactaacgtaaaacggtacgttacgtacggtacgtacgaccgtactacgttctacgttacc

SEQ ID NO: 107973 - DNA, 752 bp, Homo sapiens
  misc_feature: GYAE6OF02JDA79.12.1.A01.1.454.CMB.1.raw
tcagatacgacgtacacgaccggtgctcgatttagacgtctcatcaggggagtctcagtcaggacacagcatggacatgagggtccccgctcagctccgtggggctcctgctactctggctccgaggtgccagatggtgacatccagatcgaccctagtcctccatccctccctgtctgctatctgtagcagacagacgtcaccatccacttcggccggacaagtcagtaccatcagcagtacttaatttaaagttggtactcgaacgacgaaagaaaccgaaggggaaaccgtacccccgttaaggtccctacggtacttaccgttatacggcctggtaccattacccgtaggtttacgaccggtaaaggggttccggggtaccctaagtaccggttaaaggtccgtaaggtccggtaggtacgggtcgggttacgtacgggtactaagtacctttacgacctccgtaccaactactacgcgtagtacgttacgtacgccaaaccgtgtaaaccttcgttacctagtaaccttaacgtttaagttaacctaggttaacaaacgttaacggtaacgttaaccgtaacccgttttaacccctacccggtttaacggttaccggggaaccgggtaaccggtaaccggggagggttacggaaacggttaacggtaaaccccggtaaaggttacccggttacggttagggcccggttaacgtacccttaacggtctttaacccggtgtttaacccg

SEQ ID NO: 107974 - DNA, 658 bp, Homo sapiens
  misc_feature: GYAE6OF02I381K.12.1.A01.1.454.CMB.1.raw
  modified_base (229)..(229): a, c, t, g, unknown or other
  misc_feature (229)..(229): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagnttaattaaattggtatcagcaagaaaccgagggaacgcccctaaggtcctagatctatggtctgcactccgtagtttcgacgtaaaggtcgggtaccagtacgaaggttcaggtggacgtaggttcgggtacgtgggactagtacttctactccgtacacctatcaacggtctacggttcctagaccctaaaccgtaggtaacttacttcgttacgtaaccttaacgtttaacttacgtacgtaacgtaacgtaacggttaacgtaaacccgttccgtttaacccctacccgtttaaccggttccgggaaccgggtaaccgggtaaccgggaagggttacgggtaacggtaacgttaaaccggaaaacggttaacggttcgttacgggtacctaccggtaaccgtaccgtacgttcgttaccgttaccg

SEQ ID NO: 107975 - DNA, 606 bp, Homo sapiens
  misc_feature: GYAE6OF02IP8HF.12.1.A01.1.454.CMB.1.raw
  modified_base (213)..(213): a, c, t, g, unknown or other
  misc_feature (213)..(213): n is a, c, g, or t
  modified_base (296)..(296): a, c, t, g, unknown or other
  misc_feature (296)..(296): n is a, c, g, or t
  modified_base (405)..(405): a, c, t, g, unknown or other
  misc_feature (405)..(405): n is a, c, g, or t
  modified_base (429)..(429): a, c, t, g, unknown or other
  misc_feature (429)..(429): n is a, c, g, or t
  modified_base (466)..(466): a, c, t, g, unknown or other
  misc_feature (466)..(466): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtcctccattcctccctgtctgcatctgtagcagacagagtcaccatcacttgccggganaagtcacgaccatcagcagctaattaattggatcagcaagaaaccgagggtaacgccccttaaaggtccaggtactactagtncgtagctatccctaggtttcgacgtaaacggtgggtacccataccgaagtttcagtcggacgaggttcggcgtagggactagtactttcgacttcgacctacactcgancgtagctagactaaccaggtaacnctcgttacgacttaacctttatacgtagtcctaaaanacgtaactaacgtaccttaaccccgttaccgtaaccgttcgggaacgtacgggtacccggaggtacgtacgaaactacggtaaacccggtagtaccggtaggacctacgggtaccctacgtaacgttcgtaccgttaccg

SEQ ID NO: 107976 - DNA, 294 bp, Homo sapiens
  misc_feature: GYAE6OF02FLVGL.12.1.A01.1.454.CMB.1.raw
  modified_base (278)..(294): a, c, t, g, unknown or other
  misc_feature (278)..(294): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggaggaccaaggtggagatcaaacgaactgtggctgcaccatctgtctcatcttcccgccatctgatcgtcgtatctgagcgggctggcaggcgcatagnnnnnnnnnnnnnnnnn

SEQ ID NO: 107977 - DNA, 295 bp, Homo sapiens
  misc_feature: GYAE6OF02HSK2B.12.1.A01.1.454.CMB.1.raw
  modified_base (284)..(295): a, c, t, g, unknown or other
  misc_feature (284)..(295): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatacaaacgactgtggctgcaccatctgtcttcattcttcccgcatctgatacgtcgtatctgagcgggctggcaaggcgacatagnnnnnnnnnnnn

SEQ ID NO: 107978 - DNA, 644 bp, Homo sapiens
  misc_feature: GYAE6OF02I4HDX.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagtcttaatttaaagttggtatcagacaagaaaccgaagggaacgaccccgtaaggtcctagatctatcgctgcatccgtagttgacgtaaggtcgggtaccagtacgtaaggttcgaggtcggacgtaggtgggtcgtagggactacgtactttcactcctacacctatcagctagtctacgactaaccgtagaacgtacttacgtacgtaacttaactttaacttaccgtacgtaactaaacgtacgtaaaccgttaaccgttaacccgtttacccctacccgttaccggtttacccggtacgtaaccgggtaacgggaccggtaagggtacggtaaacgtaaccgtaaccgtaaaccggttaccggttacggtacggtaccgtaccggaaccctaccgttactcccgtttaaccg

SEQ ID NO: 107979 - DNA, 289 bp, Homo sapiens
  misc_feature: GYAE6OF02HTADL.12.1.A01.1.454.CMB.1.raw
  modified_base (281)..(289): a, c, t, g, unknown or other
  misc_feature (281)..(289): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcgggctggcaggcgcatagnnnnnnnnn

SEQ ID NO: 107980 - DNA, 287 bp, Homo sapiens
  misc_feature: GYAE6OF02GEVM0.12.1.A01.1.454.CMB.1.raw
  modified_base (275)..(275): a, c, t, g, unknown or other
  misc_feature (275)..(275): n is a, c, g, or t
  modified_base (281)..(287): a, c, t, g, unknown or other
  misc_feature (281)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatccttcccgctatctgattacgtcgtatctgagcggctggcaggcnagtagnnnnnnn

SEQ ID NO: 107981 - DNA, 292 bp, Homo sapiens
  misc_feature: GYAE6OF02HXMVI.12.1.A01.1.454.CMB.1.raw
  modified_base (284)..(292): a, c, t, g, unknown or other
  misc_feature (284)..(292): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgacgcgggctggcaaggcgacatagnnnnnnnnn

SEQ ID NO: 107982 - DNA, 290 bp, Homo sapiens
  misc_feature: GYAE6OF02FXQB8.12.1.A01.1.454.CMB.1.raw
  modified_base (284)..(290): a, c, t, g, unknown or other
  misc_feature (284)..(290): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaaacagagtaacagttaccctcccactttcggcggaggaccaaggtggagatcaaaacgaactgtggctgcacatctgtcttcatcttcccgccatctagatacgtcgtatctgagcgggctggcaaggcgacatagnnnnnnn

SEQ ID NO: 107983 - DNA, 366 bp, Homo sapiens
  misc_feature: GYAE6OF02JLSMS.12.1.A01.1.454.CMB.1.raw
  modified_base (300)..(300): a, c, t, g, unknown or other
  misc_feature (300)..(300): n is a, c, g, or t
  modified_base (326)..(327): a, c, t, g, unknown or other
  misc_feature (326)..(327): n is a, c, g, or t
  modified_base (332)..(332): a, c, t, g, unknown or other
  misc_feature (332)..(332): n is a, c, g, or t
  modified_base (336)..(337): a, c, t, g, unknown or other
  misc_feature (336)..(337): n is a, c, g, or t
  modified_base (345)..(366): a, c, t, g, unknown or other
  misc_feature (345)..(366): n is a, c, g, or t
tcagatacgacgtacacgaccggtgctcgatttagacgtctcatcagggatagaagttattctagcaggcacacaacagaggcagttccagatttcaactgctcatcagcagtctgcaacctgaagattctgcaactttattacgtgtcaacagagtaactagttaccctcccactttcggccggtaaggggaccctaagggttggagtactacaaacggtaacctggtagggcctgacacctatctgtccttcattccgttccgcactcgtgattaccgtcgtattctagaggtcgggntggtaccgaaggtcgctaattacggnngtacngacnnctgctgannnnnnnnnnnnnnnnnnnnnn

SEQ ID NO: 107984 - DNA, 282 bp, Homo sapiens
  misc_feature: GYAE6OF02HK6BO.12.1.A01.1.454.CMB.1.raw
  modified_base (278)..(282): a, c, t, g, unknown or other
  misc_feature (278)..(282): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtgagatcaaacgaactgtggctgcaccatctgtcttcatcttccgtcatctgatacgtgtatctgagcggctggcaaggcgcatagnnnnn

SEQ ID NO: 107985 - DNA, 812 bp, Homo sapiens
  misc_feature: GYAE6OF02IG84W.12.1.A01.1.454.CMB.1.raw
  modified_base (520)..(520): a, c, t, g, unknown or other
  misc_feature (520)..(520): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtcctccatcctccctgtctgcatctgtagcagacagacgtcacatcacgttcgccggacaagtcacgaccatcagcagtcttaatttaagttggtatcagacaacgaaaaccgagggaaaccaccccgttaaaggtcccgttagaacttacgttatcggtcttagacctaacgttaccgttagtttacgaacgtaaacgggtccggggttacccaagttacgtaaggttccgtaaggtcgggacgtacgggttcgggtacgttacggggtaacgtaacgttactttaccgtaccttacctacccgaactaaccgtaccgtaacggcgtaaccggttcgtccgtaaccaaacgttacgtaaacgttntttccggtaactaaccgtttaactttaacgttacccgttacggtaacctaaacggtaaccgttaaacgttaaacccgttacccggttttaacccctaccccccgggttttaaagggttaccccgggtaacgggggtaaacccgggttaacccggtaacgggggttaaccggtaaaccggttaaccggttaaaacccggtaaaaccgtttaccgggtaaccgggttacccggttaccgtacgggttaaccccctaaccgtttaccggtttacccggtacgtttttaacccccg

SEQ ID NO: 107986 - DNA, 597 bp, Homo sapiens
  misc_feature: GYAE6OF02GT7DJ.12.1.A01.1.454.CMB.1.raw
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatccctcctgtctgcatctgtagcagacagagtcaccatcacttgccgganaagtcagaccatcagcagctaatttaatggtatcaganaagaaaccagggaaacgcccctaaggtcctagactctatgctgcatccgtagtttacgactaaaggtcgggtacccagtctaaaggttcgagtggctaggtggtcggtagggactaggtactttacaccgtctacgacctactacacgtactagttcccgtacgaccgtaaaccgtaggtaattacttacgtacgtaaccttaaactttacgtttacacgtaacaaacgtaactaacgtaacccgttacgttaccccgttaccgttaaccggttacggacggtaccgacgtaagggtcgaacgtaacaaacgaactacgtgacgtcacgaccactacgtcgtacttccg

SEQ ID NO: 107987 - DNA, 608 bp, Homo sapiens
  misc_feature: GYAE6OF02F42YB.12.1.A01.1.454.CMB.1.raw
  modified_base (248)..(248): a, c, t, g, unknown or other
  misc_feature (248)..(248): n is a, c, g, or t
  modified_base (402)..(402): a, c, t, g, unknown or other
  misc_feature (402)..(402): n is a, c, g, or t
tcagatacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagcttattaaatggtatcagcagaaaccagggaaacncccctaaggtcctgatctatgctgcatccagtttcgacgtaaaggtcggggtacccaagtcgaaggttcgaggttggcgaggtgggtctagggactaggtactttcgactctacaacctatcgaagctagtcctagacctaacgttgaaacgtnttaccgtagtaacgtaaaccgtttattaaccgttacgtacaaactaggtaaacgttaactaccgtttaacccctcccgtaaggtttcccgggaacggtaacgggacctaaagggtcggaagaactaacgaaacgtacgtggtacggtctacgactaaccgtactttcgacggtttccttacgaccttacccgttcccgaccttacg

SEQ ID NO: 107988 - DNA, 640 bp, Homo sapiens
  misc_feature: GYAE6OF02I0QV0.12.1.A01.1.454.CMB.1.raw
  modified_base (90)..(90): a, c, t, g, unknown or other
  misc_feature (90)..(90): n is a, c, g, or t
  modified_base (438)..(438): a, c, t, g, unknown or other
  misc_feature (438)..(438): n is a, c, g, or t
  modified_base (633)..(633): a, c, t, g, unknown or other
  misc_feature (633)..(633): n is a, c, g, or t
tcagatacgacgtacacgaccggtgctcgatttagacgtctcatcaggggagtctcagtcaggacacagcatggacatgagggtccccgntcagctccgtggggctcctgctactctgtctccgaggtgccagatgtgacatccagatcgacccagtctccatccctcctgtctgcatctgtagcagacagactcaccagtcacgttcggccggacaagtcaacgaccatcacgcagtactttaaagttttaagtggtactcgacgacaaacggaaaaccgacggggaaaccgtccccgttaaaggtccctagacttacgtatcgctgacctactccgtagtttgacgtaacgggttccggacctagtacgtaagggttcagggttcgacgtaggtcggtacgacgggtactagttacttccacgtactccaaacgtntacgaacgcgtgttacccagacctaaaccggtgtaaactcgttcgatactttaactataccgtcaaccgtaagtacgttaacgttaccacctttaccccgcgtttaccggtgggaaccggacgaaccggtagtacgactaacgtactaaaccggtgtcggtaacggtcctacggtccaacgttcgttaccggttnttccccg

SEQ ID NO: 107989 - DNA, 644 bp, Homo sapiens
  misc_feature: GYAE6OF02H64PP.12.1.A01.1.454.CMB.1.raw
  modified_base (224)..(224): a, c, t, g, unknown or other
  misc_feature (224)..(224): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgctatctgtacgcagacagagtcaccatcacttcgccgggtanagtcagaccatcagcagtcttaatttaaattggtatcagacaagaaaccgaagggaacgtccccgtaaggtcctagatctatgctgactactaccgtagttcgacgtaaggtcgggtacccagtacgtaaggttacgaggtacggcgtaaggtcgggtaccgtaggggacctaacggttacttttaccgaccttccgtacctaaccccgtataccgagtaccgtagttcctacgaccgtaaccgtagaacgtcttcacgtaactacgtttattaccgtctactaacgaagttaaccgtaactaccgtttaccctaccgttacgtttccgggaccgggtaacgggtaccgtaacgggttaggaacgtaacgtaaccggtaaacggtacgttacggtacggtaccgtacggtaccctaaccg

SEQ ID NO: 107990 - DNA, 309 bp, Homo sapiens
  misc_feature: GYAE6OF02JY9L6.12.1.A01.1.454.CMB.1.raw
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
  modified_base (289)..(309): a, c, t, g, unknown or other
  misc_feature (289)..(309): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggacgggaccaaggtggtagatacgaaacgaacgtgtaggctgcacatctgtctnactctccgcatctnatacgtcgtatctgagcggcgtggngaaggcgtacngtagcgnnnnnnnnnnnnnnnnnnnnn

SEQ ID NO: 107991 - DNA, 786 bp, Homo sapiens
  misc_feature: GYAE6OF02HAP96.12.1.A01.1.454.CMB.1.raw
  modified_base (222)..(222): a, c, t, g, unknown or other
  misc_feature (222)..(222): n is a, c, g, or t
  modified_base (285)..(285): a, c, t, g, unknown or other
  misc_feature (285)..(285): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatcgacccagtctccatccctcctgtctgcatctgtagcagacagagtccaccatcacttggccgganaagtcagaccagtcagcagtacttaatttaaattggtatcagacaagaaaccgaagggaaacncccgtaaggtcctagactctatgtctgacatcctagtttcacgtaaggtcgggtaccctaagtacgtaaggtttcaggtcggacgtagggttacgggtcgtagggtactaaggtactttcaaccgtttcctacccgtaacctacgttaaccgagtaacgtacgtacgtaccgaacccgtaaacgttaaggtaaacggttactttaccggtacgttaaccgtttaaacttttaaccgtttaaccgttagttaaacccggtaaacgttaaacggttaaacccgttaaacccgtttaaaccccgtttaaacccccgtttaccccggtttaacccgggttttaccggggtaaacccggggggtaaaccggggtttaaaccccggtaaaccggggggttaacggtaaaccggttaaacggttaaaacccgggtaaaacccggtttaaaccgggtttacggggtaaccgggtttaacccggtacccggtaaacccggtttaaccccg

SEQ ID NO: 107992 - DNA, 700 bp, Homo sapiens
  misc_feature: GYAE6OF02INYKA.12.1.A01.1.454.CMB.1.raw
  modified_base (187)..(187): a, c, t, g, unknown or other
  misc_feature (187)..(187): n is a, c, g, or t
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
tcagatacgacgtacacgaccggtgctcgatttagacgtctcatcagggggagtctcagtcaggacacagcatggacatgagggtccccgctcagctccgtggggctcctgctactctggctccgaggtgccagatgtgacatccagatgacccagtctccatccctcctgtctgcatctgtagcanacgagagtcaccatcacttggccgganaagtcagtaccntacagcagtacttaatttaaatgtatcagacaagaaaccgtaagggaccacccgttaacgtccgtagtactacgtagtcgactgacctataccgttagtttacgacgtaaagggttcgggacctagtacgtaacgttacgaggtcgacgtaaggtcgggtacgtaggggaacctaggttatttacccgactcgtaaccgtaactacgttacccgagggtacttaacgtcgtaaccggaacgttaacccgtagtaaagttacttccggtaccaaacccttttaaagtttacgttactaaccggtaacaaaacgtcggtaaactaccttacccgttaaccccgttccgttaccggttacgggaccgggtaactaaccggtaggtaacggtacgtaaggtaaacccttaaaccgggtagttaccgggaaggtcccgtaacgtacccgtaaacccgttgttacccttacggttttccc

SEQ ID NO: 107993 - DNA, 337 bp, Homo sapiens
  misc_feature: GYAE6OF02HNEFE.12.1.A01.1.454.CMB.1.raw
  modified_base (167)..(167): a, c, t, g, unknown or other
  misc_feature (167)..(167): n is a, c, g, or t
  modified_base (271)..(271): a, c, t, g, unknown or other
  misc_feature (271)..(271): n is a, c, g, or t
  modified_base (292)..(293): a, c, t, g, unknown or other
  misc_feature (292)..(293): n is a, c, g, or t
  modified_base (297)..(337): a, c, t, g, unknown or other
  misc_feature (297)..(337): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttacccncccatttcggcggaggaccaaggtggagatcaaacgactgtggctgcaccatctgtcttcattccttcccgcctatctgattacgtcgtaatctgaacgcgggntggacaaggcgacagttagcnngtannnnnnnnnnnnnnnnnnnnnnnnnnnnnnnnnnnnnnnnn

SEQ ID NO: 107994 - DNA, 659 bp, Homo sapiens
  misc_feature: GYAE6OF02FSYP8.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctgggctcctgctactctggctccgaggtgccagatgtgacatccagatgacccagtctccatcctccctgtctgcatctgtagcagacagatcacatcacttgccgggacaagtcagaccatcagcagcttaatttaaattggtatcagacaagaaaccgaagggaaccgacccgtaaggtcctgatctatgctgctatcctagttgacgtaaggtcgggtccaagtacgtaaggttcgagtcggacgaggttggtcggtagggactagtactttcaactcctacactatacagctacgtctagaacctaacgtagtaacgttactttacgtacgtacttaactttaacgttaaccgttcgtaaacctaaacgtaagttaaacgttaaacccgttaaacccggtttaacccccgtttaccccgtaacgggttttaccccggggaacgggttaaaccggggtaacccggttaagggtacgggtaaaccgtaaccgttaaaccgtaaaacggttaccggtttaggtacgggtacccttacggaccccttaaccg

SEQ ID NO: 107995 - DNA, 696 bp, Homo sapiens
  misc_feature: GYAE6OF02H8LKT.12.1.A01.1.454.CMB.1.raw
  modified_base (360)..(360): a, c, t, g, unknown or other
  misc_feature (360)..(360): n is a, c, g, or t
  modified_base (487)..(487): a, c, t, g, unknown or other
  misc_feature (487)..(487): n is a, c, g, or t
tcagatacgacgtacacgaccggtgctcgatttagacgtctcatcaggggggcagggagtcagtctcagtcaggacacagcatggacatgagggtccccgctcagctcctggggctcctgctactctggctccggaggtcgccagatgtgacatccagatcgacccagtcctccactccctccctgtctgctactctgagacagacagacgtcaccatacacgttcggaccgggacaaaggtccaacgaccactacagactagacttaattttaaagttggtaatacaacgtacgaaacgaaaaccggaacggaaacgtaccccggttaacggtacctagtacttacgtactcgtaccgngacctaacgtaccgtagttacgaacgtaaacgggtccgggtacctagtacgttaacggtacgacggtacggtcgtaggttcgggtacggtaggacgtagtacgttaccacgtctaaccgtacatacngaccgtcgtacacgacctaaacgtcgtaaatcgtttacacgaaccttaactttagtacctacgtaaccgaaactaaggtaacttaacccgtaacgttacccccgttaacgtaccgggttcgggaaccgggtaacgggtaacgaacgggttggaaaccgttaaccgaacgtaaaccgttcgacggttacggtctaccccgtagtaacccg

SEQ ID NO: 107996 - DNA, 317 bp, Homo sapiens
  misc_feature: GYAE6OF02JAMMJ.12.1.A01.1.454.CMB.1.raw
  modified_base (251)..(251): a, c, t, g, unknown or other
  misc_feature (251)..(251): n is a, c, g, or t
  modified_base (295)..(317): a, c, t, g, unknown or other
  misc_feature (295)..(317): n is a, c, g, or t
tcagatacgacgtacacgaccggtgctcgatttagacgtctcatcagggatagaaggttattcagcaggcacacgaacagaggcagttccagatttcactctcaccatcagcagtctgcaacctgaagattctgcaacttattactgtcaacagagtaacacgttacccctccctactttccggcgggagggaccaaggtggagatacgaaaacgaactgtggctgacaccatctgtctcactccttcccncatctgatcgtctaatctgagcgggctggcaaggcgcagtagcnnnnnnnnnnnnnnnnnnnnnnn

SEQ ID NO: 107997 - DNA, 945 bp, Homo sapiens
  misc_feature: GYAE6OF02GY5MT.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtccaccatcacttcgccggacaagtcagaccatcagcagtacttaatttaagttgtatacagacgaaacgaaaccgaagggaaaccgaccccgtaaggtccctagtactctacgtgtcgtcgacctacgttcccgtagtttacgtaacggtaaacgggttccggggtaacccctaagttaaccggtaaggtttaccgtaagggttacggtaccgttaacgggttcgggggttaccggttaacgggggtaaccgttaacgggttttaaccgttttacccggtaaccccgtttcccgtttaaccccgtaacccgtaacgttaaccgtaaccgggttaacccgtaaccggttttcccggttaacccggttaacccgttaaaacccggtttaaggtaaaaccggtttaacccggttttaccgttaacccggtttaaaccgttttaaaccgtttttaaccgttttaaacccggtttaacgttaaacccgttaaaaccggttaacggttaaaaacccggttttaaaaccccgttaaaccccggttttaaacccccctttaacccccgggtttacccgggtttttaccgggggaaacccgggggtaaacccggggttaaaccgggttaaacgggggggtttaaccgggtaaaacccggttttaaaccggttaaacccggtaaaaaccggggtttaacccggtttacgggttaccccgggggttaacttacccgggaacccgtttaaccccgg

SEQ ID NO: 107998 - DNA, 293 bp, Homo sapiens
  misc_feature: GYAE6OF02FYYQO.12.1.A01.1.454.CMB.1.raw
  modified_base (282)..(282): a, c, t, g, unknown or other
  misc_feature (282)..(282): n is a, c, g, or t
  modified_base (286)..(293): a, c, t, g, unknown or other
  misc_feature (286)..(293): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaagggtggagatacaaacgaactggtggctgcaccatctgtcttcatccttcccgcctatctgatacgtcgtatctggagccggctggcaggcnatgnnnnnnnn

SEQ ID NO: 107999 - DNA, 688 bp, Homo sapiens
  misc_feature: GYAE6OF02FXDPD.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacgttgccgggcaagtcagaccatcagcagacttatttaaatgtatcagcaagaaccgagggaacgcccgtaagtcctagactactatgctgccatccgagtttcgacgtaaaggtcggggtaccctacgtaacgtaacggtttcgaagggtcggtacgtagggttcggggtcgtacggggaactaggtacttttcccgaacttctaacccgaacctacttaccgacgtactacggttcctacggaaccgtaaccgttagaacgtacgtttacacgtaacctttaaaccgtttacgttaaccttacgtaacctaaacggtagttaaaccgttaaacccgttacgtttaacccccgtcccgttaaccggttttcccgggaacggggtaaccggggtaaccgtaaacggggttacggaaccggttaataacccggtaaacggttaccggtaagggttccgtaacgttcccggacctaacccg

SEQ ID NO: 108000 - DNA, 296 bp, Homo sapiens
  misc_feature: GYAE6OF02I515P.12.1.A01.1.454.CMB.1.raw
  modified_base (286)..(296): a, c, t, g, unknown or other
  misc_feature (286)..(296): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatccttccgccatcctgatacgtcgtatctgacgcggctggacaaggcgacagtagnnnnnnnnnnn

SEQ ID NO: 108001 - DNA, 289 bp, Homo sapiens
  misc_feature: GYAE6OF02FPBZM.12.1.A01.1.454.CMB.1.raw
  modified_base (281)..(289): a, c, t, g, unknown or other
  misc_feature (281)..(289): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttccgccatctgatacgtcgtatctgagcggctggcaaggcgcatagnnnnnnnnn

SEQ ID NO: 108002 - DNA, 288 bp, Homo sapiens
  misc_feature: GYAE6OF02I1XA7.12.1.A01.1.454.CMB.1.raw
  modified_base (281)..(288): a, c, t, g, unknown or other
  misc_feature (281)..(288): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggatatcaaacgactgtggctgcaccatctgtcttcatcttcccgcatctgatacgtcgtatctgagcggctggacaaggcgcatagnnnnnnnn

SEQ ID NO: 108003 - DNA, 713 bp, Homo sapiens
  misc_feature: GYAE6OF02GQH2S.12.1.A01.1.454.CMB.1.raw
tcagatacgacgtacacgaccggtgctcgatttagacgtctcatcaaggaagggaagggggcaggagtcagtctcagtcaggtcacagcatggacatgagggtccccgctcagctccgtggggctcctgctactctggctccggaggtgccagatgtgacatccagctcgacccagtcctccactccctccctgtctgcatcgtaggtaggagaacaaagtccaaccatacctacgttcggacccgggtactaaacgagtacgttagttcgacctaagttaatttaaagttggtaactacaaaacaaaagcaaggactaaacgtacccaagcctactagtatttagcgtctcgaccactagtctgacgtaggtccggtcctagtaagtcacgtcggcgtagactacgaggactaagtaacttacgtcctaaccactactacgtaagtacgtactacacgtacctaggtaaatattacgttacgtacctttaacgttatttaccgtacgttacgtaacgtacgttaaccggtaaccgtttacccggtcctacccttacccgtacgtttaacccgttaccggtttaacccgggaaccgggtaaaccgggtacccgaacccggtaccggtaacgtaacggttaccgggttaacccggtaaacggtaccgttcgggttaccgggtacctaccggtacccgtaccgttacgttcccgg

SEQ ID NO: 108004 - DNA, 325 bp, Homo sapiens
  misc_feature: GYAE6OF02FZ43T.12.1.A01.1.454.CMB.1.raw
  modified_base (200)..(200): a, c, t, g, unknown or other
  misc_feature (200)..(200): n is a, c, g, or t
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (292)..(325): a, c, t, g, unknown or other
  misc_feature (292)..(325): n is a, c, g, or t
tcagatacgacgtacacgaccggtgctcgatttagacgtctcatcagggatagaagttattcagcaggcacacaacagaggcagttccaagatttcactactcaccatcagcagtctgcaacctgaagattctgcaaacgttattaactgtcaacagagtaacagttacctcccactttcggcgagggaccaaggtgganatacaaacgaactgtggctgacaccatctgtcttcagtcttccgcatctgatacgtcgtatctgagcgggactggnaaggcgcatagcantnnnnnnnnnnnnnnnnnnnnnnnnnnnnnnnnnn

SEQ ID NO: 108005 - DNA, 613 bp, Homo sapiens
  misc_feature: GYAE6OF02JYKEN.12.1.A01.1.454.CMB.1.raw
  modified_base (327)..(327): a, c, t, g, unknown or other
  misc_feature (327)..(327): n is a, c, g, or t
tcagatacgacgtacacgaccggtgctcgatttagacgtctcatcaaggaagggaagggggcaggagtcagtctcagtcaggtcacagcatggacatgaggtccccgctcagctcctggggctcctgctactctggctccgaggtgccagatgtgacatccgagctgacccagtctccgatcctcctgtctgcatctagtagagacaaagtcaccatcgacttcggccgggtataacgagtagtattgcctaacgttaatttaattggtaactacaaaacgtaaaagcaaggacaaacgtacccaaagtctaccgtagtatttacgngtctcgaccacgagttctcgacgtagggttcggttacccgacgtaacggttacacgtcggccgtaggactacgaacgggtactaagtaactttccgactcactactcgagtagttactacgacgtctagaacgtatactcgtacttaactttattaacgtgtacagtaccgtagtacgttaccgacctcctacctactctaccgttacggcaacgggcaccgtaccgaagtaacgtcggttaacggacctacgttacggtcggaaccttcgaaccgtctagttccg

SEQ ID NO: 108006 - DNA, 287 bp, Homo sapiens
  misc_feature: GYAE6OF02HWHTE.12.1.A01.1.454.CMB.1.raw
  modified_base (277)..(277): a, c, t, g, unknown or other
  misc_feature (277)..(277): n is a, c, g, or t
  modified_base (283)..(287): a, c, t, g, unknown or other
  misc_feature (283)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaactgaagattctgctaacttattactgtcaacagagtaacagttaccctcctatttcggcggagggaccaaggtggagatacaaacgactgtggctgcacatctgtcttcattccttcccgcatctgaccttacgtcgtatctggagcggctggcaggcncatagnnnnn

SEQ ID NO: 108007 - DNA, 779 bp, Homo sapiens
  misc_feature: GYAE6OF02H351N.12.1.A01.1.454.CMB.1.raw
  modified_base (529)..(529): a, c, t, g, unknown or other
  misc_feature (529)..(529): n is a, c, g, or t
tcagatacgacgtacacgaccggtgctcgatttagacgtctcatcagggggagtctcagtcaggacacagcatggacatggagggtccccgctcagctccctggggctcctgctactctggctccgaggtgccagatgtgacatccagatcgacccagtcctccatccctccctgtcctgctatctagtagcaagacagacgtcaacctatacctacgttgggacccggggtactaaacgtccgaacgaaccctaatacgacgacgaacgtactttaaagttttaaacgtttacggtaatacgaagtaccgaaaacggtaaaacccggaaggggtaaaacccggtaccccgtaaacgggttccctaaggtacttacctagtcggtctacgacctacttaccgtaagttacgaacgtaagggtccggggtacctacgtaacgtaacggttagtagtcggtacgtagggttcgggtaccggtaggaacgttacgttacttccgtacctcccgttacaacgtactacgaacncgtacgtaccgttcgaacctaacgttacggaaagttacttaccggtaacttacctttaactttagttaacgttaaccgaactaaccggtaaaacgtacgtaacccgtttaaccgttacccccgtttaacctacggttttccggaaacccgggtaaggtaacccggtaggggtaacgtagaacgttaaaccgaaccggtaacgttcggtacggtactaccggtcctaacccgttactacgtttccgttacc

SEQ ID NO: 108008 - DNA, 658 bp, Homo sapiens
  misc_feature: GYAE6OF02JXY4A.12.1.A01.1.454.CMB.1.raw
  modified_base (499)..(499): a, c, t, g, unknown or other
  misc_feature (499)..(499): n is a, c, g, or t
  modified_base (550)..(550): a, c, t, g, unknown or other
  misc_feature (550)..(550): n is a, c, g, or t
  modified_base (647)..(647): a, c, t, g, unknown or other
  misc_feature (647)..(647): n is a, c, g, or t
tcagatacgacgtacacgaccggtgctcgatttagacgtctcatcaggggaggtctcagtcaggacacagcatggacatgagggtccccgctcagctcctcggggctcctgctactctggctccgaggtcgccagatgtgacatccagatcgacccagtctccatccctcccgtgtcctagcacttctgtacgcaggacagacgtccacactccacgttcgccgggacaacgtcgaacgtaccatacacgtacgtagtaccttaaagtttaaacgttaggtactaccgaaggtaccaaacggtaaaaccggaggggtaaaacccgaccccggttaacggtaccttacggtaactttacgtacgttacggccttaggactaacttccgtacgtttagaccgtaaagggtccgggtaacctagtacggtaaggtcgtaggtacggacgtagggttcggtagtagggacgtagttacgttcacctctaccgactcacggtancggtatcggtcaacgtacgtgaactcgttaagaccttaagtacctttagtntacgataacgataaccgtaacctaccgtacctcctaacgtcggacgggagtaccgagtagacgactaacgaacggtatgggactactacgaccgtancgttcgtagtc

SEQ ID NO: 108009 - DNA, 292 bp, Homo sapiens
  misc_feature: GYAE6OF02JBQ0L.12.1.A01.1.454.CMB.1.raw
  modified_base (279)..(292): a, c, t, g, unknown or other
  misc_feature (279)..(292): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtgagatcaaacgaactgtggctgctacatctgtctcatcttccgcatctgatacgtcgtatctgagcggctggccaaggcgcaatgannnnnnnnnnnnnn

SEQ ID NO: 108010 - DNA, 799 bp, Homo sapiens
  misc_feature: GYAE6OF02GSF1Y.12.1.A01.1.454.CMB.1.raw
tcagatacgacgtacacgaccggtgctcgatttagacgtctcatcaggggggcagggagtcagtctcagtcaggacacagcatggacatgagggtccccgctcagctcctggggctcctgctactctggctccgaggtgccagatgtgacatccagatcgacccagtctccactccctcctgtcctgcatctgtagcagacagacgtccacctatccacgttcggacccgggacaacgtaccacgaacctatacgacgacagtactttaaattttaaagttggtaactacgagaccgaaacggaaaacccggaacggggaaacccggtaacccccgtaacgggttacccgtagtacttaccgtagtcggtctacgtactacgttaccgttaaggtttacggaacggtaaacgggtccggggtaaccctaaggttaccgtaacgggttacgacgggtacggtacggttagggttaggggtaccggtacggggtaacgtaagttacctttaccgtaacttacccgtaaccgtaacctacgtaccgtacgacgttacggtcctaccggaaccttaacgtaaggtaacgttacgttacctacggttaaccttaaacgttttacgtaacccttacggtaaaccctaaaggtaaacgtaaccgtttaaaccgttaccccgttaaccccgttacccggttacgggtttacccgggaaccgggtaaaccgggtaccggtaaaggtacggtaaccgacggttaaaccgtaacggtacggttccggtacggtactaccggactaacccg

SEQ ID NO: 108011 - DNA, 662 bp, Homo sapiens
  misc_feature: GYAE6OF02FNC6U.12.1.A01.1.454.CMB.1.raw
  modified_base (196)..(196): a, c, t, g, unknown or other
  misc_feature (196)..(196): n is a, c, g, or t
  modified_base (446)..(446): a, c, t, g, unknown or other
  misc_feature (446)..(446): n is a, c, g, or t
tcagatacgacgtacacgaccggtgctcgatttagacgtctcatcaggggggcaggagtcagtctcagtcaggacacagcatggacatgagggtccccgctcagctcctggggctcctgctactctggctccgaggtgccagatgtgacatccagctgacccagtctccatcctccctgtctgcatctagtagganacaaagtcaccatcacttgccgggactaacgagagtattcgcctacgttatttaaattggtaatacaaaacaaaaagcaaggacaaacgtacccaaagccttactagatttatcgctacgaccaccagtctgacgtaagggtcgggttcccgtagtaacggtttccgacgtcggggccgtggacgtcgaaggggtactaaggtaactttaaccgtacctacaaccgtatcgtaacgttacgtacctaacncggtaccttagaaagtagttaacttgtacctttaacgttaatttacttgtaccagtacgtacggttacgttaccggaccgtacccttaccgattccgtaaccgtttccggaaccgtaagggaacccaccggtacccgtacggtaacggtacgttaccgggaacggtaaccgttggtacggtcttacggaccctaccgtacttccgtgtttaccccg

SEQ ID NO: 108012 - DNA, 424 bp, Homo sapiens
  misc_feature: GYAE6OF02IFPLI.12.1.A01.1.454.CMB.1.raw
  modified_base (227)..(227): a, c, t, g, unknown or other
  misc_feature (227)..(227): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (354)..(357): a, c, t, g, unknown or other
  misc_feature (354)..(357): n is a, c, g, or t
  modified_base (359)..(363): a, c, t, g, unknown or other
  misc_feature (359)..(363): n is a, c, g, or t
  modified_base (365)..(424): a, c, t, g, unknown or other
  misc_feature (365)..(424): n is a, c, g, or t
tcagatacgacgtacacgaccggtgctcgatttagacgtctcatcagggatagaagttattcagcaggcacacaaacagaggcagttccagatttcactctcaccatcagcagtctgcaacctgaagattctgcctaacttattactgtcaacagagtaacagttacccctcccattttcggacggtagggaccaaagggtggaagactacgaaaacgtaactcggngggacctggctaccgattcctgtacttcaatccgtttcccgacacttctagtaactaacccggttgtatcctggacggccgggtctagggacaaagggccgctaaagtagntcagtnacgtcgtngnnnnannnnncnnnnnnnnnnnnnnnnnnnnnnnnnnnnnnnnnnnnnnnnnnnnnnnnnnnnnnnnnnnn

SEQ ID NO: 108013 - DNA, 347 bp, Homo sapiens
  misc_feature: GYAE6OF02ICZYR.12.1.A01.1.454.CMB.1.raw
  modified_base (305)..(306): a, c, t, g, unknown or other
  misc_feature (305)..(306): n is a, c, g, or t
  modified_base (308)..(309): a, c, t, g, unknown or other
  misc_feature (308)..(309): n is a, c, g, or t
  modified_base (312)..(347): a, c, t, g, unknown or other
  misc_feature (312)..(347): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaggtggagatacaaacgactgtggctgcaccatctgtcttcatccttcccgctatctcgataccggtcgtaattcgaggacggcgggcgttggacgaagggtccgactaagtacgcnngnntcnnnnnnnnnnnnnnnnnnnnnnnnnnnnnnnnnnnn

SEQ ID NO: 108014 - DNA, 638 bp, Homo sapiens
  misc_feature: GYAE6OF02IKAPO.12.1.A01.1.454.CMB.1.raw
  modified_base (208)..(208): a, c, t, g, unknown or other
  misc_feature (208)..(208): n is a, c, g, or t
  modified_base (441)..(441): a, c, t, g, unknown or other
  misc_feature (441)..(441): n is a, c, g, or t
  modified_base (468)..(468): a, c, t, g, unknown or other
  misc_feature (468)..(468): n is a, c, g, or t
  modified_base (614)..(614): a, c, t, g, unknown or other
  misc_feature (614)..(614): n is a, c, g, or t
tcagatacgacgtacacgaccggtgctcgatttagacgtctcatcaaggaagggaagggggcaggagtcagtctcagtcaggtcacagcatggacatgagggtccccgctcagctcctggggctcctgctactctggctccgaggtgccagatgtgacatccagctcgacccagtcctccactccctccctgtctgcatctgtagganaacaagtcaccatcacttggcccgggactaacgagtagttattcgacctaagttattttaaaagttggttaatacaaaacgaaaagcgaaggacaaaacgtaccccaaagtccttaccgttagtaatttactgacctcgacccactagtctagacgtaagggttccggttaccctagtaacggttccacggtcgggccgtaggtactcggaagggactaagttaactttaccnctaccactacgtctagtacgtactacngtacctagtaatatattgtactttaattattactgtacgagacacggtacttacccgcgtcccttacctattacccgttacgtttcccggaaccgtaacgggacctaccggaccgagtacggtacgtaccggaacgtacgttcggngttacccgtcgacctacctattcg

SEQ ID NO: 108015 - DNA, 680 bp, Homo sapiens
  misc_feature: GYAE6OF02IZ8BW.12.1.A01.1.454.CMB.1.raw
  modified_base (133)..(133): a, c, t, g, unknown or other
  misc_feature (133)..(133): n is a, c, g, or t
  modified_base (136)..(136): a, c, t, g, unknown or other
  misc_feature (136)..(136): n is a, c, g, or t
  modified_base (184)..(184): a, c, t, g, unknown or other
  misc_feature (184)..(184): n is a, c, g, or t
  modified_base (189)..(189): a, c, t, g, unknown or other
  misc_feature (189)..(189): n is a, c, g, or t
  modified_base (261)..(261): a, c, t, g, unknown or other
  misc_feature (261)..(261): n is a, c, g, or t
  modified_base (282)..(282): a, c, t, g, unknown or other
  misc_feature (282)..(282): n is a, c, g, or t
  modified_base (647)..(647): a, c, t, g, unknown or other
  misc_feature (647)..(647): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagntgngacatccagatgacccagtctccatccctccctgtctgcatcgtgtancgganacagtactcaaccatctacgttggccgggataacggcacgaccatcgagctagtacttaagtttaactgtancagacaacgaacgaggtaacncccctaagtcctgacttcagtcgcagactagtaccgtagttgaaccgttaagggtccggttaccagtataacgggttatacggtcggacgtgggttcggggaccttagggggaaccttaaggttaccttttccgaacgttttcctacctaacaacggttacacggaccttaacggtcttaacggtaactaaacccgggataaacggttctacctacggtaaccttaaacgtttacttactccggttaaacaaccgttaagtaaccggtaacttacccggttaacccctccgttaccggttacggaaccgggagggaaacccgttagggcgtaaacgaacgttaaccgaaacggttagtccgggtntaccgtaggacccacctaggttccacggttacc

SEQ ID NO: 108016 - DNA, 367 bp, Homo sapiens
  misc_feature: GYAE6OF02HG9LX.12.1.A01.1.454.CMB.1.raw
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
  modified_base (311)..(367): a, c, t, g, unknown or other
  misc_feature (311)..(367): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtcggagatcaaacgactgtcgctgacgaccatctgtcttcatccttcccgcatcgtgacttaccgtgttaactctaggacggcggggccttggaccaaggggtcncctataaggcngtnnnnnnnnnnnnnnnnnnnnnnnnnnnnnnnnnnnnnnnnnnnnnnnnnnnnnnnnn

SEQ ID NO: 108017 - DNA, 729 bp, Homo sapiens
  misc_feature: GYAE6OF02JLKZS.12.1.A01.1.454.CMB.1.raw
  modified_base (257)..(257): a, c, t, g, unknown or other
  misc_feature (257)..(257): n is a, c, g, or t
  modified_base (537)..(537): a, c, t, g, unknown or other
  misc_feature (537)..(537): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctcctgtctgcatctgtagcagacagagtacaccatccacttcgccgggcaagtcagaccatcagcagtctattaagttgtatcanacaagaaacaagggaaacaccccgtaaggtacctagactacgtaactacggtcttggacctacgttaccgtacggttttacggaccgttaaaagggtcccgggggttaccctaagtaccgtaaaacgggtttctaaacggggtcggtaccgtaggggttccggggttacggttaaccggggaacgtaaggttaccgtttttaccgaacccgtttacttaacccgaaccctatacccgtaaggtccctaaggtcctacggtaccctaacgtacgttaaacntttaacgtcaaccgtaactttagttaccgtagtaacctaaactacggttaaattaacccggtaaactttacccccgaaccgtttacccggttacggaaccgggtacgggtaaacccgtaaggggtaacgtacggtaaactaaccggtaaaccgtaacggttaggtaccggtaccgttcggacccttaacccg

SEQ ID NO: 108018 - DNA, 906 bp, Homo sapiens
  misc_feature: GYAE6OF02FM4EU.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggcctcgtcgctactcgtggccgtaccggaggtcgaccgaaggtagttggtacgaactactacccgaagtacgtaccgaacccgtagttccctacctaccttcccccttccgttcgttcgtcgactacttcgttaggtacgaccgaacgtacgaaggtacgtacccaacctacgtaccgttaccggttaccggggacccgggtaacgtaacggtaccaaccgtaacctaccgtacgaaccggactaacggttactttaaaagttttaaaggtttacggttaacttacgaacggaccgtaaaacggaaaaccgggaaaacggggaaaccccgttaaccccggtaacggttacccggtaagtaaccgttacgttaacgtcgtaccgtacgacctacgttacccgtttaaggtttaccggaaacgttaacggggttacccggggtaccctaacgttaaccggttaacgggtttacgtaacgggtacggtacggttacgggttcggggttacggtacgggtaacgttaagtttaccgtttacctacgtacctacccaaccgtacgtaacgacgtacgtacgttaccgtactacccgtaaacgtacggaaacgttcttacgtacgtaacctttaacgtttacgttaacgtacgtaacctaacgaacgttaacgttaacccttacccgtttaacccctaccgttaccgggttaccgggacgggtaaccggtaaccggtaagggtacggaacgttaacgaaccggtaacgtacggtagggtacctacggaccgtaccgtaccg

SEQ ID NO: 108019 - DNA, 289 bp, Homo sapiens
  misc_feature: GYAE6OF02JBBKU.12.1.A01.1.454.CMB.1.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (275)..(275): a, c, t, g, unknown or other
  misc_feature (275)..(275): n is a, c, g, or t
  modified_base (281)..(286): a, c, t, g, unknown or other
  misc_feature (281)..(286): n is a, c, g, or t
  modified_base (288)..(289): a, c, t, g, unknown or other
  misc_feature (288)..(289): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccacgtttcggcggaggaccaaggtggagatcaaacgactgtggctgcaccatctgtcttnatcctccgcatctnactacgtcgtatcctggagcggctggcaggcncatagnnnnnntnn

SEQ ID NO: 108020 - DNA, 295 bp, Homo sapiens
  misc_feature: GYAE6OF02G161L.12.1.A01.1.454.CMB.1.raw
  modified_base (285)..(295): a, c, t, g, unknown or other
  misc_feature (285)..(295): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtggagatcaaacgaactgtggctgcaccatctgtcttcattccttcccgccatctgatacgtcgtatctgagcgggctggcaaggtcgcatagnnnnnnnnnnn

SEQ ID NO: 108021 - DNA, 293 bp, Homo sapiens
  misc_feature: GYAE6OF02GWHGT.12.1.A01.1.454.CMB.1.raw
  modified_base (280)..(280): a, c, t, g, unknown or other
  misc_feature (280)..(280): n is a, c, g, or t
  modified_base (286)..(293): a, c, t, g, unknown or other
  misc_feature (286)..(293): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccatttcggcggaggaccaaggtggagatcaaaacgaactgtggctgaccaccatctgtcttcatccttcccgcatcctgactacgtcgtatctgagcgggctggcaaggcncatagnnnnnnnn

SEQ ID NO: 108022 - DNA, 301 bp, Homo sapiens
  misc_feature: GYAE6OF02HYPQJ.12.1.A01.1.454.CMB.1.raw
  modified_base (286)..(301): a, c, t, g, unknown or other
  misc_feature (286)..(301): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatcctgagcgggctgggacaaggcgcaataggnnnnnnnnnnnnnnnn

SEQ ID NO: 108023 - DNA, 733 bp, Homo sapiens
  misc_feature: GYAE6OF02JCELR.12.1.A01.1.454.CMB.1.raw
tcagatacgacgtacacgaccggtgctcgatttagacgtctcatcagggggcaggagtcagtctcagtcaggacacagcatggacatgagggtcccgctcagctcctggggctctgctactctggctccggaggtgccagatgtgacatccagatcgacctgtcctccatcctcctgtctgctatcgtagtagacagacgagtacgtccaaccattccacgttcggacccgggactaaaggtccgaacgaaccctatccgaacggtcaacggtacctttaagtttaaagttacgggtacttacgaacgtacgaaacggaaaacccgtaaggggaaaaccgtaccccgtaagggttcctaggtaacttccgtaagtcgtatcggtactacgtacctaggtttacgaacgtaaaggtcgggtactaacgtcgtaaacggtctaggtcggagtaaggtcggtacgtacggacgtagtactttacgacttactaccgaacgtctaccaaggacctaggtcctacgggaacctaacgtcggaaatttaccttacgtacgtacccttaaatttacggtacttacggtaactaacgtacgtaaagttccgaaaccgtttacccgtacttaaccggttcgggtaacgggtaaccggtaaccgggtaaggttaccggaaacgtaaccgttaaccgaaacggtttaccgtacgggtcgtacccgttacggacccgttacccgg

SEQ ID NO: 108024 - DNA, 287 bp, Homo sapiens
  misc_feature: GYAE6OF02HGSSE.12.1.A01.1.454.CMB.1.raw
  modified_base (281)..(287): a, c, t, g, unknown or other
  misc_feature (281)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtctatctgagcgggctggcaaggcgcatagnnnnnnn

SEQ ID NO: 108025 - DNA, 648 bp, Homo sapiens
  misc_feature: GYAE6OF02GYAF9.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtccaccatccacgttggccgggacaagtcacgaccatcagcagtacttaatttaaacgttggtatcaagacaagaaaaccgaagggaaaccgtccccgttaaggtccctagacttccttagtcgctcgactacttaccgtagtttacgacgtaaacggtcggggtaccctaagtacgtaaggtttcgaaggtcggtcgtagggttcgggtacgtacggggactagttactttaccacctcctacacctatccgagctaacgttctaccgacctaacgtagtaactgttctacgacttaacttattactacgtactaacgtagtaactaaccgtaccgttaccctccgtaaccggttcgggaccggtaacgggtaaccgtaagggttacggaacgtaacgttaaccggaaaccggtacgttacggtacggtaccgtacgacccgtaccg

SEQ ID NO: 108026 - DNA, 672 bp, Homo sapiens
  misc_feature: GYAE6OF02HG17M.12.1.A01.1.454.CMB.1.raw
  modified_base (214)..(214): a, c, t, g, unknown or other
  misc_feature (214)..(214): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatcgtgtagcagaccagacgtcaccatcacttggccgganaagtcagacctatcagcagtactaagtttaaataggtatacgagacaagaaaccgaagggaacgccccgtaaggtcctaggatactatcggactgactactccgtagttacgacgtaaacggtcgggtaccagtacgtaagttcgagtcggactagggtacggtacgtagggactagttacgttctacctcctaccaccgtaataccggacgtaacgtacgttcctacgaaccgtaaccgttacggaaacgttactttacgtacggtaaaccttaaacttaacgtttaactacgtaacctaaacgtaacgtaacgttaaacctaccggtttaacccctcgttaaccgtttacgggaaccgggaacggtacgtaagggtacggaacgtaacgaaccgtaaacggtacgttaggtacggtaccttaacggaccttaccgacggtttcctacggttaaccc

SEQ ID NO: 108027 - DNA, 598 bp, Homo sapiens
  misc_feature: GYAE6OF02I3YQW.12.1.A01.1.454.CMB.1.raw
  modified_base (433)..(433): a, c, t, g, unknown or other
  misc_feature (433)..(433): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccactcctccctgtctgcatctgtagcagacagacgtccacctatctaccttggacccgggcaacggtcaagaccatcagcagtacttaagtttaaagttggtatcgtagacgaacgaaaccgagggaacgtcccgtaaggtcctagactctatgctcgctactcgtagttgacgtaacggtcgggtacctagtacgtaaggttcgaggtcgacgtaggtgggtcgtaggactagtacgtttcactcctaccacactcagctagtcncgtacaacgagaacgttnttcnaacttacttatactgtaacaagtcgaacgttaacctaccgttaccctaccgttacggttaccgggacggaacgggtaaccgtagggtaacggacgttaacgtaaccgtaacggacgttacgggtcgtacgtacgaccttacgg

SEQ ID NO: 108028 - DNA, 284 bp, Homo sapiens
  misc_feature: GYAE6OF02HLWNX.12.1.A01.1.454.CMB.1.raw
  modified_base (280)..(284): a, c, t, g, unknown or other
  misc_feature (280)..(284): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcaccatctgtcttcatccttccgctatctgatacgtgtatctgagcggctggcaaggcgcatagnnnnn

SEQ ID NO: 108029 - DNA, 658 bp, Homo sapiens
  misc_feature: GYAE6OF02ISSLY.12.1.A01.1.454.CMB.1.raw
  modified_base (200)..(200): a, c, t, g, unknown or other
  misc_feature (200)..(200): n is a, c, g, or t
  modified_base (243)..(243): a, c, t, g, unknown or other
  misc_feature (243)..(243): n is a, c, g, or t
  modified_base (325)..(325): a, c, t, g, unknown or other
  misc_feature (325)..(325): n is a, c, g, or t
tcagatacgacgtacacgaccggtgctcgatttagacgtctcatcagggggcaggagtcagtctcagtcaggacacagcatgggacatgagggtccccgctcagctcctggggctcctgctactctggctccgaggtgccagatgtgacatccagatcgacccagtctccatccctcctgtctgcatctgtacgcagacngactcaccatcacgttcggccggacagtcaacgacctatacanacagtacttaatttaagttgtatacgacgacaacgaacgaggaaaccgtaccccgtaaggtctagtactactagtcgtcgtnactactacgtagttacgacgtaacggtccgggtaacctacgtacggtaacgttacgtaggtcggtacggtacgggttcgggttacgtacggggaacttacggttaactttacccgtactaccctaccgacctactacgacgtacgtacgttcctacgtaaccgtaacgtacgtaagttcctttagtaaccgtactttaaactttacgtacgttacgtaaaccaacggttagtaacgttaaccctaaaccgttccctaccgtacggttcgggaacgtaccggtaacgtaacggagaaccgtaagtaccgaatcggtacgcggtactacgctacg

SEQ ID NO: 108030 - DNA, 757 bp, Homo sapiens
  misc_feature: GYAE6OF02HYLEL.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatcgacccagtctccatccctcctgtctgcatctgtagcagacagacgtcacatcacgttcggccgggtacaacgtcacgacctatacagacagtactttaatttaaagttggtatcacgtacaagaaaccgaggaaacgtcccctaaggtcctagatctagtgcctgactactcgtagtttcgacgtaacggttccgggtacctagtaccgtacggttacgaggtacggacgttaagggtcgggtaccgtaggggtaaccttaacggttactttaccgaccgtttaccttaccgtaacccgtacgtaacctacggtaccgtaacgtttccgtaacgaccccttaaaacgtcggtaaacgtcttacccgttagtaacccttaacgttttaaaccttacggtacttaaccgaaacgttaaacggtaccgtttaaaccgttaacccgtttacccccgttaaccgtttacccgggtttacggggaaccgggtaaccgggtaccggtaacggggtacggttaaccggaaacgttacccggaaaacggtacccgttacgggtaccggttaccgttacgacccggttaacctaccgtttcggtacccggtttaccccg

SEQ ID NO: 108031 - DNA, 810 bp, Homo sapiens
  misc_feature: GYAE6OF02JHQGV.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatccctcctgtctgctatcgtgtacgacaggacagagtaccacctatcctacgttcggaccgggacaagtcacgaccatacagctacgacttaatttaagtcggtaatcaacgtacaacggaaaaccgaacgggaaacctaccccgtaacggtcctagatacgtactacgtctacgactacttaccgtagtttacggaacggttaaacgggttccgggtacctacgttacggtaacgggttaccgtaagggtcggtacgtacgggttcggggtacggtacggggtaactaacggttacttaccgtacctaccgtacctaaccctagtaccgacgtacgtattaccgttaaggaacccttaaacggtaacgtaacgttaccgtttacggtaccctttaaactaaaccgttttaagttaaccctaagggtaaccctaaaacggttaagggttaaaccccgtttaaaccgtttaaaccccgttccccgtttaaacccggttaaccggggttaaccggggtaaccggtaaacgggggtacccgtaaggggttaccggtaacggtaacgttaaaaccccggtaaagttcccggtaacggggttcgtaacccgttacggtaaccctaccggtttaccttacggtcccgttttaccgg

SEQ ID NO: 108032 - DNA, 704 bp, Homo sapiens
  misc_feature: GYAE6OF02I01ZB.12.1.A01.1.454.CMB.1.raw
  modified_base (230)..(230): a, c, t, g, unknown or other
  misc_feature (230)..(230): n is a, c, g, or t
tcagatacgacgtacacgaccggtgctcgatttagacgtctcatcaggggggcaggagtcagtctcagtcaggacacagcatggacatgagggtccccgctcagctcctggggctcctgctactctggctccgaggtcgccagatgtgacatccagatcgacccagtcctccatcccttccctgttctgctatctgtagcagacagacgtcaccatcacgtcggccgggnaacgtccagaccatcgagcagtacttaatttaagttggtatacgagacgaacgaaaaccggaacgggaaaccgtacccccgttaaggtaccgtagtaactactatcgtactacgctacgttccgtagttacgaacgtaaacgggttcgggttaccagttaccgtaaggttacgtacggtggtacgtagggttcgggtacgtacgggtacgtacgttacttacgacctacctaccacctacgttacgacgtccgtacgtccgtacgtaacctaaccgtaggtaacttacgttacgtactaacccgttaaatttaaccgttacgtacgtaaaccaacgtaagttaaaccgttaaccgtaacccgttacccccttaccgggttacccggttaccggggtaacgggaaccgggtaacggtagggttaggaacgttacgaaacgtaacgtacggttggtacggcgtaccgtacgtaccg

SEQ ID NO: 108033 - DNA, 722 bp, Homo sapiens
  misc_feature: GYAE6OF02GAGOP.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtcctccatccctccctgtctgcattctgtagcagacagagtccaccatccacttgccgggcaagtcagaccatcagcagtacttaatttaaattggtatacagtacgaacgtaaaaccgaacggggaaaccgtacccccgtaaggtaccgtagtaactccgttatgtccgtgacctacgtccgtaggtttcgacgtaaacggtcggggtaccctaagttaccgtaaacggtttcgaacggttggaccggtaggggttacggggttacggtaacggggtacgtaaggttacgtttaccctacgtttccctaacctacctaactaccgtaagtccgtaacggttctaccgtacccgtaacgtagttaactacgtttcacgtaaccttaactttataaccgttacgttaacgaaacgtaccggtaaattaacccgtaacccgtttacccccttaaccgttcggtttacccggggaccggtaacgggtaacccgtaagggtaacggtaacttaacgaaccgttaacggtaacgtacggtcggtactaccggtacccgtaaccg

SEQ ID NO: 108034 - DNA, 299 bp, Homo sapiens
  misc_feature: GYAE6OF02JA5S7.12.1.A01.1.454.CMB.1.raw
  modified_base (281)..(281): a, c, t, g, unknown or other
  misc_feature (281)..(281): n is a, c, g, or t
  modified_base (284)..(299): a, c, t, g, unknown or other
  misc_feature (284)..(299): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatacaaacgaactgtggctgcacatctgtctcatctccgcatctgatacgtcgtatcctgacgcggtctggacaaggcgcatagntannnnnnnnnnnnnnnn

SEQ ID NO: 108035 - DNA, 422 bp, Homo sapiens
  misc_feature: GYAE6OF02HAK73.12.1.A01.1.454.CMB.1.raw
  modified_base (161)..(161): a, c, t, g, unknown or other
  misc_feature (161)..(161): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
  modified_base (359)..(422): a, c, t, g, unknown or other
  misc_feature (359)..(422): n is a, c, g, or t
tcagatacgacgtacacgaccggtgctcgatttagacgtctcatcagggatagaagttattcagcaggcgacacaacagaggcagttccagatttcaaatgctcatcagcagtctgcaacctgaagattctgcaactttatactgtacaacagagtaaacncgttacccctacccgtactttcgggccgggaacgggtaaccaagggttggagtacgtaccaaaaacggtatggtggctacggacgaccattacgtcgttctacacgttccttcccgactattcctaggaccttacgtgttactcgtaggtaccggcgggggtcctgggacctaaggggcaactagtaagnatngtacnnnnnnnnnnnnnnnnnnnnnnnnnnnnnnnnnnnnnnnnnnnnnnnnnnnnnnnnnnnnnnnn

SEQ ID NO: 108036 - DNA, 725 bp, Homo sapiens
  misc_feature: GYAE6OF02IVQHO.12.1.A01.1.454.CMB.1.raw
  modified_base (221)..(221): a, c, t, g, unknown or other
  misc_feature (221)..(221): n is a, c, g, or t
tcagatacgacgtacacgaccggtgctcgatttagacgtctcatcagggggcaggagtcagtctcagtcaggacacagcatggacatgaggtccccgctcagctcctggggctcctgctactctggctccgaggtgccagatgtgacatccagatgacccagtctccatcctcctgtctgcatctgtagcagacagagtccacatccacgttggcccgganaacggtcacgaccatcagcagtacttaatttaaagttggtatcagcaacgaaaccgaacgggaaacgtaccccgtaaggttcctagtacgtctagtcgctgctactactagttagacgtaacggtacgggtccctagtacgtaacggttacgtaggtcggacgtaggtcgggtacgtagggacctagtactttcctacccgttactaccgtaaccctagtacctaagaccttagtccgtaccgtacccgtaaaccgtaggtaaacgttacgtttacgttaacgtacctttaaacgtttaaccgtttaaccgttaccgttaacgtaaaccgtaacgttaaaccgtttaaaccgtacccgtttaaacccgttaccccgttacccgggtttaccgggtaccgggtaaccgggtaaccggtaacgggttaacggtaacgtaacgtaaaccggtaaaccgtaacggtttaaccgggtccggtaaccgttacccggtaaccgttaacccg

SEQ ID NO: 108037 - DNA, 652 bp, Homo sapiens
  misc_feature: GYAE6OF02HVMMT.12.1.A01.1.454.CMB.1.raw
  modified_base (205)..(205): a, c, t, g, unknown or other
  misc_feature (205)..(205): n is a, c, g, or t
tcagatacgacgtacacgaccggtgctcgatttagacgtctcatcaaggaagggaagggggcagcagtcagtctcagtcaggtcacagcatggacatgagggtccccactcagctcctgggctcctgctactctggctccgaggtgccagatgtgacatccagctgacccagtctccactcccgtcctgtctgcatctgtagganaacaagtcaccatcacgttcgccggcagtcaggactagttagactaattagttaggcttaggtatcgagcagaacgacgaaggaacgcccgtaacgtccgtgatctagtgtcgactactcctatttgactacgtagggtcgggtacccatacgtaagttcgacggtcggacgtaggtaggtactcgggtacgggtactaagtaactttcccgaaccgttaccgtacaaacgttaactaccgaacccacggtccctagacctacgtaccgttaggtaactttacgttttacgaactttaactttagttaactacgtaactaaacgtttaacggttttaaacttaacccgtttaaccctttccggtttacggtttcccggtacccgttaccggaccgttaaactggtaactaattaaccgacgtaaactggtagtccggtatccgtacc

SEQ ID NO: 108038 - DNA, 656 bp, Homo sapiens
  misc_feature: GYAE6OF02I6XWO.12.1.A01.1.454.CMB.1.raw
  modified_base (314)..(314): a, c, t, g, unknown or other
  misc_feature (314)..(314): n is a, c, g, or t
  modified_base (495)..(495): a, c, t, g, unknown or other
  misc_feature (495)..(495): n is a, c, g, or t
  modified_base (644)..(644): a, c, t, g, unknown or other
  misc_feature (644)..(644): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatcgacccagtctccattccctccctgtcctgcattcgtagtagcagacagtgtcaccatcacttggaccggactaagtcgacgaccagtcagcagtacttaatttaaagtggtatcagacgaacgaaaccgaagggtaaccgaccccgtaaggtctacgattacgtancggtctgacctacttcgttaggtttacgacgttaaacgggtccggtaacctataacggtaacggttcaggttcggacgtagggttcgggtacgtacgggaacgttaacttcgttacctacgtacctaccgtacctaacgtcgacgtacctacgtcttacggaccgtaacgtagtaacgttnttcgacgttacttaaccttacttacgtcgtaacctagaacgtactaactacccgttaccctaccgtttaccgtaccggtaaggaacgggtaacgtaggtacgaacgtaacgtacgtaaacgtacgttggacgtacgacgtacgaacctnttacgtcttacc

SEQ ID NO: 108039 - DNA, 351 bp, Homo sapiens
  misc_feature: GYAE6OF02G9R0B.12.1.A01.1.454.CMB.1.raw
  modified_base (209)..(209): a, c, t, g, unknown or other
  misc_feature (209)..(209): n is a, c, g, or t
  modified_base (254)..(254): a, c, t, g, unknown or other
  misc_feature (254)..(254): n is a, c, g, or t
  modified_base (280)..(282): a, c, t, g, unknown or other
  misc_feature (280)..(282): n is a, c, g, or t
  modified_base (285)..(286): a, c, t, g, unknown or other
  misc_feature (285)..(286): n is a, c, g, or t
  modified_base (290)..(291): a, c, t, g, unknown or other
  misc_feature (290)..(291): n is a, c, g, or t
  modified_base (295)..(295): a, c, t, g, unknown or other
  misc_feature (295)..(295): n is a, c, g, or t
  modified_base (298)..(299): a, c, t, g, unknown or other
  misc_feature (298)..(299): n is a, c, g, or t
  modified_base (301)..(351): a, c, t, g, unknown or other
  misc_feature (301)..(351): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggaggaccaaggtggagatacaaacgactgnggctgcaccatctgtctcatctctcgcatctgactacgctatcgngagcggctggacaaggcactagtagnnncannagcnntgcngcnngnnnnnnnnnnnnnnnnnnnnnnnnnnnnnnnnnnnnnnnnnnnnnnnnnnn

SEQ ID NO: 108040 - DNA, 751 bp, Homo sapiens
  misc_feature: GYAE6OF02HCXCF.12.1.A01.1.454.CMB.1.raw
  modified_base (225)..(225): a, c, t, g, unknown or other
  misc_feature (225)..(225): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatcgacccagtcctccatcctccctgtctgcatcgtgtagcagacagatcaccatcacgtcggcccggganaagtcacgaccatcgagacagtcttaaattttaaagttacggtattacgagacaaacggtaaaaccgaacgggaaaccggtacccgttaaacggtcccgtacgtacgtactagtcgtctcgacctacgttaccgtagtttacgacgtaaacggttcggggtaccctagtaccgtaaggttctaggtggtacgtaggttacgggtcggtggaacgtagtacgtttactaccttactacccgtaactaacgttacgaacgtacgtcggttaacctccggtaaccgtaaaccgtacgttaaacgtattttaccgtagtaaccctttaactttaacgtttacccgttaagtaaacccgtaaacggtaacgtttaaacgttaaacccgttaacccggtttaaccccttacccgttaccgggtttacccggggaccggaaaccggggtaccgtaaacggggtacgggtaaacgttaaccgtaacgtaaaccggttacgtacgggttaaccggacttaccggacctaacccgg

SEQ ID NO: 108041 - DNA, 731 bp, Homo sapiens
  misc_feature: GYAE6OF02F9Z4S.12.1.A01.1.454.CMB.1.raw
  modified_base (400)..(400): a, c, t, g, unknown or other
  misc_feature (400)..(400): n is a, c, g, or t
  modified_base (563)..(563): a, c, t, g, unknown or other
  misc_feature (563)..(563): n is a, c, g, or t
tcagatacgacgtacacgaccggtgctcgatttagacgtctcatcaaggaagggaagggggcagggagtcagtctcagtcaggtcacagcatggacatggacgggtccccgctcagctccgtggggcctcctgctactctggctccggaggtcgccagatgtgactactccagctcggaccctagtcctcctactcccttcctgtctcgctactcgtaggtaaggacgaactaaacgtccaacctatcctacgttcggacccgggtacgtaacggaggtaagttacgttccggaccttaacgtttaaagtttttaaacgttggtaactaaaccgaaaaacgtaaaacgcgaacggtaaccaaacgtaccccgaaagtcctaccgttagttaactttacgngtcctccggaccctacgacgttcgtggtacggtacgggttccggtaccctaaggtacgttccgacgtcggccgtagacgtacggaggtactaagttaccgtttacctcctaaccacgtactaacgtacggttacgacctacgacgtaccaaggtaatacgttnttacgttaccttacttttacgtccgtgtactagtacgtaccggttaaccgttcccgaccttccctaccgtattccgtacgttaccggacgtaacggacctaccgacgtagtaacggtacggtaccgaacgttcggtacggtccggtacctacgaccttacgtgttccg

SEQ ID NO: 108042 - DNA, 298 bp, Homo sapiens
  misc_feature: GYAE6OF02FO39A.12.1.A01.1.454.CMB.1.raw
  modified_base (246)..(246): a, c, t, g, unknown or other
  misc_feature (246)..(246): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (287)..(298): a, c, t, g, unknown or other
  misc_feature (287)..(298): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccacgtttcggcggagggaccaaggtggagatcaaacgaactgtggctgccacatctgtctcactccttcccgccatcngtatacgtctatctgagcggctggacgaggcncagtagngnnnnnnnnnnnn

SEQ ID NO: 108043 - DNA, 633 bp, Homo sapiens
  misc_feature: GYAE6OF02FUUMM.12.1.A01.1.454.CMB.1.raw
  modified_base (345)..(345): a, c, t, g, unknown or other
  misc_feature (345)..(345): n is a, c, g, or t
  modified_base (414)..(414): a, c, t, g, unknown or other
  misc_feature (414)..(414): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatccctccctgtctgcatctgtagcagacagagtcaccatcacttgccgggcaagtcagaccatcagcagctatttaaagtgtatcagcaagaacaggaacgcccctaagtcctgactctaatcgcttgcatcctagtttgactaaggtcggggtccagtcgaaggtcagtcgacgngtgggtcgtgggactagtacgtttcactcgtcaccgtatcagacgtagtcagccctaacctgaaacgtnttaccgtacgacttaaactttacgttaccgttataccgtaaacgtacgtaacgttaaaacccgtaccgtttaacccctaccccggttaacctttacccgggggtacccgggtaaacggggtaacccccggttaaaggggtaccgggtaacggttaacgttaacccgaaaaccggtaaccgttacgggtaaccgtacgggtttacccgaccgttaacccg

SEQ ID NO: 108044 - DNA, 289 bp, Homo sapiens
  misc_feature: GYAE6OF02FWXY7.12.1.A01.1.454.CMB.1.raw
  modified_base (257)..(257): a, c, t, g, unknown or other
  misc_feature (257)..(257): n is a, c, g, or t
  modified_base (282)..(289): a, c, t, g, unknown or other
  misc_feature (282)..(289): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaaacagagtaacacgttaccctcccactttcggcggaggaccaaggtggagatcaaacgactgtggctgcaccatctgtcttcatccttcccgcatctgatacgtcgtanctgagcggctggcaaggcgcatagnnnnnnnn

SEQ ID NO: 108045 - DNA, 366 bp, Homo sapiens
  misc_feature: GYAE6OF02F5JAT.12.1.A01.1.454.CMB.1.raw
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (316)..(366): a, c, t, g, unknown or other
  misc_feature (316)..(366): n is a, c, g, or t
tcagatacgacgtacacgaccggtgctcgatttagacgtctcatcagggatagaagttattcagcaggcacacaacagaggcagttccagatttcactctcaccatcagcagtcctgccaacctgaagattctgacaacttatactgtcaaacagagtaacagttaccctcccatttcggcggaggaccaaggtggagatacaaacgtaactgtaggctgcaccatctgtacttcattccttcccgccatcctagactacgtccgtatctagagccgggtactggactaaggcgccattaaggntnatgtcagcannnnnnnnnnnnnnnnnnnnnnnnnnnnnnnnnnnnnnnnnnnnnnnnnnn

SEQ ID NO: 108046 - DNA, 641 bp, Homo sapiens
  misc_feature: GYAE6OF02HOWNP.12.1.A01.1.454.CMB.1.raw
  modified_base (128)..(128): a, c, t, g, unknown or other
  misc_feature (128)..(128): n is a, c, g, or t
  modified_base (136)..(136): a, c, t, g, unknown or other
  misc_feature (136)..(136): n is a, c, g, or t
  modified_base (184)..(184): a, c, t, g, unknown or other
  misc_feature (184)..(184): n is a, c, g, or t
  modified_base (214)..(214): a, c, t, g, unknown or other
  misc_feature (214)..(214): n is a, c, g, or t
  modified_base (271)..(271): a, c, t, g, unknown or other
  misc_feature (271)..(271): n is a, c, g, or t
  modified_base (359)..(359): a, c, t, g, unknown or other
  misc_feature (359)..(359): n is a, c, g, or t
  modified_base (401)..(401): a, c, t, g, unknown or other
  misc_feature (401)..(401): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtnccagatgngacatccagatcgacccagtctccatccctccctgtctgcatctgtancagacagactcaacatctacttggccgganaacgtcagaccaatcagcagtcttaattaatgtatcagacaagaaaccgaggaaccncccttaaggctagtactctaatcgctagactacttccgaagtttcgaagtaacgggtccgggtacctagtacgtaagttcgaggtcgnggtaaggtcggtcgtggtaactagttcgttacacgtttaccnccgacctagtacgacgtacgtagtccgttacgaccttaaccgtaaggtaaccgttacttaccgtaacgtacttaaacgttacgttactaacgtactaaacgtaacgttaacgtaaacctaccggttaacccttccgttaaccgttacgggacgtaaccgggaacaggggtatacgtaacgaacgtaacggtaactcggtacgtaccgttacgaccttaccgtacttacgtccgttaaccg

SEQ ID NO: 108047 - DNA, 579 bp, Homo sapiens
  misc_feature: GYAE6OF02I587P.12.1.A01.1.454.CMB.1.raw
  modified_base (240)..(240): a, c, t, g, unknown or other
  misc_feature (240)..(240): n is a, c, g, or t
  modified_base (308)..(308): a, c, t, g, unknown or other
  misc_feature (308)..(308): n is a, c, g, or t
  modified_base (391)..(391): a, c, t, g, unknown or other
  misc_feature (391)..(391): n is a, c, g, or t
  modified_base (418)..(418): a, c, t, g, unknown or other
  misc_feature (418)..(418): n is a, c, g, or t
  modified_base (453)..(453): a, c, t, g, unknown or other
  misc_feature (453)..(453): n is a, c, g, or t
  modified_base (506)..(506): a, c, t, g, unknown or other
  misc_feature (506)..(506): n is a, c, g, or t
  modified_base (563)..(563): a, c, t, g, unknown or other
  misc_feature (563)..(563): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccactcctccctgtctgcatctgtagcagacagagtccaacatctacttcggcgggacaagtcacgccatcagnacgtacttaagttttaaatggtatctaagactaaagaaaccggagggtaaacctcccgttaaggtccnggtactgtatgctgacctgacctgttcgaacggaacggtcggtaccagtcgtaagggttccaggtcgactaggtcgggtacgnggtaactgtacgttcactcgtacactnactgctacgtcacgtaccgaatcggaatcttacgnttacctaattagttcctagtactaaatggtaaaccttactacccgtttaaccnccgttaagtccgggagtaaccggataacggagtaagaactaacgaacgtcgttacgngtacctggtacctaag

SEQ ID NO: 108048 - DNA, 685 bp, Homo sapiens
  misc_feature: GYAE6OF02HXQHR.12.1.A01.1.454.CMB.1.raw
  modified_base (467)..(467): a, c, t, g, unknown or other
  misc_feature (467)..(467): n is a, c, g, or t
  modified_base (511)..(511): a, c, t, g, unknown or other
  misc_feature (511)..(511): n is a, c, g, or t
tcagatacgacgtacacgaccggtgctcgattttagacgtctcatcagggggcaggagtcagtctcagtcaggacacagcatggacatgagggtccccgctcagctcctgggctcctgctactctggctccgaggtgccagatgtgacatccagatgaccccagtcctccatccctccctgtctgctatctgtacgcaagacagagtaccaccatcacgttggccggacagtcaacgaccatcgagcagtactttaagtttaaagttggtaactacacgacgaaacggaaaaccgaagggaaaccgtacccccgttaaggttccctagtacttactagtcgtcctagtacctactccgtagttacgacgtaaacggtcgggtaccctaagttacgtaaggttcaggtacgtcgaggttcgggtacgtagggactagttactttaccgacttaccgtacctaaccgtntacgacgtccgtacgtccgtacgacctaaaccgtgtaaacgttnttacgtactacttaacttacttacctacgtaacgaacgtaacgtaacgttaaccttacccgttacccgtacccgttaacggttccgggacgtaaccgggaccggttaaggtcggtaactaaccgtaaaccgaaccggttaagttccggtacggtacctaccggaccttaaccgg

SEQ ID NO: 108049 - DNA, 317 bp, Homo sapiens
  misc_feature: GYAE6OF02IFKI4.12.1.A01.1.454.CMB.1.raw
  modified_base (212)..(212): a, c, t, g, unknown or other
  misc_feature (212)..(212): n is a, c, g, or t
  modified_base (290)..(291): a, c, t, g, unknown or other
  misc_feature (290)..(291): n is a, c, g, or t
  modified_base (293)..(294): a, c, t, g, unknown or other
  misc_feature (293)..(294): n is a, c, g, or t
  modified_base (296)..(317): a, c, t, g, unknown or other
  misc_feature (296)..(317): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgctaacttattactgtcaacagagtaactacgttacccctccactttcggcggagggaccaagggtgagatcaaacgactgngctgcaccatctgtctcactctcccgctatctagacttacgtcgtatcgtggacggcggctggacaaggccacagtgnnanngnnnnnnnnnnnnnnnnnnnnnn

SEQ ID NO: 108050 - DNA, 314 bp, Homo sapiens
  misc_feature: GYAE6OF02FTYI2.12.1.A01.1.454.CMB.1.raw
  modified_base (281)..(281): a, c, t, g, unknown or other
  misc_feature (281)..(281): n is a, c, g, or t
  modified_base (287)..(288): a, c, t, g, unknown or other
  misc_feature (287)..(288): n is a, c, g, or t
  modified_base (290)..(292): a, c, t, g, unknown or other
  misc_feature (290)..(292): n is a, c, g, or t
  modified_base (294)..(314): a, c, t, g, unknown or other
  misc_feature (294)..(314): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggaggaccaaggtggagatcaaacgaactgtggctgcaccatctgtctcatccttccgcctatctgactacgtcgtatcctggagcggtctaggctaagggcncatagnngnnnannnnnnnnnnnnnnnnnnnnn

SEQ ID NO: 108051 - DNA, 792 bp, Homo sapiens
  misc_feature: GYAE6OF02G2G4K.12.1.A01.1.454.CMB.1.raw
tcagatacgacgtacacgaccggtgctcgatttagacgtctcatcagggggcaggagtcagtctcagtcaggacacagcatggacatgagggtcccgctcagctcctggggctcctgctactctggctccgaggtgccagtatgtcgacatccagactgacccagtcctccattccctcctgtctcgactatctgtagcgagtacagacgtaccacactctacttcggccggagtaagtcgaacctacgactacgtagacctagtactttaaagttttaaacgtttggttacttacacgaacgaaacggtaaaaccggaagggaaaccgtaccccggtaaacgtcccgtagtaacgttcttacggttcgcgtacgacttaccgttacccgtaaggttttcgaacgttaaacggtccggtaccgtaacgtaccgttaaggtacgtaggtacggtacgtaggtcgggtcgtaggggaactacggttactttaccgtacgtaccgtaaccgaacccgtcgtaccgacgtaccgtacgttacgtaccgaaccgttaaacggttacgtaaacgttccgttaacgtaccgttacgtttaaacgtttaacgttacgttaaccgtaacgaaacctaacgttaaaccgttaaaccgttaaccccgtttaacccgtaccgtttaaccggggttccggtaaccggggtaccggggtaaacgttaacggggtacgggtaacgttaaaccgtaacgtaaaccggttacggaaccggttcggtacccgttacggacccttaaccgg

SEQ ID NO: 108052 - DNA, 357 bp, Homo sapiens
  misc_feature: GYAE6OF02ID5X5.12.1.A01.1.454.CMB.1.raw
  modified_base (152)..(152): a, c, t, g, unknown or other
  misc_feature (152)..(152): n is a, c, g, or t
  modified_base (207)..(207): a, c, t, g, unknown or other
  misc_feature (207)..(207): n is a, c, g, or t
  modified_base (260)..(260): a, c, t, g, unknown or other
  misc_feature (260)..(260): n is a, c, g, or t
  modified_base (304)..(357): a, c, t, g, unknown or other
  misc_feature (304)..(357): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaactttattactgtcaacngagtaacagttaccctcccactttggcgagggacaggtggagatcaaacgacgtnaggctgcaccatctagtcttcactcttccccgacatcctagtactaacggttntactactggacgcgggactggaccgaaggccggtcagtagacgnnnnnnnnnnnnnnnnnnnnnnnnnnnnnnnnnnnnnnnnnnnnnnnnnnnnnn

SEQ ID NO: 108053 - DNA, 407 bp, Homo sapiens
  misc_feature: GYAE6OF02G3XG2.12.1.A01.1.454.CMB.1.raw
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (374)..(375): a, c, t, g, unknown or other
  misc_feature (374)..(375): n is a, c, g, or t
  modified_base (377)..(378): a, c, t, g, unknown or other
  misc_feature (377)..(378): n is a, c, g, or t
  modified_base (381)..(407): a, c, t, g, unknown or other
  misc_feature (381)..(407): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgactaacttatactgtacaacagagtaactcgttacccctcccgtacgtttcgggacggtaacggggaaccctaaggggttggaacgtaattaaccgaaaacggtaaccgtggtacgggtccaggaccaaccagtacttcggtccttacacgttacccttcccgactatcgttacggtaacttaccggtccttatccgtaggcggtaccgggtctgggaccaacgggtcacgtanacggncgnntnntannnnnnnnnnnnnnnnnnnnnnnnnnn

SEQ ID NO: 108054 - DNA, 300 bp, Homo sapiens
  misc_feature: GYAE6OF02HEKCK.12.1.A01.1.454.CMB.1.raw
  modified_base (290)..(300): a, c, t, g, unknown or other
  misc_feature (290)..(300): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgacaacttattactgtcaacagagtaacagttaccctccactttcggcggagggaccaagggtggagatacgaaacgagtagtggctgcaccatctgtcttcatccttccgcatctgtactcgtctatcgtagacggcggctaggcgaacggcagatagnnnnnnnnnnn

SEQ ID NO: 108055 - DNA, 369 bp, Homo sapiens
  misc_feature: GYAE6OF02G3L9A.12.1.A01.1.454.CMB.1.raw
  modified_base (346)..(347): a, c, t, g, unknown or other
  misc_feature (346)..(347): n is a, c, g, or t
  modified_base (351)..(351): a, c, t, g, unknown or other
  misc_feature (351)..(351): n is a, c, g, or t
  modified_base (353)..(369): a, c, t, g, unknown or other
  misc_feature (353)..(369): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctagactaactttagttactgtcaaacagtagtaacagttacccctccctacgtttcgggcggaacgggtaccaaggtggagataccaaaacgactggtcggctgccaccgtatctagtccttcgaacttcccgttcccgcctattcctagtaaccgttctaatcgtgagggccgggcttagggctaaaggccgactaagtggacctggatgccaagnnttcngnnnnnnnnnnnnnnnnn

SEQ ID NO: 108056 - DNA, 899 bp, Homo sapiens
  misc_feature: GYAE6OF02JK18K.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtcgccagatggtgacatccagatcgacccagtcctccatccctccctgtctcgcactctgtacgcagacagacgtccaccacgtacacttcggcccgggactaacgtcacgaccatacacgctagtactttaatttaagttgtactacgagaccgtaacggaaaaccgaacggggaaaccgtacccgtaacgggtcctagtacctactactgtacgtacgtaccgacttcgtagttacgacgttaacggtccggggtaccctaagttacgtaacggttcgacgggtacggtcgtacgggtcgggtacgacggtaacacgttactttaccgtaccgtaccgtacctaaccccgttaggtacccgtaacggtcccgtacggttcccgtaaccgggttaacccttaaaacgggttaacgttaaaccggtttaacgttttaaccgtaaacccgttaaaccgttttaaaccgttttaacccgttttaaccggttaacccgggtttaacccttaaaaaccggtaaacgtttaaacccgggtttaaaaccccgttaaccccggtttaaaccccccgttaacccggttttacccgggggttaccggggggtaaaaccccggggtaaaccgggggttaacccggttaaccgggggttaaaccggaaacccggtttaaaaccccggttaacgggttaaaaacccggttaccgggttttaacccgggggtaccccggttaacggggttttaacccccgaacccgtttaaccccgg

SEQ ID NO: 108057 - DNA, 324 bp, Homo sapiens
  misc_feature: GYAE6OF02GPYHU.12.1.A01.1.454.CMB.1.raw
  modified_base (152)..(152): a, c, t, g, unknown or other
  misc_feature (152)..(152): n is a, c, g, or t
  modified_base (242)..(242): a, c, t, g, unknown or other
  misc_feature (242)..(242): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (296)..(324): a, c, t, g, unknown or other
  misc_feature (296)..(324): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaactttattactgtcaacngagtaacacgtttaccctcccactttcggcggaggaccaaggtgagatcaaacgactgtggctgcaccatctgtctcatctcccgcatcngactcgtcgtatctgagcgggtctggccaagggtcactagtagctacnatncannnnnnnnnnnnnnnnnnnnnnnnnnnnn

SEQ ID NO: 108058 - DNA, 813 bp, Homo sapiens
  misc_feature: GYAE6OF02H0JK8.12.1.A01.1.454.CMB.1.raw
  modified_base (129)..(129): a, c, t, g, unknown or other
  misc_feature (129)..(129): n is a, c, g, or t
tcagatacgacgtacacgaccggtgctcgatttagacgtctcatcagggggagtctcagtcaggacacagcatggacatgagggtccccgctcagctcctggggctcctgctactctggctccgaggtnccagatgtgacatccagatcgacccagtcctccacgtccctcctgtctcgctactcgtaggtaaggagtaacgtaaacgtcctaacctacttacacttcggaccgacgggacgaggtagaacgggtacttaacggtttaacggtttaaaaagtttttaacgttggttttaaccgaacggtacgaaaaccggtaaaccggaacgggtaaaccgtcccgtaacggtaccctaccgttagtaaccgttacgaaccggtacggtactaacgtacccgtaaaggttacggaaacggttaccgggtacccgtaaaggtaacgggtttacgacgggttagggtacgggtacggaacgcggttaacgggtaacttaacggtttaacctttacccgaactaaccgtaagtactacggacgtaaccgccgttacggctaaccggtacgtagaacgttacgtgtaacgtactaagtagttaactacgtaacgtactaaaacgttaagtaacttaaactccttaaccgtaccttaacgttcgttaaccggaccggtaacgggtaactaagtcggtaacgaacggtaactaaaccggaagtcgtagggtcctaacggtacgaaccttaccgtaagtttaccgtagttacccgtaccgttaaccgttaccccgtttacccgactttacgtaacccggg

SEQ ID NO: 108059 - DNA, 740 bp, Homo sapiens
  misc_feature: GYAE6OF02I7HLF.12.1.A01.1.454.CMB.1.raw
  modified_base (512)..(512): a, c, t, g, unknown or other
  misc_feature (512)..(512): n is a, c, g, or t
  modified_base (550)..(550): a, c, t, g, unknown or other
  misc_feature (550)..(550): n is a, c, g, or t
tcagatacgacgtacacgaccggtgctcgatttagacgtctcatcagggggcaggagtcagtctcagtcaggacacagcatggacatgagggtccccgctcagctccgtggggctccgtgctactctggctccgaggtgccagatgtgacatccaagatcgacccagtcctccacttccctcctgtctagctatcgtgtacgcgtagacgagtacgtccaaccgtaactccgtaaccttccgggacccgggacaaacggtccgaacgtaacctacgtcgaacggtactacgtactttaaacgttttaaaggttacggtaacgtaccgtaacgacgtaaaacggaaaacccggaacggggtaaaccgtaccccggttaaaggttccctaggacttaccgtacgtacgcgtacgaccgttattaccgtagttacgacggtaacggtcggtactacgtacgtaagtacgtagtcggcgacggtcggtacggacgtctaacgtcttacacgttccncaccactagcgaacgtgttaccgactaaccgtacgtanaccgttattaccgtagtaaccgttaaacttaccttacgtaacgtactaaacgtacggtaaccttaacttacccttaacccgttcccgtaacggtttaccgggacgggtaaaccgggcggttaacgggagtaaccggtacgttaaacgaacggttacgttaccggtccggtacgtaccgtacccgtaacgg

SEQ ID NO: 108060 - DNA, 663 bp, Homo sapiens
  misc_feature: GYAE6OF02GLFA8.12.1.A01.1.454.CMB.1.raw
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
  modified_base (455)..(455): a, c, t, g, unknown or other
  misc_feature (455)..(455): n is a, c, g, or t
  modified_base (461)..(461): a, c, t, g, unknown or other
  misc_feature (461)..(461): n is a, c, g, or t
  modified_base (463)..(464): a, c, t, g, unknown or other
  misc_feature (463)..(464): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (517)..(517): a, c, t, g, unknown or other
  misc_feature (517)..(517): n is a, c, g, or t
tcagatacgacgtacacgaccggtgctcgatttagacgtctcatcagggatagaagtttattcagcaggcacacaacagaggcagttccagatttcactctcaccatcagcagtctgaccaacctgaagattctagacaactttattaccgtagtacaaactagaacgttaacctacgtttaccccctacccgttacgttttacggggaccgggaacgggaccaaaggggtcggaagtactaccgaaaacgtaacgtcggtagggactaggaccaacctattccgttagtacctttactaccgttcccgtttaccccgaccctattaccgttagtaaccgttaacccggtttcggttaacttaccgtagggaaccgggtcggggtacccgttaggaccggaaaccggggtcgaaccgtagtaaggatnacgtagacngagccagtacaggacnangacganannananagacanananacanactananatagagtacganananatananagatanacacgatactactacgtacgtagtacgtacgagtacgtacgtacgtacgacgtacgtaccgtacgacacgtacgacgtacaccttaacgtaccggtacgtagacctagtacgtacgactaccgtagtaagtaccgttacgtaaccg

SEQ ID NO: 108061 - DNA, 561 bp, Homo sapiens
  misc_feature: GYAE6OF02JXU8R.12.1.A01.1.454.CMB.1.raw
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (347)..(347): a, c, t, g, unknown or other
  misc_feature (347)..(347): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (512)..(512): a, c, t, g, unknown or other
  misc_feature (512)..(512): n is a, c, g, or t
  modified_base (556)..(556): a, c, t, g, unknown or other
  misc_feature (556)..(556): n is a, c, g, or t
tcagatacgacgtacacgaccggtgctcgatttagacgtctcatcagggatagaagttattcagcaggcacacacagaggcagttccagattcaactgactcatcagcagtctgcacctgagatctgcaacttatactgtcaacagagtacagttaccctccacttcggaccggaggaccaaggtcgagtatacgaacgactggtaggctggactaccactctagtacttcacttccgtacccgactattctagtacttaccgtcgtatcgtaggacggtcggtactaggacgtacggcctagtacgtagcnctacgangcgtactntantanancagtnagtaccntacgtgtcagactacgcgtagacgtgtactacgcgtaatcgngacccncgtacactactcgtacgacgtacgtacgtactagtcgtacgtacgtacgtacgtacgtcgtacgtacgtacgtagtctacgacgtcgtacgtacgtacgtagtacgtcgtcgtacgngtgtacgtagtacgtacgtacgtacgcgtacgtacgtacgtagngtacg

SEQ ID NO: 108062 - DNA, 458 bp, Homo sapiens
  misc_feature: GYAE6OF02HSDOH.12.1.A01.1.454.CMB.1.raw
  modified_base (159)..(159): a, c, t, g, unknown or other
  misc_feature (159)..(159): n is a, c, g, or t
  modified_base (229)..(229): a, c, t, g, unknown or other
  misc_feature (229)..(229): n is a, c, g, or t
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
  modified_base (339)..(339): a, c, t, g, unknown or other
  misc_feature (339)..(339): n is a, c, g, or t
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
  modified_base (345)..(346): a, c, t, g, unknown or other
  misc_feature (345)..(346): n is a, c, g, or t
  modified_base (348)..(348): a, c, t, g, unknown or other
  misc_feature (348)..(348): n is a, c, g, or t
  modified_base (352)..(353): a, c, t, g, unknown or other
  misc_feature (352)..(353): n is a, c, g, or t
  modified_base (355)..(355): a, c, t, g, unknown or other
  misc_feature (355)..(355): n is a, c, g, or t
  modified_base (358)..(358): a, c, t, g, unknown or other
  misc_feature (358)..(358): n is a, c, g, or t
  modified_base (362)..(363): a, c, t, g, unknown or other
  misc_feature (362)..(363): n is a, c, g, or t
  modified_base (365)..(365): a, c, t, g, unknown or other
  misc_feature (365)..(365): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (381)..(382): a, c, t, g, unknown or other
  misc_feature (381)..(382): n is a, c, g, or t
  modified_base (391)..(392): a, c, t, g, unknown or other
  misc_feature (391)..(392): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (423)..(423): a, c, t, g, unknown or other
  misc_feature (423)..(423): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgctaacttattactgtcaacagagtaacngttacccctcctacttcggcggagggacccaagggtggacgatacgaaacgaccgtgtggactgcacctntctgtctctacgtccttcccgctattccgngtacttaccgttacgttacncggttagacggccggggtcttagggccgaaacgggtcgaaccgtaaggttcgagcgtgtngngngnngncgcnncnctnctcnncncgntcacgcangancnncgtctgtcnncncgtcgctcncgcntcgtctactcgtagtncgttccgtgtcgtccgtaccgtccgtaacgtcgta

SEQ ID NO: 108063 - DNA, 385 bp, Homo sapiens
  misc_feature: GYAE6OF02GCQEY.12.1.A01.1.454.CMB.1.raw
  modified_base (337)..(337): a, c, t, g, unknown or other
  misc_feature (337)..(337): n is a, c, g, or t
  modified_base (340)..(385): a, c, t, g, unknown or other
  misc_feature (340)..(385): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagtattctgacaactttattacgtgtacaacagaagtaacacgtttacccctccgtactttcgggcggaagggacccaagggttgggaacttaccgaaaacggactggtggctcgacacctattctcgtcttcattcccgttcccgacctattcgtagaacttacggtctattcgaggacggcgggtcgtggaccgtaaggcgacagttacgnagnnnnnnnnnnnnnnnnnnnnnnnnnnnnnnnnnnnnnnnnnnnnnn

SEQ ID NO: 108064 - DNA, 859 bp, Homo sapiens
  misc_feature: GYAE6OF02GA7R4.12.1.A01.1.454.CMB.1.raw
  modified_base (181)..(181): a, c, t, g, unknown or other
  misc_feature (181)..(181): n is a, c, g, or t
  modified_base (212)..(212): a, c, t, g, unknown or other
  misc_feature (212)..(212): n is a, c, g, or t
  modified_base (577)..(577): a, c, t, g, unknown or other
  misc_feature (577)..(577): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctcctgtctgcatctgtancagacgagagtcaccatcacttgcccggganaagtcaacgtccatcagctagactaatttaaatcggtatacagtcaacggaaaccgaaggggaacgtacccctaagggttccctagtaactacgtactcgtcgtacgcctaattcccgtaagtttaccggacgttaaaaacggggtcgggtaccccgtaagttacggtaaaacggtttcggtaccgggtaggggtaccgttaagggttacggggttaccggttacgggggtaaacctaacgggtttacttttaaccccgtaccggttacccttaacggtaaaccctacgtaactaacgggaccttaacgggttcttaaaccgggaccgttaaaacccgtagggtaaaacgttacgttaacccggnggttaaaccttttaacctttaagttaacccgggtttacgttaaaccgtaaaccgggtaaacttaaaccggtttaaaccgttaacccggttttaaccccccttaaccccggtttaacccgggttttaaacggggaaccccggggttaacggggaaacccggtttaacggggaacggttaacgttaaccgggtaaaccctaaaaaccgggttaacgttacgggttacccgggtaacgaccggtaccccgttaactaaccggtttccgtaacgttttaaccccgg

SEQ ID NO: 108065 - DNA, 711 bp, Homo sapiens
  misc_feature: GYAE6OF02HG2BH.12.1.A01.1.454.CMB.1.raw
  modified_base (427)..(427): a, c, t, g, unknown or other
  misc_feature (427)..(427): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctcctgtctgcatctgtagcagacagacgtcaccatcacttggcccgggacaacgtcagaccatcgagcagtcttaatttaagttggtatcgagacaagaaaccgaaggggaaccaccccgtaaggtccagtactcttagtcgtcgtcgacctagtaccgttagttagacgtaaaggggttcggggtacccacgttaccggtaaggttccgaggtccggagtagggttcgggtcggtagggaacgtagttactttccacctttcnccaacttactccgaacgtcgaccgttactacggaaccctaacgtacggtaaacttaacgtttcctaacggttaaccttaaacgttttacttaaccggtacgtaaccaaacgtaaagggttaaacccgtttaacccgttaacccgtttaccccgtacccgtttaacgggtttaccggaccgggggttaaccgaacccgggttaaggtacgggaacttaacggtaaccgaaacggttacgttacggtcggtacgttaccgacctaccgtacgttacctgttacccg

SEQ ID NO: 108066 - DNA, 710 bp, Homo sapiens
  misc_feature: GYAE6OF02HCMOW.12.1.A01.1.454.CMB.1.raw
  modified_base (294)..(294): a, c, t, g, unknown or other
  misc_feature (294)..(294): n is a, c, g, or t
  modified_base (431)..(431): a, c, t, g, unknown or other
  misc_feature (431)..(431): n is a, c, g, or t
  modified_base (463)..(463): a, c, t, g, unknown or other
  misc_feature (463)..(463): n is a, c, g, or t
  modified_base (473)..(473): a, c, t, g, unknown or other
  misc_feature (473)..(473): n is a, c, g, or t
  modified_base (498)..(498): a, c, t, g, unknown or other
  misc_feature (498)..(498): n is a, c, g, or t
  modified_base (514)..(514): a, c, t, g, unknown or other
  misc_feature (514)..(514): n is a, c, g, or t
tcagatacgacgtacacgaccggtgctcgatttagacgtctcatcagggggcaggagtcagtctcagtcaggacacagcatggacaatgagggtccccgctcagctcctggggctcctgctactctggctccgaggtcgccagatgtgactagtccagatcgacccagtcctccatccctccctgtctgctagtctgtgcagacagacgtactaccatacacttggccggactaacgtccgacgaccaagtccagtaccgagtacttaaagtttaacgttacgtaataccgtanacaaccggaaaaccgaacgggaaaccgtcccccgtttaaaggtcccgtgtaacttaccgtagtccgcgttcgtaccaccttaccgtaacggttacgtaacggttaaccggtccgggtacctaagtcgtaacggtacncggtaggtcgtaggtcggtggtacggtacgtnttaaccgttntacccgtctaccgtacctagtaccncggtaacgtcgttacncgtacgtaaacgtcgaaagtttaccgtcgtaactactttaacgtacttaaggacttacaaaccggtacttaacggtaaaccctccgttaaccccgtaccgttacgggtcccgggagaaccgggtaacgtggggtaacggaacttaaccggtaaccgtaggtaaccgttggttacgggcctaccgtacggttaaccc

SEQ ID NO: 108067 - DNA, 728 bp, Homo sapiens
  misc_feature: GYAE6OF02I04OT.12.1.A01.1.454.CMB.1.raw
  modified_base (470)..(470): a, c, t, g, unknown or other
  misc_feature (470)..(470): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtcgccagatgtgacatccagatcgacccagtcctccatcctcctgtctgcatctgtagcagacagacgtcaccatcacgttcggccgggacaagtcaacgaccatccgagcctagtacttaatttaaattggtatacagacaaggaaaaccgaagggtaaacgccccgttaaaagggtccttaggaacttcctaagttcgaccgttaggacctaacttacccgtaagttttggaacctaaaggggtccggggtacccctaaagttaccgaaggttacgaacgggttcggaccgggtttaggttacggggggtaccgtaggggtaacctagttacgtttaacccncgttaccctaccgtaaaccacgtacgtaacgctaacggtccgtacgaaccgtaacccgtaagtacgttaataccgtcgtaacttaacttaacgttactacgttaacaaaggtactacctaaacgtaccttaccccgttaccgtaacgttacggaaccgggttagggaacccgtaagggtcggtaacgtaaacggtaacccgtaaacgtaaccggttcggacggtactccggtaactaaccgtcgttacttcggttacc

SEQ ID NO: 108068 - DNA, 830 bp, Homo sapiens
  misc_feature: GYAE6OF02H5DJW.12.1.A01.1.454.CMB.1.raw
  modified_base (99)..(99): a, c, t, g, unknown or other
  misc_feature (99)..(99): n is a, c, g, or t
  modified_base (542)..(542): a, c, t, g, unknown or other
  misc_feature (542)..(542): n is a, c, g, or t
tcagatacgacgtacacgaccggtgctcgatttagacgtctcatcagggggcaggagtcagtctcagtcaggacacagcatggacatgagggtccccgntcagctccgtggggctcctgctactctggctccggaggtcgccagatgtcgacactccagatcgaccctacgtcctccactccctcctgtctgactacgttctaggtaacgacgaagaacaggtacgtaccaaccgtaacttccgtaccgttcgggaccggacgtaacgcctaacgaccgatccaggaccgtaagtactttaaacgttttaagttacgtactacgacgaacgaaaacggaaaccggaacggtaaccgtaccccggtaaggttacctacggtaccttctacgcgtacgtaccgtaccttcgtaccgttacggttaacgaaccggttaacggttacccgggtacctagttaaccggtaggttacggtacggtcggtacgggttggaacgggttacggacggtacggtactttacggtacaccgttcctaaccganccgttacgaggtctacggttcctaacggaccttaacggttagacgttacttaacctaccggtaaacttacgttaaaccgttaccgtttacgaaacccttaaagggtaaccgttaacccgtttaaaccggttaaaccccgttacccgttacccgggtttaaccggttacccggggggaaccgggtaaccgggttaaaccggtacgggttaacgggtaaaccttaacgaaacccggtttaacggtaccgggttacggtacccggggtactaccggttaaccctaacccgg

SEQ ID NO: 108069 - DNA, 760 bp, Homo sapiens
  misc_feature: GYAE6OF02G45Z8.12.1.A01.1.454.CMB.1.raw
tcagatacgacgtacacgaccggtgctcgatttagacgtctcatcaaggaagggaagggggcaggagtcagtctcagtcaggtcacagcagtggacatgacgggtccccgctcagctccgtggggcctcctgctactctggctccggaggtcgccagatgtcgacactccagctcgaccctagtcctccactccctcctgtacctgctatcgtggtaggaacaactaagtccaactactctacgtcggccggtactaacgagtagttacgtcgtacctaagtttaagtttaaacgttggtaactaacgaaaacgaaaacgcgaaggtaactaaaccggtaccgaaacgtccttacgtagttattatcggcgtaccgactacgtgtccgtacggacggttacgggttccggttaccacgttaagtccgtaggtccgggtacggttagaacgtacggacgggtaactaaacggttacgtttaccacctaaccgacgttaatccgtagtaccgtactaacggtacgtacgtaagtaacgttagtactttaccggttaactttaacctttaacgttcgtaacgctaacggtaaccgtacggttacccgttaccgcccgttactacccctaagttaccggttaacccgttaccggaaaccgttaacggggcccctaaaccggtcgtaaacccggttaacggtacggttaacgggaacccgttaggtccgggtacgaccggttacccaccgtaccgttattcccgg

SEQ ID NO: 108070 - DNA, 595 bp, Homo sapiens
  misc_feature: GYAE6OF02IT7NJ.12.1.A01.1.454.CMB.1.raw
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (387)..(388): a, c, t, g, unknown or other
  misc_feature (387)..(388): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (468)..(468): a, c, t, g, unknown or other
  misc_feature (468)..(468): n is a, c, g, or t
  modified_base (491)..(491): a, c, t, g, unknown or other
  misc_feature (491)..(491): n is a, c, g, or t
  modified_base (509)..(509): a, c, t, g, unknown or other
  misc_feature (509)..(509): n is a, c, g, or t
  modified_base (574)..(574): a, c, t, g, unknown or other
  misc_feature (574)..(574): n is a, c, g, or t
  modified_base (588)..(588): a, c, t, g, unknown or other
  misc_feature (588)..(588): n is a, c, g, or t
tcagatacgacgtacacgaccggtgctcgattttagacgtctcatcagggtatagaagttattcagtcaggcacacaacagaggcagttccagatttcaactgctcatcagcagtctcgcaacctgaagtatcgtgacaactttatacttgactaacaggacgttaactacgtttacccctccctaacgtttcgggacggaacggggtaacctaagggtgaacgtactacgaaaacgaccgttggtaggccttgccacgtatccgttactacgttcacgttccttcccgaccctatcgtagtacgttacgtaccgttaatcctaggtaacggcgggtctacgggtacggaaacgggtcaacgtcaaggtacgcaagtcgngagntgnncatcngcgctacganancgtcncgcncgtactcgcgacgcgacgacngacgngagcgactcgtacgtcgtacgtaagtanacggtagtactactaacgtctancgtagtagtgctcgttanactaccgtagtagaaccgtgaaccgagtactagtacacgtacgtcgagtaggacgtcgacgtacntcttcgactaccgngtaccgg

SEQ ID NO: 108071 - DNA, 524 bp, Homo sapiens
  misc_feature: GYAE6OF01D4LVU.49.40.D07.1.454.CMB.1.raw
  modified_base (497)..(497): a, c, t, g, unknown or other
  misc_feature (497)..(497): n is a, c, g, or t
  modified_base (521)..(521): a, c, t, g, unknown or other
  misc_feature (521)..(521): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccctgttttggtcctttatcgagacttcaatcggcccgctgggatccctgagcgattctctggctccacgtcggggaacagggccactctgaccatcatcagggcccagggcgacgatgaggctgactattactgtcagggtcgaagacgccaaacttgtcatagttcggcggagggaccaaattgaccgtctgggtcagccaaggctcgcccctggtcnctctcgttcccgcctcctctctcnctc

SEQ ID NO: 108072 - DNA, 523 bp, Homo sapiens
  misc_feature: GYAE6OF01EDJUZ.49.40.D07.1.454.CMB.1.raw
  modified_base (495)..(495): a, c, t, g, unknown or other
  misc_feature (495)..(495): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccctgttttggtcctttatcgagacttcaatcggcccgctgggatccctgagcgattctctggctccacgtcggggaacagggccactctgaccatcatcagggcccagggcgacgatgaggctgactattactgtcaggtcgaagacgccaaacttgcatatcggacggagggaccaaattcgaccgtctgggtcagcccaaggctcgcccctggcnctctgtccccgcctcctctctctcgtac

SEQ ID NO: 108073 - DNA, 523 bp, Homo sapiens
  misc_feature: GYAE6OF01EOYPJ.49.40.D07.1.454.CMB.1.raw
  modified_base (494)..(494): a, c, t, g, unknown or other
  misc_feature (494)..(494): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccctgttttggtcctttatcgagacttcaatcggcccgctgggatccctgagcgattctctggctccacgtcggggaacagggccactctgaccatcatcagggcccagggcgacgatgaggctgactatactgtcaggtcgaagacgccaaacttgtacatattcggcggaggaccaaattgaccgtctgggtcagcccaaggctcgcccctggcnctctgttcccgccctcctctctctcgtac

SEQ ID NO: 108074 - DNA, 542 bp, Homo sapiens
  misc_feature: GYAE6OF01CAM30.49.40.D07.1.454.CMB.1.raw
  modified_base (339)..(339): a, c, t, g, unknown or other
  misc_feature (339)..(339): n is a, c, g, or t
  modified_base (415)..(415): a, c, t, g, unknown or other
  misc_feature (415)..(415): n is a, c, g, or t
  modified_base (508)..(508): a, c, t, g, unknown or other
  misc_feature (508)..(508): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaaataagaatattcactggtatcaacaaaagcctggccaggccctgttttggtcctttatcgagactttcaatcggcccgctgggactccctgagcgattcnctggctccacgtcggggaacagggccactctgaccatcatcgacgggcccagggcacgatgaggctgactattacngtcaggtcaagccgaccaaattgtcaatagttcggacggagggacctaaattcgaaccgtctgggtcagcccaaggcctcgccccctggtccnctctcgttccccgcctccctctcctcctcgtacc

SEQ ID NO: 108075 - DNA, 528 bp, Homo sapiens
  misc_feature: GYAE6OF01BA1X7.49.40.D07.1.454.CMB.1.raw
  modified_base (500)..(500): a, c, t, g, unknown or other
  misc_feature (500)..(500): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaatagaatattcactggtatcaacaaaagcctggccaggcccctgttttggtcctttatcgagacttcaatcggcccgctgggatccctgagcgattctctggctccgacgtcggggaacagggccactctgaccatcatcagggcccagggcgacgatgaggctgactatactgtcaggtcgaagacgccaaacttgtacatagttcggacggagggaccaaagttgaccgtctgggtcagcccaaggctcgcccctggtcnctctcgttcccaccctctctctctcgac

SEQ ID NO: 108076 - DNA, 619 bp, Homo sapiens
  misc_feature: GYAE6OF01DRCPN.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccctgttttggtcctttatcgagacttcaatcggcccgctgggactccctgagcgattctctggctccacgtcggggaacagggccactctgaccatcatcagggcccagggcgacgatgaggctagactattactgtcagggtcgaacgacgacctaaactttgactattagttcgggacgggaacgggtaacctaaagttcggaacccggttccgtggggttaccaacggccccgaaacgggcccttccggcccccccttcgggtaccctacccgttcccgttccggtttccccccgtcccccgtttccccttcctttcccctccgttcccggtaacccg

SEQ ID NO: 108077 - DNA, 577 bp, Homo sapiens
  misc_feature: GYAE6OF01B16VM.49.40.D07.1.454.CMB.1.raw
  modified_base (316)..(316): a, c, t, g, unknown or other
  misc_feature (316)..(316): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccctgttttggtcctttatcgagacttcaatcggcccgntgggatccctgagcgattctcgtggcctccgacggtcggggaacagggcccactctcgaccatcatcgacgggcccgaggggccgacgatggaggctgacttattactgtcgaggtcgaagaccgacctaaattgtacagttacgttccgggacgggaacggaacctaaagttcgaccgttccgtgggtacacggacccgaggtcctccggcccccttggtccacttctccgttccccaccctccctctcctcgtccgtac

SEQ ID NO: 108078 - DNA, 621 bp, Homo sapiens
  misc_feature: GYAE6OF01BLZSZ.49.40.D07.1.454.CMB.1.raw
  modified_base (228)..(228): a, c, t, g, unknown or other
  misc_feature (228)..(228): n is a, c, g, or t
  modified_base (295)..(295): a, c, t, g, unknown or other
  misc_feature (295)..(295): n is a, c, g, or t
  modified_base (317)..(317): a, c, t, g, unknown or other
  misc_feature (317)..(317): n is a, c, g, or t
  modified_base (416)..(416): a, c, t, g, unknown or other
  misc_feature (416)..(416): n is a, c, g, or t
tcagagtcgagagacacgaccggtgctcgatttagtgatagagcgtaacaacgagaggggctgggcctcaggaagcagcactcgggggtgccgcagccatggcctggaccgctctccttctgagtcctccttgctcactttacaggttatgtcgcctcctacgaagtgattcagccacgttccgtctcagtggccctgggacaggacgccacaattacctgtgacggngagaacaatcgaaataagatatcatgtatcaacaaagcctggccaggccctgttttcggccctttancgagacttcgaatccggcccgngtgggactcccgtgagcgtatttcctctgggcctaccgacggttacggggaaactaggggcccacgtctcgaccatccatcgagggcccagggccacgntcgagctagacttattctgtcgaggtcaaagcctaccaaattcgactacgttagtcgggcggtaagggacctaaggttcgacccgttcgtgggtaccacggtcccgaaagggtccttacgggccccccttgggtaccctacccgttaccgttccgtttaccccccaccgtttacccctcggttcccttcccgtacccgggtaccc

SEQ ID NO: 108079 - DNA, 539 bp, Homo sapiens
  misc_feature: GYAE6OF01A5VVK.49.40.D07.1.454.CMB.1.raw
  modified_base (414)..(414): a, c, t, g, unknown or other
  misc_feature (414)..(414): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattaccctgtgacggcgagaacaatcgaaataagaatattcactggtatcaacaaaagcctggccaggcccctgttttggtcctttatcgagacttcaatcggcccgctgggatccctgagcgattctctggctccacgtcggggaacaggggccactctgaccatcatcagggcccagggcgacgatgaggctgactattacngtcaggtcgaagacgaccaaacttgtcatattcgggcggagggaccaaagttgaccgtcctgggtcagcccaaggctcgccccctggtcacctctcgttccccaccctcctctcctctcgtaccc

SEQ ID NO: 108080 - DNA, 573 bp, Homo sapiens
  misc_feature: GYAE6OF01EPA99.49.40.D07.1.454.CMB.1.raw
  modified_base (533)..(533): a, c, t, g, unknown or other
  misc_feature (533)..(533): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccttgttttggtcctttatcgagacttcaatcggcccgctggggactccctgagcgattctctggcctccgacggtcggggaacaggggccactctgaccatcatcgacgggcccagggcgacgatggagctgactattactgtcaggtcgaagacgacctaaacttgtacattacgttcgggacgggaacgggacctaaagttcggaccgtccgtgggtccacgccccgaaggcctcggccccccgttggtccnccgtcctcgttcccccacccttccctctcctcctcgtacc

SEQ ID NO: 108081 - DNA, 545 bp, Homo sapiens
  misc_feature: GYAE6OF01CGK5P.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccctgttttggtcctttatcgagacttcaatcggcccgctgggatccctgagcgattctctggctccgacgtcggggaacaggggccactctgaccatcatcgagggcccagggcgacgatgaggctgactattactgtcaggtcgaagaccgaccaaacttgtacatagttcggcggagggacctaaagttcgaccgtcgtgggtcagcccgaaggcctcgccccctggtccactcctcgttccccaccctcctctctcctcgtacc

SEQ ID NO: 108082 - DNA, 609 bp, Homo sapiens
  misc_feature: GYAE6OF01C195C.49.40.D07.1.454.CMB.1.raw
  modified_base (217)..(217): a, c, t, g, unknown or other
  misc_feature (217)..(217): n is a, c, g, or t
  modified_base (321)..(321): a, c, t, g, unknown or other
  misc_feature (321)..(321): n is a, c, g, or t
  modified_base (344)..(344): a, c, t, g, unknown or other
  misc_feature (344)..(344): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattaccngtgacggcgagaacaatcgaaaataagaatattcactggtatacaacaaaagcctggccaggccctgttttcggtcctttatcgagtacttcaatccggcccgntcgggatccctagacgcgattcnctggcctccgaacggtcggggaaacacggggccaactcgtcgaacccatccaacgttcgaacggggccccaagggggccgtaacggatacggaacgggctaggaacttaattaactggttacagggtacgaaagacgacctaaacttgacaagtagttcggacgggagggaacctaaagttcggacccgttcgagggtacacggcccgaaaggcctacgcccccgtggccacgttcctcgttccccgctcctctctcgccgtacg

SEQ ID NO: 108083 - DNA, 542 bp, Homo sapiens
  misc_feature: GYAE6OF01CA0N6.49.40.D07.1.454.CMB.1.raw
  modified_base (183)..(183): a, c, t, g, unknown or other
  misc_feature (183)..(183): n is a, c, g, or t
  modified_base (217)..(217): a, c, t, g, unknown or other
  misc_feature (217)..(217): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtntcagtggccctgggacagacggccacaattaccngtgacggcgagaacaatcgaaataagatatcactgtatcaacaaaagcctggccaggccctgttttggtcctttatcgagacttcaatcggcccgctgggatccctgagcgattctctggctccacgtcggggaacaggggcccatctgaccatcatcaggcccagggcacgatgaggctgactatactgtcaggtcgaagacgcctaaacttgtacaatcgttcgggcggaaggacctaaattcgacccgttcctgggtacacgcccaaggcctcgccccctggtccactcgtcgttccccaccctcctctccttcgtcgtacc

SEQ ID NO: 108084 - DNA, 527 bp, Homo sapiens
  misc_feature: GYAE6OF01CZPBK.49.40.D07.1.454.CMB.1.raw
  modified_base (358)..(358): a, c, t, g, unknown or other
  misc_feature (358)..(358): n is a, c, g, or t
  modified_base (498)..(498): a, c, t, g, unknown or other
  misc_feature (498)..(498): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacgtcggggaacngggccactctgaccatcatcgagggcccagggcgacgatgaggctgactattactgtcagggtcgaagacgccaaacttgcattattcggcggaggaccaagttcgaccgtctgggcacgccaaggctcgcccctggtcnctctcttcccaccctcctctcctctcgtc

SEQ ID NO: 108085 - DNA, 552 bp, Homo sapiens
  misc_feature: GYAE6OF01EWCVK.49.40.D07.1.454.CMB.1.raw
  modified_base (516)..(516): a, c, t, g, unknown or other
  misc_feature (516)..(516): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccctgttttggtcctttatcgagacttcaatcggcccgctgggactccctgagcgtattctcgtggcctccgacgtcggggaacagggccactctgaccatcatcgacgggcccagggcgacgatgaggctgactatctgtcaggtcgaagacgacctaaattgtacagttacgtcgggcggaagggacctaaagttcgacccggtctgggtcacgcccaaggcctcgcccctggtccncgttctcgttccccacccttctctctccgtcgtacc

SEQ ID NO: 108086 - DNA, 664 bp, Homo sapiens
  misc_feature: GYAE6OF01C3S2B.49.40.D07.1.454.CMB.1.raw
  modified_base (219)..(219): a, c, t, g, unknown or other
  misc_feature (219)..(219): n is a, c, g, or t
  modified_base (459)..(459): a, c, t, g, unknown or other
  misc_feature (459)..(459): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctcttgctcactttacaggttatgtggcctcctacgaagtgattcagccacgttccgtctcagtcggccctgggacagacggccactaattaccngtgacggcgagaacaatcgaaaatagaatattcactggtatacaaacaaaagcctggaccacggtcccttgttttcgtcctttatcgagtacttcaagtccggaccgtcgtgggactccgtggacgcgtattctcgtcggctccgacggtacggggaacgacgggcctactcgtacgacctagtcagtcgacgggcccgagggcgaacgagtacggacggtctacgacttagtttaacgngtacagggtacgaaacgtcgaacctaaactttgactagttacgttcgggacggtaacggaaccttaaagtcggaacccgttcgtacggggtaccacggtaccccgaagggtccctacccggtcccccgttacggttacctaccgtttcccgtcccggttaccccctaccccgttcccttacccgttccttcccgtcccgtacccg

SEQ ID NO: 108087 - DNA, 583 bp, Homo sapiens
  misc_feature: GYAE6OF01BA9FX.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactgtatcaacaaagcctggccaggccctgtttgtcctttatcgagacttcaatcggcccgcgtgggactccctgagcgattctctggcctccgacggtcggggaacacgggccatctcgaccatcatcgacgggcccagggcacgatgaggctagactattacgtgtacgaggtacgaacgaccgacctaaacttgtacaagttacgttcgggacgggtaacgggaacctaaagttcgacccgtcgtcgggtacacggcccaagggcctccggcccccgtggtcctacctccgtccgttccccgtccccttcctccttcctccgtccgtacc

SEQ ID NO: 108088 - DNA, 612 bp, Homo sapiens
  misc_feature: GYAE6OF01ALTQ5.49.40.D07.1.454.CMB.1.raw
  modified_base (369)..(369): a, c, t, g, unknown or other
  misc_feature (369)..(369): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactgtatcaacaaagcctggccaggccctgttttcggtcctttatcgagacttcaacgtccggcccgtcgtgggactcccgtgacgcgtattctcgtggcctccgacggtcggggaacncggggcccacgtctacgaccatcactcgacgggcccagggcgacgatggaggctagactattcgtgtacgaggtaccgaagaccgacctaaacgttcgtactattacgttcgggacgggtaacggaacctaagttcggacccgtcgtagggaccacgacccgaaggtccgtccggtcccccgtggtaccctaccgttccgttcccgttcccccgtcccttcccttcctcctccgtccggtacc

SEQ ID NO: 108089 - DNA, 536 bp, Homo sapiens
  misc_feature: GYAE6OF01BASX2.49.40.D07.1.454.CMB.1.raw
  modified_base (504)..(504): a, c, t, g, unknown or other
  misc_feature (504)..(504): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagactttcaatcggcccgctgggatccctgagcgattctctggctccacgtcggggaacaggggccactctgaccatcatcagggcccagggcgacgatgaggctgactattactgtcaggtcgaagacgccaacttgtcatattcggcggagggaccaaagttcgaccgtcctgggtcagcccaaggcctcgccccctggtccnctcctgttccccgccctcctcctctctcgtac

SEQ ID NO: 108090 - DNA, 562 bp, Homo sapiens
  misc_feature: GYAE6OF01CRXKY.49.40.D07.1.454.CMB.1.raw
  modified_base (430)..(430): a, c, t, g, unknown or other
  misc_feature (430)..(430): n is a, c, g, or t
  modified_base (530)..(530): a, c, t, g, unknown or other
  misc_feature (530)..(530): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggcacaattacctgtgacggcgagaacaatcgaaaatagaatattcactggtatacaacaaaagcctaggccacggtcccttgttttcggtcctttatcgagtacttcaatccggcccgctgggactcccgtgagcgtattctcgtggcctccgacggtcggggaacacgggccactcgtcgaccatcatcgacgggcccagggcacgatggacgctgactattacngtacgagggtcgaaagccgactaacttgacagttagtcggaacgggtaggaacctaagtcgaccgtcgtggacagcccgaaggtcctcgcccctgtaccncgtctccttcccaccctctctcctcgtctacg

SEQ ID NO: 108091 - DNA, 665 bp, Homo sapiens
  misc_feature: GYAE6OF01CTWQ3.49.40.D07.1.454.CMB.1.raw
  modified_base (217)..(217): a, c, t, g, unknown or other
  misc_feature (217)..(217): n is a, c, g, or t
  modified_base (264)..(264): a, c, t, g, unknown or other
  misc_feature (264)..(264): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattaccngtgacggcgagaacaatacgaaataagaatattcactggtatcaaanaaaagcctggccaggccctgttttggtcctttatcgagtacttcaatcggcccgctgggactccctgagcgattctctggctccacggtcggggaacagggccactctgaccatcatcgacgggcccagggcgaacgatggacggctagacttattaactgtacgaggtacgaaacgacgacctaaactttgtactaagttacgttccgggacgggtaacgggaaccctaaagtttcggaacccggttccgtacggggtacccaacggtccccgaaagggtcccttaccgggtccccccccgttacggggttacccaaccccgtttcccgttaccccggtttaccccccctaaccccccgtttccccttcccgtttccccttcccgttcccggttaacccg

SEQ ID NO: 108092 - DNA, 538 bp, Homo sapiens
  misc_feature: GYAE6OF01B8N9N.49.40.D07.1.454.CMB.1.raw
  modified_base (509)..(509): a, c, t, g, unknown or other
  misc_feature (509)..(509): n is a, c, g, or t
  modified_base (522)..(522): a, c, t, g, unknown or other
  misc_feature (522)..(522): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccctgttttggtcctttatcgagacttcaatcggcccgctgggatccctgagcgattctctggctccacgtcggggaacagggccactctgaccatcatcgacgggcccagggcgacgatggaggctgactattactgtcaggtcgaagaccgaccaaacttgtcatagttcggacggaggacctaaagttgaccgtcgtcgggtcacgcccaaggctcgccccctggtccnctctcgttccccncctcctctctctcgtc

SEQ ID NO: 108093 - DNA, 637 bp, Homo sapiens
  misc_feature: GYAE6OF01D2HDY.49.40.D07.1.454.CMB.1.raw
  modified_base (306)..(306): a, c, t, g, unknown or other
  misc_feature (306)..(306): n is a, c, g, or t
  modified_base (382)..(382): a, c, t, g, unknown or other
  misc_feature (382)..(382): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtcggccctgggacagacggccacaattcctgtgacggcaagaaacaatacgaaataagaatattcactggtatacaaacaaaagcctaggccacggtccccttgttttcggtcctttancgagtacttcaagtccggcccgcgtgggactcccgtgacgtcgtatttctcgtcggcctccgacggtcggggaacncgggcccactcgtacgaccatcacgtcgacgggcccgaggggcgaacgagtggacgggtctagtaacttattacgtgtacgaggtacgaagaccgacctaaacgttgtactagtacgttcggacggacggaacctaaagttccgaccgttccgtgggaccaccggaccaacggcctaccggtccccccgtggtaccctccgttccttcccgtaccccctacccctttccctacccttcctccgttcccgtacccg

SEQ ID NO: 108094 - DNA, 585 bp, Homo sapiens
  misc_feature: GYAE6OF01DLWQB.49.40.D07.1.454.CMB.1.raw
  modified_base (409)..(409): a, c, t, g, unknown or other
  misc_feature (409)..(409): n is a, c, g, or t
  modified_base (543)..(543): a, c, t, g, unknown or other
  misc_feature (543)..(543): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaaacaaaagcctggccaggcccttgttttggtcctttatcgagactttcaatccggcccgctgggactccctgagcgattctcgtggcctccgacggtcggggaacacggggccactctcgaccatcatcgacgggcccagggcgacganggaggctgacttattactgtcaggtcgaagaccgaccaaagtttcgactaagttacgttccgggcgggaacgggacctaaagttcgtacccgttctcggggtcacggacccagggcctccgcccccgtggtccncctccgtccgttccccgtcccttccctcctctcctcgtaccc

SEQ ID NO: 108095 - DNA, 714 bp, Homo sapiens
  misc_feature: GYAE6OF01BS5WR.49.40.D07.1.454.CMB.1.raw
  modified_base (220)..(220): a, c, t, g, unknown or other
  misc_feature (220)..(220): n is a, c, g, or t
  modified_base (303)..(303): a, c, t, g, unknown or other
  misc_feature (303)..(303): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctccttgctcactttacaggttatgtggcctcctacgaagtgattcagccacgttccgtctcagtcggccctgggacagacggccaacaattaccngtgacggcgaagaacaatacgaaaataagaatattcactgtatacaaacaaagcctggccaggcccttgtttcggtcctttancgagtacttcaagtccggcccgctcgggactcccgtgacgcgtattctcgtcggctccgacggtacggggaacacggggcctacgtcgtcgaaccagtccacgtacgacggggcccaggggaccgacgtagtggaacgggtctagtaacttattacgtcggttacgacgggtaaccgaaaggacccgtaacctaaacgtttcgtactaacgttacggttccgggacgggtaacgggaacccttaaagttccggtaacccggttcccggttaggggacccaacggtacccccggaaacgggtcccgtacccggtccccccgttagggttaccccacccgtttccccgttacccggtttacccccctaccccttccccttacccgttcccgttcccggttaccggtaaccccg

SEQ ID NO: 108096 - DNA, 557 bp, Homo sapiens
  misc_feature: GYAE6OF01AMZ66.49.40.D07.1.454.CMB.1.raw
  modified_base (358)..(358): a, c, t, g, unknown or other
  misc_feature (358)..(358): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaatagaatattcactggtatcaacaaaagcctggccaggccctgttttggtcctttatcgagacttcaatcggcccgctgggactccctgagcgattctctggctccgacgtcggggaacngggccactctgaccatcatcgagggcccagggcgacgatgagctgactattctgtcaggtcgaagaccgaccaaactttgtacagttagttcgggacggaagggacctaaagttcgacccgttccgtgggtaccacgcccaagggctccggccccctggtccacgtcctcgttccccacctccctctctccgtcgtacc

SEQ ID NO: 108097 - DNA, 526 bp, Homo sapiens
  misc_feature: GYAE6OF01A247M.49.40.D07.1.454.CMB.1.raw
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
  modified_base (497)..(497): a, c, t, g, unknown or other
  misc_feature (497)..(497): n is a, c, g, or t
  modified_base (518)..(518): a, c, t, g, unknown or other
  misc_feature (518)..(518): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacgggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccnctgggatccctgagcgattcnctggctccgacggtcgggaacagggccactctgaccatcatcgaggcccagggcgacgatgaggctgactattactgtcaggtcgaagacgacctaaacttgacatatcggcgaggaccaaattcgaccgtcctgggtcagccaaggctcgcccctgtcnctctcgtcccacctcctctcnctcgctcg

SEQ ID NO: 108098 - DNA, 566 bp, Homo sapiens
  misc_feature: GYAE6OF01A9Y45.49.40.D07.1.454.CMB.1.raw
  modified_base (357)..(357): a, c, t, g, unknown or other
  misc_feature (357)..(357): n is a, c, g, or t
  modified_base (394)..(394): a, c, t, g, unknown or other
  misc_feature (394)..(394): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcacttttacaggttatgtggcctcctacgaagtgattcagccacgttccgtctcagtggccctgggacagacggccacaattacctgtgacggcgagaacaatcgaaatagaatatcactgtatcaacaaagcctggccaggcccctgttttggtcctttatcgagacttcaatcggcccgctgggactccctgagcgattctctggctccgacgtcggggaacngggccactctgaccatcatccagggcccagggcacgntggagctgactagttactgtcagggtcgaagaccgacctaaactttgtacagttagttcgggacgggtagggaccctaaagttcgacccgtcgtcgggtcacggccccaaggcctcggccccccgtggtcctacctcctccgttaccccacccttcctcctcctctcgtacc

SEQ ID NO: 108099 - DNA, 795 bp, Homo sapiens
  misc_feature: GYAE6OF01CBVAW.49.40.D07.1.454.CMB.1.raw
  modified_base (120)..(120): a, c, t, g, unknown or other
  misc_feature (120)..(120): n is a, c, g, or t
tcagagtcgagagacacgaccggtgctcgatttagtgatagagcgtaacaacagaggggctgggcctcaggaagcagcagtcgggggtgccgcagccatggcctggaccgctctccttcngagcctcttgctctactttacaggttatgtcggcctcctacgaagtgattcagccacgttccgtctcaggtcgccctgggacagaccggccactaattcctgtagacggcgaagaaacaatacgaaaaattaagaattattaccaactggtaatacaaacaaaacgcctggaccacggtcccttagttttcggtcctttatcgtagtaccttcaacgttccggcccgtcgtacgggtacctcccgtggaacgtccgtactttcctcgttcgggccttacccggacggtacgggggaaaccacggggccctaacgttcgtaccggaaccctacgttaccacgtccggaaccggggaccccgtaacgggggacccgaacgggtacgttacggggaacggggtccttaacgtaaacccgtttaacgtttaacccggtgggtttaaccgaaccggggttaccggaaaaccgacccggtaaccctaaacgtttcgtacgttaaacgttacggttaccgggaaccggggtaaacgggaacccttaaaagtcccggtaacccggtccggtacgggtaccaacgggtccccgaaggtcccctcccggtaccccccgtggtcccaccttccgttccccgtccccctacccttcccgtttccctaccgttcccgttccgtacccg

SEQ ID NO: 108100 - DNA, 619 bp, Homo sapiens
  misc_feature: GYAE6OF01CBBDJ.49.40.D07.1.454.CMB.1.raw
  modified_base (366)..(366): a, c, t, g, unknown or other
  misc_feature (366)..(366): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattaactggtatcaaacaaaagcctggccaggccccttgttttggtcctttatcgagacttcaatccggcccgctgggactccctgacgcgtattctctggcctccgacggtcgggaacncgggccactctcgaccatcatcgacgggcccaggggcgacgatggaggctagacttattacgtgtcgaggtacgaacgaccgacctaaacgttgtactattacgttcgggacggtaacgggaacctaaagttcggaacccgttcgtagggtccacggacccgaacggcctccggccccccgttcgggtaccacccgttccgttcccgttacccccaccccgttccctacccttcctccgtccgtaccttccgg

SEQ ID NO: 108101 - DNA, 854 bp, Homo sapiens
  misc_feature: GYAE6OF01C0POS.49.40.D07.1.454.CMB.1.raw
  modified_base (120)..(120): a, c, t, g, unknown or other
  misc_feature (120)..(120): n is a, c, g, or t
tcagagtcgagagacacgaccggtgctcgatttagtgatagagcgtaacaacagaggggctgggcctcaggaagcagcagtcgggggtgccgcagccatggcctggaccgctctccttcngagcctcttgctcactttacaggttatgtggcctcctacgaagtgattcagcctacgttccgtctcaggtcggccctgggacaggaccggccaactaacttcctggtacgacggacgaagaacaatacgaaaatagaattatcaactggtatacaaacaaacgcctaggaccacggtcccttggttttcggttcctttagtcggtaacgtaccttacaacgttccggccgtcgtcgggactcccgtgacgtcgtacttcgtcgtcggcctaccggacgggtacggggaacgtacgggacctacgtcgtacggacctactcacgtccggaacgggcccgaggggaccggacggacgtacggacggtacgtacgtaacgttaacgttacgtacggtacggtacgggtaacggtaaacggtaaccgtaaccgtaaaccgacgtttttttttttttttttttttacgaacgttaacggttaccgggtaaccggggtaacgggtaaccggtaaacggttaaccggttacccgggttacccgggttaccggggttaccggtaccggtaacccggtaacccgggtacccggtaccccggttaccccccggttaccccgggttaccccggttaccccggtttaccccggtttaccccggtttacccccccgttaacccccccgtttaccccccgtttacccccgtttcccccgttccccggtttaccccggttaaccccggg

SEQ ID NO: 108102 - DNA, 541 bp, Homo sapiens
  misc_feature: GYAE6OF01A3UT0.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagactttcaatcggccgctgggatccctgagcgattctctggctccacgtcggggaacagggccactctgaccatcatcagggcccagggcgacgatgaggctgactatactgtcaggtcgaagacgaccaaattgtcatagttcggacggagggaacctaaagttcgacccgtcgtgggtccaggcccaaggcctcgccccctggccactctcgttccccgccctcctcctctctcgtacc

SEQ ID NO: 108103 - DNA, 556 bp, Homo sapiens
  misc_feature: GYAE6OF01EBEQR.49.40.D07.1.454.CMB.1.raw
  modified_base (209)..(209): a, c, t, g, unknown or other
  misc_feature (209)..(209): n is a, c, g, or t
  modified_base (216)..(216): a, c, t, g, unknown or other
  misc_feature (216)..(216): n is a, c, g, or t
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (407)..(407): a, c, t, g, unknown or other
  misc_feature (407)..(407): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagccctccttgctcactttacaggttatggtggccctcctagaagtgattcagccacgttccgctcagtggccctgggacagacgccanaattccngngacgnagaacatcgaaatagatattcatgtatcaacaaagctgccaggccctgtttcgtctttancgagtacttcaatcggccgntgggactccctgagcgattctctcggctccgacggtcggggaacaggggccactctagaccatcgatcgacgggcccagggcacgatgaggctgactagttacngtacaggtcgaagaccacctaaagttgacatacgtcggacggacggacctaaagttcggaccgtccgtgggtccaggccccaaggcctacccggtccccctaggtccaccttccgtccgttcccccgccttccctctcctctccgtacg

SEQ ID NO: 108104 - DNA, 675 bp, Homo sapiens
  misc_feature: GYAE6OF01B79PO.49.40.D07.1.454.CMB.1.raw
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (296)..(296): a, c, t, g, unknown or other
  misc_feature (296)..(296): n is a, c, g, or t
  modified_base (342)..(342): a, c, t, g, unknown or other
  misc_feature (342)..(342): n is a, c, g, or t
  modified_base (453)..(453): a, c, t, g, unknown or other
  misc_feature (453)..(453): n is a, c, g, or t
tcagagtcgagagacacgaccggtgctcgatttagtgatagagcgtaacaacagaggggctgggcctcaggaagcagcagtcgggggtgccgcagccatggcctgggaccgctctccttctgagccctcttgctcactttacaggttatgtgcctcctacgaagtgattcagcctacgttccgtctcagtcggccctgggacagacgcacaattccngtgacggnagaacaatcgaaaatagatattcactggtatacaacaaagcctaggccacggtccctgtttcggtctttancgagtacttcaactcggcccgctgggactcccgtgacgcgtattcncgttacggctaccgacggtacggggaacacgggccctacgtcgtacgaaccagtacacgtacgaccggggcccgagggacgacgagtgacggtctaggacctaagttacgngtacgaacggttacgaaagaccgaccgtaacgttcgtcaagtacggttaccgggacgggtaaaccgggtaacctaaagtttccggacccggttaccggtacgggtaccaccggtacccgtaacgggtccctacccccggtccccgtacggttccccaccgtttccccgttacccgttacccccctacccttcccgttacccttccttcccggtccgttaccg

SEQ ID NO: 108105 - DNA, 555 bp, Homo sapiens
  misc_feature: GYAE6OF01EHB72.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccctgttttggtcctttatcgagacttcaatccggcccgctgggatccctgagcgattctctggctccgacgtcggggaacagggccactctgaccatcatcagggcccagggcgacgatgagctgactatactgtcaggtcaagcgaccaaacttgacatagtcggacgggtagggacctaaagttcgacccggtcctggggtccacggccccgaaggccctcggcccccctggtccacttcctcgttccccgcccttccctctcctccgtcgtacc

SEQ ID NO: 108106 - DNA, 749 bp, Homo sapiens
  misc_feature: GYAE6OF01COUXU.49.40.D07.1.454.CMB.1.raw
  modified_base (215)..(215): a, c, t, g, unknown or other
  misc_feature (215)..(215): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctcttgctcactttacaggttatgtggcctcctacgaagtgattcagccacgttccgtctcagtcggcctgggacagacgccacaattccngtgacggcgaagaacaatacgaaaataagaatattcacttggtatacaaacaaaagcctaggaccacggtcccttggttttcggttcctttagtcgtaacgtacttcaacgtccggacccgtcgtcgggacttcccgtggacgcgtattcctcgtcggctccgacggtacggggaaacacggggaccctacgtcgtacgaaccgtatcacgtccggacgggacccgaggggtccgaacggacgtgggacggtctagtaacttagttacgtagtcgtaagggtaccgaaacggtaccgtaacctaaacgtttcgtactaagttacggttaccggggaacggggtaaccggtaaacctaaagtttccgggaacccggttacccggtacggggttaccaaccgggaccccgtaaacggggtcccttaccccgggtccccccggttacgggtacccctacccggtttccccgttacccggtttccccccgtccccctttacccgttccccgtttcccgttcccgttcccggttacccg

SEQ ID NO: 108107 - DNA, 581 bp, Homo sapiens
  misc_feature: GYAE6OF01EU05N.49.40.D07.1.454.CMB.1.raw
  modified_base (536)..(536): a, c, t, g, unknown or other
  misc_feature (536)..(536): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactgtatcaacaaaagcctggccaggccctgttttggtcctttatcgagacttcaagtccggcccgcgtggggactccctgagcgtattctctggcctccgacggtcggggaacagggccactcgtcgaccatcatcgacgggcccagggcgacgagtggaggctagacttaattacgtgtacgaggtacgaacgacgacctaaacttcgtcagttagttcgggacggtaagggacctaaagttcgaccgtcgtaggcacgcccaggcctaccggcccctggtccnccgtcctccgttccccctaccttccctcctccttcctccgtaccg

SEQ ID NO: 108108 - DNA, 647 bp, Homo sapiens
  misc_feature: GYAE6OF01AM6JN.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatatcactggtatacaacaaaagcctggccacggcccttgttttcggtcctttatcgagtactttcaactccggcccgcgtgggactcccgtgacgcgtatttctcgtcggcctccgacggtccggggaacacggggccacgtctcgaccatcatcgacgggcccgagggcgacgatggacggtctaggtacttaatttacgtcgtacgagggttaccgaaagaccgacctaaacgtttgtactaagttacgttcgggaccgggaagggaaccctaaagtttcggacccgttccgtagggtaccacggcccctaaagggcctacccggtccccccgttcgggtacctaccgttccgttcccgttcccccgtccccttaccctccttccttccgtccgtacccg

SEQ ID NO: 108109 - DNA, 535 bp, Homo sapiens
  misc_feature: GYAE6OF01BTD8J.49.40.D07.1.454.CMB.1.raw
  modified_base (360)..(360): a, c, t, g, unknown or other
  misc_feature (360)..(360): n is a, c, g, or t
  modified_base (506)..(506): a, c, t, g, unknown or other
  misc_feature (506)..(506): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggactccctgagcgattctctggctccgacgtcggggaacngggccactctgaccatcatcgagggcccagggcgacgatgaggctgactattactgtcaggtcgaagacgaccaacttgtacatagttcggacggagggacctaaattgacccgtctgggtcacgcccaggcctcgcccctggtcnctctcgttcccgccctcctctctctcgtc

SEQ ID NO: 108110 - DNA, 881 bp, Homo sapiens
  misc_feature: GYAE6OF01CSY8O.49.40.D07.1.454.CMB.1.raw
  modified_base (224)..(224): a, c, t, g, unknown or other
  misc_feature (224)..(224): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagccctccttgctcactttacaggttatgtggcctcctacgaagtgattcagcccacgttccgtctcagtcggccctgggacagacggccactaattacctgngacggcgaagaacaatacgaaaataagaatattcactggtatacaaacaaaacgcctaggccacggtcccttaggttttcggtcctttatacgagtacttcaacgtccggcccgcgtgggactcccgtagacgtcgtacttctacgtcggacccgtacccggaacgggtaccggggaaacgacggggacccctacgtaccgacgtaaccacttaccgaacgttccggaaccgggacccggacggggaccgaacggtagtaggacgggtacgtacgtaaccgtttaacgttaccggtacggtaccggtaacggggttaaccggaaaaccgggtaacccggtaaaccccgttaaaaccgttttcgttaaccctaagtttaaaccgggtttcccgggggaaccggggtaaaccggggtaaaaccccttaaagggtttacccgggtaaccccgggtttacccgggtacggggttacccgaaccgggtacccccggaaaaccgggggttccccttaccccccgggtaccccccccggtttccggggttaaccccctcccggtttaccccccggttttcccccgttacccccccccgttaacccccccgtttcccccgttacccccctttaccccgttaccccggttacccgtttaccccggg

SEQ ID NO: 108111 - DNA, 615 bp, Homo sapiens
  misc_feature: GYAE6OF01CZJ0B.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgaagaacaatcgaaaataagaatattcactggtaatcaaacaaaagcctggccaggccccttgttttggtcctttatcgagactttcaatcggcccgctgggatccctgacgcgacttctctggctccacgtcggggaacacgggccactctgaccatcatcgagggcccagggccgacgatggaggctacgacttacttactgtcagggtcgaacgaccgaccaaactttcgctacttagttcgggacggaggtaacctaaattcggacccgttccgtgggtaccacgacccgaacggcctccggtccccccgtggtaccctaccgttcccgttcccggtttcccccgtcccccttcccgtaccctttcccgtccgttcccggtacccg

SEQ ID NO: 108112 - DNA, 626 bp, Homo sapiens
  misc_feature: GYAE6OF01DCMJM.49.40.D07.1.454.CMB.1.raw
  modified_base (589)..(589): a, c, t, g, unknown or other
  misc_feature (589)..(589): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctccttgctcactttacaggttatgtggcctcctacgaagtgattcagccacgttccgtctcagtggccctgggacagacggccacaattacctgtgacggcgaagaacaatcgaaaataagaatattcactggtatcaaacaaaagcctggccaggcccctgttttggtcctttatcgagacttcaatcggcccgctgggactccctgagcgattctctggcctccacggtcggggaacaggggccctactctcgaccatcatcgagggcccagggcgacgatggacgtctgacttatactgcgaggtacgaagaccgacctaaacttgactaagtagttccgggagggacgggtaacctaaagtttcggaccccgttccgttgggggaccacggacccccgaaacggtccgtacccggtcccccccgttcggtcctacccttaccgttccggtttaccccccnccccctttacccgtcctttaccctccgtccgtacccg

SEQ ID NO: 108113 - DNA, 715 bp, Homo sapiens
  misc_feature: GYAE6OF01CJZXC.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattcctgtgacggcgagaacaatacgaaaataagaatatcactggtatacaaacaaagcctggccacggtcccttgttttcggtcctttatcgagtacttcaatccggcccgcgtgggactcccgtgacgcgtattctcgtcggcctaccgacgggtaccgggggaaacgcgggaccctacgtcgtacgactactacacgtacggacccggaccgggacgggacgaacggtagtacggtacggtactacgtaacttaattaccggtagtacggtaacggtaacggaacgtaacccgtaaccgttaacgtttcgtaacttaacggttacggtaccggggaacgggaacggtaaacctaggttacccggtacccgttcgggtacggtaccgaaccggaccggtaaccgggtccgtaccccggttccccggtacgtaccctaccgtttcccgttaccccgttacccccctaccttaccccttcccgttaccttccggtacccgttacg

SEQ ID NO: 108114 - DNA, 559 bp, Homo sapiens
  misc_feature: GYAE6OF01BQUJ5.49.40.D07.1.454.CMB.1.raw
  modified_base (528)..(528): a, c, t, g, unknown or other
  misc_feature (528)..(528): n is a, c, g, or t
  modified_base (548)..(548): a, c, t, g, unknown or other
  misc_feature (548)..(548): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccctgttttggtcctttatcgagacttcaatcggcccgctgggactccctgcgcgtattctctggcctccgacggtcggggaacacgggccactctcgaccatcatcgacgggcccagggcgacgatgaggctagacttattactgtacgaggtcgaaagccgtacctaaacgttcgtacagtacgttcgggacgggacggaacctaaagttcgaccgtcgtagggtccagcccaggctcgcccctggtcnctctcgtccccgccttcctntcctcgtcgtc

SEQ ID NO: 108115 - DNA, 696 bp, Homo sapiens
  misc_feature: GYAE6OF01BZX22.49.40.D07.1.454.CMB.1.raw
  modified_base (220)..(220): a, c, t, g, unknown or other
  misc_feature (220)..(220): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctaacgaagtgattcagccacgttccgtctcagtcggccctgggacagacggccaacaattaccngtgacggcaagaacaatcgaaaatagaatatcactgtatcaaacaaaagcctggccaggtccccttgttttcggtcctttatcgagtacttcaacttccggcccgtcgtcgggtactcccgtaggacgcgtactttcctcgtcggcctccgacggtaccgggggaaacacggggcccacgtccgtacgacccatacacgtccgaacgggcccgaggggccgaaggtacgtaggacggtctagtaacttattaccgtggtaccgagggtaccggaaacggcctaacccgtaaacgtttcgactaagttacgttcgggacgggtaacgggtaacctaaagttcggaacccgttccgtagggtaccaccggtaccccgaacgggtcccgtaccggtccccccgtacggtacccttcccgtccctttcccggttcccccctaccccgttcccttcccttcccgttccccgtcccgtaccg

SEQ ID NO: 108116 - DNA, 733 bp, Homo sapiens
  misc_feature: GYAE6OF01BW4K2.49.40.D07.1.454.CMB.1.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (323)..(323): a, c, t, g, unknown or other
  misc_feature (323)..(323): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggcacaattaccngtgacggtnagaacatacgaaatagaatattcatgtatacaaacaaaagcctggaccacggcccttgttttcggtcctttatcgtagacttcaactccggacccgtntcgggactccctggacgcgtattcctcgtcggtcctaccgtaccggtacgggggaaaccacgggggaccctaaccgtccgtacgaccctaatccgtaacgtccgaaaccggggccccgaagggggccgaaccggtaacgtacgggaacgggtccttacggtaactaacgtttaacgttcggttacgaacgggttacgaaagacccgaaccgtaaacgtttcgtactaagttacgttccggggacgggtaacgggtacctaaagttcggtacccgttcggtacgggtaccaccggacccgtaacgggccctcccggccccccgttcgggtaccctacccgttccggttaccccgtttccccccgtaaccccgtttcccttaccctttcccgttccgttccccggtaacccg

SEQ ID NO: 108117 - DNA, 682 bp, Homo sapiens
  misc_feature: GYAE6OF01CWE3M.49.40.D07.1.454.CMB.1.raw
  modified_base (397)..(397): a, c, t, g, unknown or other
  misc_feature (397)..(397): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctcttgctcactttacaggttatgtggcctcctacgaagtgattcagccctacgttccgtctcgagtcggccctgggacaggacggccactaattcctgtgacggcgaagaacaatacgaaaatagaattatcacgtggtaatacaaacaaagcctggccacggtcccttggttttcggtcctttagcgtaagtactttacaagtccgggccctcgtcggggactcccgtggacgtcgtacttcgtcgtcggtctccgacggtacggggaacncgggccacgtctacgacctatcatcggacggccgagggcgacgagtggacggctagacttacgttacgcggtacgacggggtacgaaacgaccgtacctaaacgtttcgtaaccgtagttacggttaccggggacgggaacggtaaccgtaaagttccggaaccggttccggtagggtacccgacggtaccccggaacggtcccgttacccggccccccgttgggtaccctaccgttcccgtacccggttccccgtccccttctcccgttctcccgtcgtacccg

SEQ ID NO: 108118 - DNA, 706 bp, Homo sapiens
  misc_feature: GYAE6OF01E2G6F.49.40.D07.1.454.CMB.1.raw
  modified_base (439)..(439): a, c, t, g, unknown or other
  misc_feature (439)..(439): n is a, c, g, or t
tcagagtcgagagacacgaccggtgctcgatttagtgatagagcgtaacaacaggaggggctgggcctcaggaagcagcagtcgggggtgccgcagccatggcctggaccgctcctccttctgacgcccttccttgcctctacttttacaggtttatgtcggcctcctaagaagtgattcagccctacgttccgtctcaggtcggcccgtgggacacggaccggccaactaatttccgtggtacgacggcgaagaaacaagtacgaaaataagaattattcagttgtatacaaacaaacgcctcggccgacggtcccttgttttcgtcctttagtacgacgtacttacgaacgtccgggacccgtcgtacggggtacctcccgtagacgtccgttactttccttccggtcggtcctaccggaccgggtaccggggaacncggggccctacgttccacgaccatccagtccggacgggtcccgagggccgagacgtggacggtctagtaacttagttacgtggtaccgtaagggtaccgaaaggaacctacccgtaaacgtttcgtaactagttacggtcgggaacgggtaacggaactaaagttcggacccgttcggtcggtccacggaccgtacggccgtcccgtccccgtaggtccctactccgttcccttcccctaccttccctacctcctccgtcgtacccg

SEQ ID NO: 108119 - DNA, 696 bp, Homo sapiens
  misc_feature: GYAE6OF01B79VQ.49.40.D07.1.454.CMB.1.raw
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
  modified_base (269)..(269): a, c, t, g, unknown or other
  misc_feature (269)..(269): n is a, c, g, or t
  modified_base (301)..(301): a, c, t, g, unknown or other
  misc_feature (301)..(301): n is a, c, g, or t
tcagagtcgagagacacgaccggtgctcgatttagtgatagagcgtaacaacaggaggggctgggcctcaggaagcagcagtcgggggtgccgcagccagtggcctgggaccgctctccttctgagcctcttgctcactttacaggttatgtggcctcctacgaagtgattcagcctacgttccgtctcaggtcgcccgtgggacacggacgccaanaattacctgngacggcaagaacaatcgaaaatagaatattcactgtatcaanaaaagctggacagccctagttttgtcctttancgatacgttcaatccggccgtctgggactcccgtgagtcgtagtttcctcgtcggtctccgtaacggtaccgggggaaacacggggaccacgtctcgaacccatcatacgacgggacccagggaccgacgatggacggtctaggaacttaacttacgtcgttacgaacggtacgaaagtaccgtaaccaaacgtttgactaagtacgttccgggacgggaacgggtaaacctaaagttccggacccgttcggtacgggtaccgtaaggaccccgaacgggccgttaccggcccccccgttagggttacctaaccccgtttcccgggtttccccttacccccccggtaccccctttcccggtacccttttaccccgttccgtacccggttaacccg

SEQ ID NO: 108120 - DNA, 645 bp, Homo sapiens
  misc_feature: GYAE6OF01BO05G.49.40.D07.1.454.CMB.1.raw
  modified_base (220)..(220): a, c, t, g, unknown or other
  misc_feature (220)..(220): n is a, c, g, or t
  modified_base (338)..(338): a, c, t, g, unknown or other
  misc_feature (338)..(338): n is a, c, g, or t
  modified_base (382)..(382): a, c, t, g, unknown or other
  misc_feature (382)..(382): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctccttgctcactttacaggttatgtggcctcctacgaagtgattcagccacgttccgtctcagtcggccctgggacagacggccactaattaccngtgacggcgagaacaatcgaaaataagaatattcactgtatcaaacaaaagctggccaggcccttgtttggtcctttatcgagacttcaactccggcccgctgggactcccgtgacgngtacttctcgtcgtctccgacggtcggggaacacgggccactcngaccatcactcgacgggcccagggaccgtacgagtggacgactaggacttaatacgtcgtagacgggtacgaacggaccgtacctaaaccgttgtactaatacgttccgggaacggtacgggtaaacctaagttaccggacccgttcggtcgggtaccgaccgacccgaacggtccgtacccggtcccccgtggtacccacccgttcccgttacccgttccccccctaccccttacttcccttcccgttcccgtccttcccgg

SEQ ID NO: 108121 - DNA, 938 bp, Homo sapiens
  misc_feature: GYAE6OF01CBESB.49.40.D07.1.454.CMB.1.raw
  modified_base (88)..(88): a, c, t, g, unknown or other
  misc_feature (88)..(88): n is a, c, g, or t
  modified_base (119)..(119): a, c, t, g, unknown or other
  misc_feature (119)..(119): n is a, c, g, or t
tcagagtcgagagacacgaccggtgctcgatttagtgatagagcgtaacaacagaggggctgggcctcaggaagcagcatcgggggtnccgcagccatggcctggaccgctctccttcngacgcctctgctctactttacaggttatgtcggcctcctaacgaagtgtattcagccctacgtttccgtctcaggtcggcccgtgggacaggaccggcccaactaactttacccgtggtacggaaccgggcgaaagaaacctaaagtaccggaaaaattaagaatttacttaccaacgttggttaactaccaaaaccgaaaaacgtcccgtacgggaccctaacgggtccccctttggttttttaccggttaccctttttaacgtaccggaacgtacctttaccgaaacgttcccgggccccgtcggttacggggtaccttccccggtaggacggtcggtaactttccgtcgttcgggtcccttaccccgtaacgttccggtaccgggggaaacccccgtcccctaacccgttacggaaccctacgtaccggaaccgggtccccggggtaacggaaacggggtaaccgggggtacgttacggggaaccgggtaccccgtaaacgtttaacgtttaccgttcgggttaccggtaaggggtttcgggttaggggtaacgttagggttcggggttaaggttcggggtttacggttccggtttccggttacggggacggtccgggttaccgggggtaacccggtacggggttaccccgtacccgggtttacccgttacggggtacccaaccgggaccccgtaaaccgggaccccctaaaacccccgtcgttaccggtaccctacccgtttcccgttcccgtttacccccctacccccgtttcccttcccttacccttcccgttaccgtccgttccggtacggg

SEQ ID NO: 108122 - DNA, 636 bp, Homo sapiens
  misc_feature: GYAE6OF01A82XM.49.40.D07.1.454.CMB.1.raw
  modified_base (335)..(335): a, c, t, g, unknown or other
  misc_feature (335)..(335): n is a, c, g, or t
  modified_base (384)..(384): a, c, t, g, unknown or other
  misc_feature (384)..(384): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctccttgctcactttacaggttatgtggcctcctacgaagtgattcagccacgttccgtctcagtcggccctgggacaggaccggccaacaattacctgtgacgggcgaagaaacaatacgaaaataagaatattcactggtatacaaacaaaagcctggccaggtcccttgttttcggtcctttatcgagtacttcaacgtccggcccgngtgggactcccgtgacgcgtacttctctggcctccgacggtcgggaacngggcccacgtctacgacctatcacgtcgacgggcccgagggacgacgagtggacgctagacttagtactgtacgacggtagaacgtacgtaccaaacgtttgtactaagtcggttccggacgggacggtaacccgtaaagttccggaacccgttccggtcggtaccgacggacccgacggtccctcccggccccccgtaggtcctaccgtccttccgtccccctaccctcccttcctccctcccgtcgtacc

SEQ ID NO: 108123 - DNA, 606 bp, Homo sapiens
  misc_feature: GYAE6OF01AJ3DB.49.40.D07.1.454.CMB.1.raw
  modified_base (318)..(318): a, c, t, g, unknown or other
  misc_feature (318)..(318): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattcctgtgacggcgagaacaatcgaaataagatattcatgtatcaacaaaagcctgccaggcccctgttttggtcctttatcgagacctttcaaactccggacccgngtcggggactcccgtgagcgattctctgctccacggtacggggaacacggggccactctcgaccatcagtcgacgggcccgagggcgacgagtggaggctgactattacgtgtcgaggtcgaagaccgacctaacttgctatacgttcgggacggtacgggtaacctaagttcggaccgttccgtcgggtaccacgacccgtaacggcctccggccccccgttggtaccctccgttcccgttcccgtttacccccacccttcccttcttcccttccgtccgttacccg

SEQ ID NO: 108124 - DNA, 543 bp, Homo sapiens
  misc_feature: GYAE6OF01C7PEG.49.40.D07.1.454.CMB.1.raw
  modified_base (263)..(263): a, c, t, g, unknown or other
  misc_feature (263)..(263): n is a, c, g, or t
  modified_base (338)..(338): a, c, t, g, unknown or other
  misc_feature (338)..(338): n is a, c, g, or t
  modified_base (376)..(376): a, c, t, g, unknown or other
  misc_feature (376)..(376): n is a, c, g, or t
  modified_base (532)..(532): a, c, t, g, unknown or other
  misc_feature (532)..(532): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaaanaaaagcctggccaggccctgtttggtcctttatcgagtacttcaatccggccgctgggactccctgagcgattcnctggctccacggtcggggaacagggccactctgaccancatcagggcccagggcgacgatgaggctgactattactgtacagtcgaagaccgaccaaattgacattagtcggacggagggaacctaaattcggaccgttcctgggtcacggacccaaggctcgccccctggcctactctcgtcccaccctcctntcctctcgtac

SEQ ID NO: 108125 - DNA, 755 bp, Homo sapiens
  misc_feature: GYAE6OF01E5BF0.49.40.D07.1.454.CMB.1.raw
  modified_base (393)..(393): a, c, t, g, unknown or other
  misc_feature (393)..(393): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctccttgctcactttacaggttatgtggcctcctacgaagtgattcagccacgttccgtctcagtcggccctggggaccaggaccggcccaacaaatttacccgtggtcggaaccggccgaagaaaccaaataccgaaaattaagaattacttcacttggtactacaaaacaaaacgcctggcccgacggtcccttgttttggtccctttagtcgagtacctttacaactccggcccgcgtgggacttcccgtggagtcgtactttccncgttcgggccttaccccggaacggtaccgggggaaaccgacgggggcccctaaccgttcccgttaggaacccctagttaccgaacgtcccggaacgggggaccccgaagggggacccgaacggtacgtaggacgggtctacgggtaactttaacgttacgtaggtaccgaacgggttacgaaacgtaccgaacccgtaagttcgtaactagtacggttccgggacggaacggtaacctaaacgttcgaccggtcgtacggtaccgaccgacccgacggacctcccggtccccccgttggtaccctacccgttccgttcccgttaccccccgtacccttcccctacttccctccgtccgtacg

SEQ ID NO: 108126 - DNA, 815 bp, Homo sapiens
  misc_feature: GYAE6OF01DSS3U.49.40.D07.1.454.CMB.1.raw
  modified_base (89)..(89): a, c, t, g, unknown or other
  misc_feature (89)..(89): n is a, c, g, or t
tcagagtcgagagacacgaccggtgctcgatttagtgatagagcgtaacaacagaggggctgggcctcaggaagcagcagtcgggggtnccgcagccatggcctggaccgctctccttctgacgcctcttgctctactttacaggttatgtcggcctcctacgaagtgattcagcctacgttccgtctcaggtcggcccgtagggacaggaccggccaactaacttaccgtggtacggacggacgaagaaactaagtaacgaaaataaaggaattattacgacgttaggtaactacgaaaacgaaaacgccgtaggaccgtaccgggtccctttaggttttccggttcctttagtacgtaacgtacctttaccgaacgttcccggccccgtcggttcggtaacctcccgtaggtacgtcttacgttttcctacgttccggtccttaccggaacgggtacgggaaaccgtcgggacccacgttccacgtacccagtaccagtaccggcccgggtaccggacgggaccggtagacggtacggacggttacgtacgttaacttacgtttaccgtcgttaacgggtacggttaacggaaaccggtaccggtaaaccttaacgtttacgtaacttacgttaacggttaccggggtaacgggtaaccgggtaaacccgttaacgttacccgggtaaccgttaccgggtacggtaccgtaccgaacccggtaaccgtccgtaccccggtccccgtacggttaccctccgttccgttaccccttccccgtaccccttcctaccgttcccttccgccgttcccg

SEQ ID NO: 108127 - DNA, 651 bp, Homo sapiens
  misc_feature: GYAE6OF01CC5TC.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaatagaatattcactggtatcaaacaaagcctggccaggccctgttttggtcctttatcgagacttcaattcggcccgctgggactcccgtgagcgtattctcgtcggcctccgacggtaccgggggaacacggggccctacgtccgtcgaaccctactcaacgtccggacggggaccccgaggggccgaacgagtcgggaggccgtagtaaccttaagttaccgtggtacgtagggtaccggaacggaccgaaccctaaacgtttcgtactacgttacgttcgggacgggtaacgggaacctaagttccgacccgttcgtggtccgacgacccgagccgtacccgtccccgtcggtcctacgttccgttacccgttcccccaccccttcccttccttccttccgtcgtacccg

SEQ ID NO: 108128 - DNA, 654 bp, Homo sapiens
  misc_feature: GYAE6OF01A4QKE.49.40.D07.1.454.CMB.1.raw
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaaataagaatattcactggtatcaaacaaaagcctggccaggccccttgttttcggtcctttatcgagtacttcaagtccggcccgcgtgggactccctgacgcgtattcctctggcctccgacggtccggggaacnggggccacgtcngaccatcacgtcgacggggccccagggccacgagtgaggctagacttagttacgtgtcgaggtacgaacgaccgtacctaaagttcgtacaagttgttaccgggacgggtaacgggaacctaaagtttccggaacccggttacgttaggggtacccaacggaccccgtaaagggtccctacccgggtccccccgttggtaccctaccgttccccgttcccgttccccccggtccccttcccctccctttccctacccgtccgtacccg

SEQ ID NO: 108129 - DNA, 548 bp, Homo sapiens
  misc_feature: GYAE6OF01EPYX1.49.40.D07.1.454.CMB.1.raw
  modified_base (342)..(342): a, c, t, g, unknown or other
  misc_feature (342)..(342): n is a, c, g, or t
  modified_base (419)..(419): a, c, t, g, unknown or other
  misc_feature (419)..(419): n is a, c, g, or t
  modified_base (491)..(491): a, c, t, g, unknown or other
  misc_feature (491)..(491): n is a, c, g, or t
  modified_base (534)..(534): a, c, t, g, unknown or other
  misc_feature (534)..(534): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccaacaattacctgtgacggcgagacaaatcgaaaataagaatattcactggtatacaacaaaagcctggccacggccctgttttggttccttatcgagtactcaatcggcccgcgtggatcccctgagcggattcnctggctccacgtcggggaacaggggccactctgaccatcatcagggcccagggcgacggatgaggctgactattacngtcagggtcgaagacgccaaaacttgtacatattcggacgggagggaccaaagttcgaccgtacgtgggtcngcccgaagctcgcccctggcctcctctcgttccccaccttccncctcctcctcgtac

SEQ ID NO: 108130 - DNA, 633 bp, Homo sapiens
  misc_feature: GYAE6OF01DIQ0Y.49.40.D07.1.454.CMB.1.raw
  modified_base (373)..(373): a, c, t, g, unknown or other
  misc_feature (373)..(373): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagaccggccacaattacctgtgacggcgaagaacaatcgaaaataagaatattcactggtatcaaacaaaagcctaggccaggtccccttgttttcggtcctttatcgagtacctttcaatccggcccgctgggactccctgagcgattctctggctccgacggtcggggaacngggccactctgaccatcatcgagggcccagggcgacgatggagctagacttattactgtcgagggtcgaacgaccgacctaacttgtactaattacgttcgggacgggtaacgggaacctaaagttcgaacccgttcgtcgggtaccaaccggcccgaaacggtccgtacccggccccccgttgggttaccctaccgttcccttccgtttaccccccgtacccctttccccttaccttcccctccgttcccggtaacccg

SEQ ID NO: 108131 - DNA, 641 bp, Homo sapiens
  misc_feature: GYAE6OF01D7M05.49.40.D07.1.454.CMB.1.raw
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
tcagagtcgagagacacgaccggtgctcgatttagtgatagagcgtaacaacagaggggctgggcctcaggaagcagcagtcggggggtgccgcagccatggcctggaccgctctccttctgagcctccttgctcactttacaggttatgtggcctcctacgaagtgattcagccacgttccgctcagtcggccctggggaccaggaccggccaacaaatttacctggtcgacggcgaagaaacaatcgaaaataagaattattcaactggtaatacaaacaaaagcctaggccaggcccttgtttcggtcctttancgagacttnaactcggcccgngtgggactccctggacgcgtacttcctctggcctccgacggtacggggaacacgggccaactcgtagaccacgtcactcgacgggcccagggcgacgagtgacggcttggaaccttagttactgtacgtagggtacgaaagaccgacctaaacgtttgacagtacgttcgggacggaacggacctaaagttcggaccgtccgtacgggtacacggcccgaaacggtcctccgcccccgttagtcctaccgttccgtacccgttccccctaacccttccctaccgttcccttccgtccgtaccg

SEQ ID NO: 108132 - DNA, 587 bp, Homo sapiens
  misc_feature: GYAE6OF01BI75G.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccctgttttcggtcctttatcgagacttcaatccggcccgctgggatcccgtgacgcgattctctggctccgacggtcggggaacacgggccactctcgaccatcatcgacgggcccagggccgagatggagctgactattactgtcaggtcgaagacgacctaaacttcgtacaattagtcggacgggacggaacctaaagttcgaccgtccgtggtacacgacccgaggccgtccggcccccgttcggtccctaccgttccgttaccgttcccctaccccttaccctccttccttccgtcccgtaccg

SEQ ID NO: 108133 - DNA, 630 bp, Homo sapiens
  misc_feature: GYAE6OF01CDXH6.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccaacaattacctgtgacggcgaagaacaatacgaaaataagaatattcactggtatacaaacaaaagcctggccaggtcccttggttttcggtcctttatcgagtacctttcaacgtccggcccgtcgtgggactcccgtgacgcgtattctcgtggcctaccgacggtacggggaacacgggccactctcgacctatcatccgacgggcccgagggccgacgagtggaggctagacttattacgtgtacgaggtacgaacgaccacctaacttgtactaacttacgttcgggacgggtaacggaacctaagttcgaccgttcgtacgggtcaacggtacccgaacggtccgtcccggtcccccgtggtaccctaccgttccgttcccgttcccccgtcccttccctcttccctcgtcgtaccg

SEQ ID NO: 108134 - DNA, 673 bp, Homo sapiens
  misc_feature: GYAE6OF01EBWUL.49.40.D07.1.454.CMB.1.raw
  modified_base (89)..(89): a, c, t, g, unknown or other
  misc_feature (89)..(89): n is a, c, g, or t
  modified_base (120)..(120): a, c, t, g, unknown or other
  misc_feature (120)..(120): n is a, c, g, or t
  modified_base (304)..(304): a, c, t, g, unknown or other
  misc_feature (304)..(304): n is a, c, g, or t
tcagagtcgagagacacgaccggtgctcgatttagtgatagagcgtaacaacagaggggctgggcctcaggaagcagcatcggggggtnccgcagccatggcctggaccgctctccttcngagcctcttgctcactttacaggttatgtcggccctcctacgaagtgattcagccacgttccgtctcagtcggccctgggacaggaccgccactaattacctggtcgacggcgaagaacatacgaaatagaatatcatgtatacaacaaagcctggccaggtcccttgtttcgtccttatcganactcaagtccggccgtgtcgggactccgtgacgcgtattctcgtggcctccgacggtacggggaacacgggccctactcgtacgaccatcagtccgacgggtcccgagggcgacgagtcggaaggtctagtaacttattcgtacgacggacgtacggaaacgtaccgtacttaacgttcggtactagttacggttacgggggaaccgggtaaacggaacctaaggttccggtaacccggttcggtacgggtaccaccggtaacccgtaacgggcccttacccggccccccgttaggtaccttaccgttcccgtttcccggttacccccgtcccctttacccgtccctttacccgtcgttccggtacccg

SEQ ID NO: 108135 - DNA, 559 bp, Homo sapiens
  misc_feature: GYAE6OF01AF7SA.49.40.D07.1.454.CMB.1.raw
  modified_base (315)..(315): a, c, t, g, unknown or other
  misc_feature (315)..(315): n is a, c, g, or t
  modified_base (417)..(417): a, c, t, g, unknown or other
  misc_feature (417)..(417): n is a, c, g, or t
  modified_base (546)..(546): a, c, t, g, unknown or other
  misc_feature (546)..(546): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgctcagtggccctgggacagacgccacaattacctgtgacggcgagaacaatcgaaaataagaatattcatggtatcaacaaaagcctggccaggcccctgttttggtcctttatcgagacttcaatcggcccgntgggatccctgagcgattctctgctccacggtcggggaacacggggccactctcgacctactcactcgagggccccagggcgacgatgagctgactattacngtacgaggtcgaagaccgtacctaaacttgtacatacgttcgggacggagggacctaaagttcgacccgtcgtgggcacggcccaaggcctaccgcccccttggccactcctcgttccccaccctcctntccctctcgtacc

SEQ ID NO: 108136 - DNA, 748 bp, Homo sapiens
  misc_feature: GYAE6OF01CU5M1.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacaggttatgtggcctcctacgaagtgattcagccacgttccgtctcagtcggccctgggacagacggccacaattcctgtgacggcgaagaacaatacgaaataagaatattcactgtatacaaacaaaagcctggccaggccccttgttttcggtcctttatcgagtacctttcaatcggcccgcgtgggactcccgtgagcgtattcctcgtggcctccgacggtacggggaaaccaggggtcccactctcggacctagtccacgtcgacggggccccgaagggggccgaaccggtagtcgggacgggcctaggtaaccttacgtttacgtcggtactacgggtaccggaaacggaccgtaaccctaaacgtttcggtaacctaagttacgtttaccgggggacgggtaacgggggtaaacccctaaaggtttccgggaaccccggtttccggttacggggttaccacccgggtacccccgaaaggggtcccttaccccgggtaccccccccggttgggttaccccctaccgtttccccggttacccgtttcccccccgttcccccgttccccttacccgttcccccgttcgttcccccgggtacccg

SEQ ID NO: 108137 - DNA, 559 bp, Homo sapiens
  misc_feature: GYAE6OF01E239M.49.40.D07.1.454.CMB.1.raw
  modified_base (538)..(538): a, c, t, g, unknown or other
  misc_feature (538)..(538): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgaagaacaatcgaaatagaatatcactgtatcaacaaaagcctggccaggcccctgttttggtcctttatcgagacttcaatcggcccgctgggatccccgtgacgcgattcctcgtcggctccgacgtcggggaacacggggccactctcgaccatcatcgacgggcccagggcgacgatggagctgactatacgtgtcaggtcgaagacgacctaaattcgactatacgttccgggacggacgggaacctaaagttcgacccgtcgtcgggtcacgcccaaggcctcgccccgtgcctctcgtctaccccnccctcctcctctccgtcgtcg

SEQ ID NO: 108138 - DNA, 655 bp, Homo sapiens
  misc_feature: GYAE6OF01AG67F.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacaggacggccacaattacctgtgacggcgagaacaatcgaaataagaatattcactggtatacaaacaaaagcctaggcccaggtccccttggttttcggtcctttatcgagtaccttcaatccggcccgcgtggggactccccgtggacgccgtattcctcgtcggcctccgaccggtcggggaacacgggcctactctacgaccatcagtcgacgggcccgagggaccgacgagtggacggtctagtacttagttactggtacgacgggtacggaacgaacccgtacctaaacgtttcgtactaagttacggttaccgggacgggtaacggggaacctaaaggttccggaacccgttcggtacgggtaccacgaccccgaaggtcccgccggtcccccgtggtaccctcctccgttcccgttccccacccccttcctcccttctccgtccgtccg

SEQ ID NO: 108139 - DNA, 718 bp, Homo sapiens
  misc_feature: GYAE6OF01BHBJP.49.40.D07.1.454.CMB.1.raw
  modified_base (229)..(229): a, c, t, g, unknown or other
  misc_feature (229)..(229): n is a, c, g, or t
  modified_base (707)..(707): a, c, t, g, unknown or other
  misc_feature (707)..(707): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctccttgctcactttacaggttatgtggcctcctacgaagtgattcagccacgttccgtctcagtcggccctgggacacgacggccaacaattacctgtgacggngaagaacaatacgaaaatagaatattcactgtatacaaacaaagcctggccacggtcccttggttttcggtaccctttagtcgtagtacctttacgaacgttccgggaccccgtgtacggggtaccttcccgtagtacgccgtatttccgtcgtcgggccttaccggaccggttacggggaaacgcggggtaccctaaccgttccgtacggaacctaacttccgaagttccgaaaccgggggccccgaagggggtaccgaaccggtaagttgggaacggtccgttagtaacttaaccgttacggttcgtaccggtacgggttaacggaacggtaaccgtaacctaacgttacgtataaccgttagtccgggacgtaacgggtaacctaaagttcggaccgttccgtgggtacaacggcctaaggcccgtccgccctacggtcctacgttccttacccgtcccctaccctccttctccngttccgtaccg

SEQ ID NO: 108140 - DNA, 660 bp, Homo sapiens
  misc_feature: GYAE6OF01BDVVK.49.40.D07.1.454.CMB.1.raw
tcagagtcgagagacacgaccggtgctcgatttagtgatagagcgtaacaacagaggggctgggcctcaggaagcagcagtcgggggtgccgcagccatggcctggaccgctctccttctgagcctcttgctcactttacaggttatgtggcctcctacgaagtgattcagccacgttccgtctcagtcggccctgggacagacggccacaattacctgtgacggcgaagaacaatcgaaaataagaatattcactggtactacaaacaaagcctaggaccacggtcccttggttttcggtcctttagtcgaagtacttacaacgtccggccgcgtagggactcccgtagacgtcgtattctcgtggcctaccgacggtacggggaacacgggccactctcgaacctatacactcgacgggcccaggggccgagagtggacggtctagaacttagttacgtgtacgaacgggtacgaacgaccgtacctaaagttctactagttacgtccgggacgggaacggtaacctaagttccggtacccgtaccgtgggtaccacggacccgaacggcccgtacccggcccccgttaggtccctaccgttcccgttacccgttcccccctaacccttccctacccttccgttcccgtccgtacccg

SEQ ID NO: 108141 - DNA, 752 bp, Homo sapiens
  misc_feature: GYAE6OF01CXOSV.49.40.D07.1.454.CMB.1.raw
  modified_base (224)..(224): a, c, t, g, unknown or other
  misc_feature (224)..(224): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgacgcctccttgctcactttacaggttatgtggcctcctacgaagtgattcagccctacgttccgtctcgaggtcggccctgggacagaccggccacaattaccngtgacggcgaagaacaatacgaaaataagtaatatcacgtaggtaatacaaacaaaacgcctcggccacggtcccttgttttcggtacctttatcgagtacttacaagtccggcccgtgtacgggtactcccgtggtacgccgttacttccgtcgtcggtcccttacccggacgggttacggggaaaccgtaccggggacccctacgttaccgtacgaaccctaactacccgtaacgtccggaaccggggtccccgaaggggccgaaacggtagtacgggacgtcgtacgtaactttacgttacgtcgtacgacggtacgaacgaccgtacctaaacgttgactagttacgtccgggaacggtaacggtaactacgttaccggtaccgttacggtacggtaccaccgggtacccgtaagggtcccctacccggtcccccgttcggttacccgtccgtttacccccgtttacccggttccccccttaccccgttaccccgttccctttccgtccccgttcgtaaccccg

SEQ ID NO: 108142 - DNA, 811 bp, Homo sapiens
  misc_feature: GYAE6OF01BVLXY.49.40.D07.1.454.CMB.1.raw
  modified_base (225)..(225): a, c, t, g, unknown or other
  misc_feature (225)..(225): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacaggttatgtggccctcctacgaagtgattcagccacgttccgtctcagtggccctgggacagacggccacaattacctgtgacggnagaacatcgaaataagatattcactgtatacaacaaagcctggccacggccccttggttttcggtacctttagtcgtacgtactttacaacgttccgggaccccgtggttacggggaccttcccgtaggacgacggtactttccgtcgttcgggcccttacccggacgggttaccgggggaaacctacgggggtcccctaacgttcccgtacggaaccctaacttcccgaacgttccggaacggggacccccggaaggggggtacccggaacggtaggttacgggaacggggtcccttaacgggtaacctttaacgtttaccggtagtacccggtaaggggtaaccggaaacggtacccgaacccgttaaactttcggtaaccgtaattacgggttccgggggacgggtaaacgggtaaccctaaagtttccggaacccggttccgggtacgggtacccaaccgggtccccgaaagggtcccttaccccgggtccccccggttacgggttcccaacccggtttccccgttacccgtttccccccaacccccgtttccctaccttaccccgttcctcccggttaccg

SEQ ID NO: 108143 - DNA, 617 bp, Homo sapiens
  misc_feature: GYAE6OF01A6CT7.49.40.D07.1.454.CMB.1.raw
  modified_base (354)..(354): a, c, t, g, unknown or other
  misc_feature (354)..(354): n is a, c, g, or t
  modified_base (574)..(574): a, c, t, g, unknown or other
  misc_feature (574)..(574): n is a, c, g, or t
tcagagtcgagagacacgaccggtgctcgatttagtgatagagcgtaacaacagagggggctgggcctcaggaagcagcatcggggggtgccgcagccatggcctggaccgctctccttctgagcctccttgctcactttacaggttatgtggcctcctacgaagtgattcagccctacgttccgtctcagtggccctggggacaggaccggccaactaattaccctgtcgaaccgggcgaagaaacaatacgaaaataagaatatttccagtggtatacaacaaaagcctggccaggcccttgttttggtcctttatcgagtacttcaacgtcggcccgcgtgggactcccgngagcgtattctctggcctccacggtcggggaacacgggccactctcgaccatcatcgacgggcccaggggcacggtatacggacggctacggtacttagttactggtcagggtacgaaacggaccgtaccaaacgtttcgtacaattacgttcggacgggtacggacctaaagttcgaccgtccgtggacaccgaccgagcctccggtcccctggtaccncttccgtccttaccccgtcccttcctcctcctcgtccgtaccg

SEQ ID NO: 108144 - DNA, 845 bp, Homo sapiens
  misc_feature: GYAE6OF01D5Y5S.49.40.D07.1.454.CMB.1.raw
  modified_base (787)..(787): a, c, t, g, unknown or other
  misc_feature (787)..(787): n is a, c, g, or t
tcagagtcgagagacacgaccggtgctcgatttagtgatagagcgtaacaacaggaggggctgggcctcaggaagcagcagtcgggggtgccgcagccatcggcctggaccgcttcctccttctgacgcctcttgctctactttacaggttatgtcgcctccgtaacgaagtgtattcacgtccgtacgttccgtctcgacggtcggccgtgggacaggaccggtccaactaaacgttaccgtggtacggacggacgaacgaaactaaagtaacgaaaataaagtaacttattacgacgttaggttaactaaccaaaacgtaaaacgccgtacggacccgtaaccggttcccgttttaggtttttacgttaccgtttagtaccggtaacggttaccttaccgtaacggtcccgggtccccgtaggttacgggacctttcccggagtacggtaccgttacgtttccgtcggtccggtaccgttacccgggtaacgggtaaccgggggaaacgaccggggtaccctaccgttacggtaccgtaaacctactaacggtacgtacccggggaacgggtaccccggaaggggtaccgaaccggtacgttacggaaccgggtacttaacgtaacgtttaacgttaacgtcgggaaccggtaagggtaacgaaaccggtacctaacgttaacgtttcgaacgttagtacgggtaccgggtacgtaaccggaactaacgttcggaaccgttcggcggtaaccacggaccgtacgtcccgtacccgtcccgttacnccgttacgttcccgtacccgttcccccgctttccctccttcccttacgtccgtaccgg

SEQ ID NO: 108145 - DNA, 809 bp, Homo sapiens
  misc_feature: GYAE6OF01C5LX6.49.40.D07.1.454.CMB.1.raw
tcagagtcgagagacacgaccggtgctcgatttagtgatagagcgtaacaacagaggggctgggcctcaggaagcagcagtcgggggtgccgcagccatggcctggaccgctctccttctgagcctccttgctcactttacaggttatgtcggcctcctacgaagtgattcagccacgttccgtctcagtcggccctgggacaggaccggccaactaattaccgtggtggacggcgaagaacaatacgaaaataagaatattcactggtaatacaaaacaaaacgccgtcggacccacggtcccctttggtttttcggtacctttagtccggtaagtacctttacgaacgttcccgggccccgtcgtacgggtaccttcccgtaggtacggtcgtaacgtttccgtccgtcgggcctcccggtaacggggtaccggggaaacgtacgggccctacgtctacggaacctatccgacgtacggaaccgggccccggaggggaccgaacgtagtaggaaccgggtctaggtactttaacgttacgtcggtacggtaacgggtacggaaaccgtaccgtaacccgtaaacgttttcggtaactaacgtttacgggtacccggggaacgggtaacgggtaaaccttaacggttccgggtaacccggtttcccggtacgggtacccaaccgggtaccccggaacgggttccctccccggtaccccccgttagggttcccctaccgttccccggtttccccttacccccctaccccgtttccccttacccttcccttaccggttcccgttacccgg

SEQ ID NO: 108146 - DNA, 559 bp, Homo sapiens
  misc_feature: GYAE6OF01E18I3.49.40.D07.1.454.CMB.1.raw
  modified_base (317)..(317): a, c, t, g, unknown or other
  misc_feature (317)..(317): n is a, c, g, or t
  modified_base (555)..(555): a, c, t, g, unknown or other
  misc_feature (555)..(555): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatacgaaataagaatattcactggtatcaacaaaagcctggccaggccctgttttggtcctttatcgagacttcaatcggcccgntgggatcccgtgagcgattctctggcctccgacggtcggggaacagggccactctgaccatcatcgacgggcccgagggcgacgatggagctgacttaattactgtcgagggtacgaaagacgacccaaatttcgtcaattacgttcggacgggaagggactacaaattcgaacccgtccgtagggccaggcccaggcctccgccccgtggtccactctcgtccccgccctcctctcnctcg

SEQ ID NO: 108147 - DNA, 753 bp, Homo sapiens
  misc_feature: GYAE6OF01B3MGU.49.40.D07.1.454.CMB.1.raw
  modified_base (90)..(90): a, c, t, g, unknown or other
  misc_feature (90)..(90): n is a, c, g, or t
  modified_base (230)..(230): a, c, t, g, unknown or other
  misc_feature (230)..(230): n is a, c, g, or t
tcagagtcgagagacacgaccggtgctcgatttagtgatagagcgtaacaacagaggggctgggcctcaggaagcagcagtcggggggtnccgcagccatggcctggaccgctctccttctgagcctcttgctcactttacaggttatgtggcctacctacgaagtgattcagtccacgttccgtctcagtcggcccgtaggggacaggaccggccaactaactttaccnggtacggaacggacgaagaaactaaagtacgaaaaataagaatattccaacgtgtaactacaaacaaaagcctaggaccgacggtacccgttggttttacggtcctttaagtcgacgtacttacgaagtccggccgcgtgggtacttcccgtgacgtctacttctcgtcgtcctccgacggtacggggaacgacgggacctactacgtacggacctatcacgtacggacgggcccgagggaccgacgtagtggaacgttcgtaacgtacttaagttcgtacggtagtaacgggtaccgaaacgtaaccgaaccttaacggttcaacgtaacgtttacgtaccggggaacggtaacgggtaaaccttaaacggttccggtaaccgttccggttacgggacctaaccggacccggtaaggtccccgtccccggtcccccggttacggtacccttacccgttcccggtttcccccgtaccccggttcccctttaccgtcccttccggttacccgttccgtaacccg

SEQ ID NO: 108148 - DNA, 875 bp, Homo sapiens
  misc_feature: GYAE6OF01DO9N8.49.40.D07.1.454.CMB.1.raw
  modified_base (276)..(276): a, c, t, g, unknown or other
  misc_feature (276)..(276): n is a, c, g, or t
tcagagtcgagagacacgaccggtgctcgatttagtgatagagcgtaaacaacagaggggctgggcctcaggaagcagcatcgggggtgccgcagccatggcctggaccgctctccttctgagcctcttgctcactttacaggttatgtggcctcctaacgaagtgattcagcctacgttccgtctcagtcggccctgggacaggacggccactaattacctgtgaccggagaagaacaatacgaaaataagaatattcacgtggtaatacaaaanaaaacgcctggccacggtcccttggttttcggtctttacgcgtaagtaccttacaacgtccgggccgtacgtgggtacctccgtggacgtctacttcctacgtcggtacctaccggtaccggtacggggaaacacggggtaccctaccttacgtacgaaccctaatccgtacgttaccggaaccggggcccgaacgggggaccgtaaccggtaagtcgggtaaacgggtcgttaacggtaactttaacgttaccggttaggttaaccggacggggttaaccggaaaacggtcccgttaaacccgttaaacggttttcgtaacgttaacgggttaccggtttaaccgggggaccggggttaaaccggtaaacccgtttaaaaggtttacccgggtaacccccgggtttacccgggttacgggggtacccgtaaaccccgggtaacccggttaaacccgggtcccggttaccccccggtacccccgggttacccgggtttaacccaccccgttttacccgggttttccccccgtttaacccccccgtaccccgtttttccccctaccccgttttcccggttccccgtaccggttaacccgg

SEQ ID NO: 108149 - DNA, 748 bp, Homo sapiens
  misc_feature: GYAE6OF01CQOOE.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacaggttatgtggcctcctacgaagtgattcagccacgttccgtctcagtggccctgggacaggacggaccacgaacttacctggtcggacggcgaagaacaagtacgaaaataagaatatccactggtactacaaacaaaacgcctaggcccaacgggtcccctttggtttttcggttcctttagtaccgtagtaacctttcaaacgttccggccccggtacgtcgggtacttcccgtaggacgcgtacgtttctcgtacggtcctccggaccgggtaccggggaaacgacggggccctacctacgtcgaaccctatcacgtcggacgggcccgagggccgaacgacgtcggacggtactgtaacccttagttacgtggtaccgagggtaccggaaaggtacccgaacctaacgtttcgtacgaacgtttacgggtccggggaacgggaacggggtaacctaaaggttccgggtaaccccgttagttccggggtaacaccgggacccgaaaccgggtccgttccccggtcccccgtcgggtacccttcccgtaccgttccccgttaccccccgtaaccccttccctacttcccttaccgtcccggtaccg

SEQ ID NO: 108150 - DNA, 663 bp, Homo sapiens
  misc_feature: GYAE6OF01CTJYX.49.40.D07.1.454.CMB.1.raw
  modified_base (374)..(374): a, c, t, g, unknown or other
  misc_feature (374)..(374): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtcggccctgggacagacggccacaattacctgtgacggcgagaacaatcgaaataagatattcactggtatacaaacaaaagcctggccacggcccttgttttcggtcctttatcgagtacttcaactccggcccgcgtgggactcccgtgacgcgtattctcgtcggctccgacggtcggggaacncgggccactctagacctatcacgtcgacgggcccgagggccgaacgagtcggaacggtctagtaacttagtttacgtacgtacgacgggtacgaaacggtaccgaacctaacgtttcgactaacgttacggttaccgggacgggaacgggtaaccctaagttccggacccggttaccgttgggtaccgacggtcccgaaacggtcctacccggtaccccccgttggtaccctccgttcccgttcccgttcccccgtcccctcccgttccttccttccgtcccgttaccg

SEQ ID NO: 108151 - DNA, 634 bp, Homo sapiens
  misc_feature: GYAE6OF01C3DY1.49.40.D07.1.454.CMB.1.raw
  modified_base (228)..(228): a, c, t, g, unknown or other
  misc_feature (228)..(228): n is a, c, g, or t
  modified_base (319)..(319): a, c, t, g, unknown or other
  misc_feature (319)..(319): n is a, c, g, or t
tcagagtcgagagacacgaccggtgctcgatttagtgatagagcgtaacaacagaggggctgggcctcaggaagcagcagtcggggggtgccgcagccatggcctggaccgctctccttctgacgcctccttgctctactttacaggttatgtcggcctcctacgaagtgattcagcctacgttccgtctcaggtcggccctgggacaggaccggccactaattaccnggtcgacggcgaagaacaatacgaaaataagaatatcactgtatacaaacaaagcctacggccacggtcccttggttttcggtacctttancgacgtactttacaacgtccggccgcgtcgggacctccgtgacgtcgtattccgtcgtcggcctaccgtacggtacggggaacgacgggacctacgtcgtacgacctacgtctaacgtcggacgggacccgagggtccgacgtagtggacggtctagtacttagttactgccgtaggtacgaacgccgactaattgactagtacgtcggacgggaagtaactaagtcggtaccgtcgtggacaccgaccgacgtccgtccgtccccgtggacctccgtccgttcccgttccctacccttctcctcctctcgtacg

SEQ ID NO: 108152 - DNA, 689 bp, Homo sapiens
  misc_feature: GYAE6OF01B3OJY.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtcggccctgggacagacggccaacaattacctgtgacggcgagaacaatcgaaataagaatattcactggtatacaacaaaagcctggccaggcccttgttttggtcctttatcgagacttcaatccggcccgtcgtgggactcccgtgagcgtattctctggcctccgacggtcggggaacacgggccactctcgaccatcagtcgacgggcccgagggcgacgataggacggtctgaacttagttacgtgtaccgagggtacgaaacggtaccgtacctaaacgtttgtactagttacggttcgggacgggtaacgggaaccctaaagtttccggaacccggttccgtacggggttacccaaccgggtccccgtaaacggggtcccgttacccggtcccccccgtttacgggttaccctaaccccgttcccgtttaccccggtttaccccccctacccccgtttccccttaccccttccctttcccgtcccgttaacccg

SEQ ID NO: 108153 - DNA, 595 bp, Homo sapiens
  misc_feature: GYAE6OF01D54NB.49.40.D07.1.454.CMB.1.raw
  modified_base (304)..(304): a, c, t, g, unknown or other
  misc_feature (304)..(304): n is a, c, g, or t
  modified_base (325)..(325): a, c, t, g, unknown or other
  misc_feature (325)..(325): n is a, c, g, or t
  modified_base (382)..(382): a, c, t, g, unknown or other
  misc_feature (382)..(382): n is a, c, g, or t
  modified_base (546)..(546): a, c, t, g, unknown or other
  misc_feature (546)..(546): n is a, c, g, or t
tcagagtcgagagacacgaccggtgctcgatttagtgatagagcgtaacaacagaggggctgggcctcaggaagcagcatcgggggtgccgcagccatggcctggaccgctcctccttctgagcctccttgctcactttacaggttatgtggcctcctacgaagtgattcagccacgttccgtctcagtggccctgggacagacggccacaattacctgtgacggcgaagaacaatcgaaataagaatattcactggtatacaaacaaaagcctggccacggtcccctggttttggtcctttancgagtacttcaatcggcccgntcgggactcctgagcgtattctctggctccgacggtcgggaacaggccatctgaccntcatcgacggccagggcacgatgagctagtactatacgtgtacgagggtcgaagacgacctaaacttgtacattacggttaccgggcgggtaagggaacctaaagttcggtaaccgtccgtagggtcaccggacctacggccgttaccgccccttacggtaccncctttccgccgtttacccccacccttccctccttccctcgtcccgtacg

SEQ ID NO: 108154 - DNA, 804 bp, Homo sapiens
  misc_feature: GYAE6OF01CGO7A.49.40.D07.1.454.CMB.1.raw
  modified_base (218)..(218): a, c, t, g, unknown or other
  misc_feature (218)..(218): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctccttgctcactttacaggttatgtggcctcctacgaagtgattcagccacgttccgtctcagtggccctgggacagacggccacaattaccngtgacggcgaagaacaatcgaaataagaatattcaactgtatacaacaaagcctggccaggccctgttttgtcctttatcgagacttcaatccggcccgcgtgggactccctagacgcgatttcctcgtacggctacccgacggttaccggggaaccaggggtcccacgttcgtacgaccctaagtccagtaccgacgggaccccgagggggaccgaacggtaacgtgggaacggcgttacggaaccctttaagtttaaccgtacggtaccgtaacgggtacggaaaacgtaacccggacccttaaaaccgtttgtaccgtaaagtttacggtttacccgggacggggtaaaccgggtaaccccgtaaaaaggtttcccgggtaacccgggtttacccggttagggggttaccccaaaccgggtaccccccggtaaacggggtaccccgttccccgggtacccccccccgttttacgggggtaccccttaaaccccggttccccgttacccggttttaccccccccccaacccccgttttcccccttcccgtttaaccccgtcccgtttccccgggttaacccccg

SEQ ID NO: 108155 - DNA, 635 bp, Homo sapiens
  misc_feature: GYAE6OF01CIUV8.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacaggttatgtggcctcctacgaagtgattcagccacgttccgtctcagtggccctgggacagacggccacaattacctgtgacggcgaagaacaatcgaaaataagaatattcactggtatacaaacaaaagcctggccacggcccttgttttcggtcctttatcgagtactttcaacgtccggcccgtcgtcgggactcccgtgacgcgattctcgtggctccgacggtcggggaacacgggccactctcgaccatcatcgacgggcccagggccgacgatggagctagacttatactgtcgaggtacgaagaccgacctaaacgttcgtactaagttacgttacgggacggtaacgggaaccctaaagttccggaacccgttccgtgggtaccacggccccgaaggtcccgtcccggcccccgttggtaccctacccgttcccgttacccgtttaccccccaccccttcccgttaccctccttccgtccgtaccg

SEQ ID NO: 108156 - DNA, 720 bp, Homo sapiens
  misc_feature: GYAE6OF01CZH58.49.40.D07.1.454.CMB.1.raw
  modified_base (89)..(89): a, c, t, g, unknown or other
  misc_feature (89)..(89): n is a, c, g, or t
  modified_base (224)..(224): a, c, t, g, unknown or other
  misc_feature (224)..(224): n is a, c, g, or t
  modified_base (336)..(336): a, c, t, g, unknown or other
  misc_feature (336)..(336): n is a, c, g, or t
  modified_base (373)..(373): a, c, t, g, unknown or other
  misc_feature (373)..(373): n is a, c, g, or t
tcagagtcgagagacacgaccggtgctcgatttagtgatagagcgtaacaacagaggggctgggcctcaggaagcagcagtcgggggtnccgcagccatggcctggaccgctctccttctgagcctcttgctcacttttacaggttatgtggcctcctacgaagtgattcagccacgttccgtctcaggtggccctgggacagaccggccaacaatttacccgngtacggacggacgaaagaactaagtaacgaaaataagtaattactactacgtaggtaactaacaaaacgaaacgcgtacgaccgtaccggtccctttgtttacgttacttancgtactacttacacgtccggccgtgtcggacctccgngacgtcgtactcgtcgcgtcctaccgacggtacggaaacgcggacctactcgacgaccatcacgtaccggacggccggagggacgacgtagtacggagtacgtacgtaactttacgttacgtaggaccggtaagggaccgaaacgtccgaaacccgttaagtttcaacgttaaggttacggtcgggaacgggtaaccgtaacttaccgggttaccgtacccggtttcgtacggggtacctaccggtacccggacggtccgtccccggtccccgttacggtaccctccgttccgttacccccgttcccctaccccgtttaccttccgttacctccggttccgtacccg

SEQ ID NO: 108157 - DNA, 807 bp, Homo sapiens
  misc_feature: GYAE6OF01DC765.49.40.D07.1.454.CMB.1.raw
  modified_base (119)..(119): a, c, t, g, unknown or other
  misc_feature (119)..(119): n is a, c, g, or t
  modified_base (184)..(184): a, c, t, g, unknown or other
  misc_feature (184)..(184): n is a, c, g, or t
tcagagtcgagagacacgaccggtgctcgatttagtgatagagcgtaacaacagaggggctgggcctcaggaagcagcatcgggggtgccgcagccatggcctggaccgctctccttcngagcctcttgctcactttacaggttatgtggccttcctacgaagtgattcagccacgttcgtctnaggtcggccctgggacaggaccggccaactaatttacctggtgaccggcgagaacaatcgaaataagaatattcacttggtatcaaacaaaagcctggaccacggtcccttggttttcggtcctttagtcgagtaccttaccaagtccgggccctcgtagggacttccccgtggacgtcgtacttccgtcgtcgggtccctaccgtacggtaccgggggtaaacacggggaccctaccgtcgtacgaccctaatccgaactaccgggacgggccccgacggggcgaacgtacgtcggaacgggtctacggtaacctttagttaaccgttggtacccggtaaggggtaccgaaacggtacccgtaacccttaaaaccgttttggtacgttaacgtttacggttacccgggaacgggggtaaacccggttaaccgtaaaggttttcccgggaacccggtttcccgggtacgggtacccggaaccgtaccccggtaaaccgggtcccgttaccccgggtcccccccgttaccggggttcccttacccgttaccccgttttccccgggttcccccctacccctttacccccgttcggtttaaccccttcccgttccggttaaccccg

SEQ ID NO: 108158 - DNA, 788 bp, Homo sapiens
  misc_feature: GYAE6OF01AGUL0.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtgccctgggacagacgcacattacctgtgacggcgagaacaatcgaactaagatattcactagtatacaacaaagacctggccacggaccctcgtttcggtcctttactacgtagactttcgaactccgtcccgcgtaggtaactccctagacggtcgtaactttcgtcctcgggcctccgaccggttacggggaacgacgggcctaccgtactcggactaacgtccacgtcgacggggaccccaggggaccgacggactacgagggtaccgtaggtacttaacgttacgtacggttcgaaccgggttacggaaaccggtacccggtaaccgaaaacctttcggtaaccctaacgtttaacggttacccggggtaaccgggtaacggggaaacccgtttaaacgttaccgggttaacccggttacccggttaccggggtaaccgtaaccgggtaccccggtaaacgggtaaccccggtcccggtacccccccgggtacggttaaccccggtcccgttaacccggttccccggtttaccccccggtccccccgtttaaccccggttcccctttaccccggtccgtttccccgggtaaccccc

SEQ ID NO: 108159 - DNA, 611 bp, Homo sapiens
  misc_feature: GYAE6OF01EXXFI.49.40.D07.1.454.CMB.1.raw
  modified_base (571)..(571): a, c, t, g, unknown or other
  misc_feature (571)..(571): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaaataagaattattcactggtatacaaacaaaagcctaggccaggtccccttgtttttcggtcctttatcgtagacttcaatccgggcccgtctggggactccccgtgacgcggtatttctcgtcggctccgacggtcggggaaacacggggccactctacgaccatcatcgacgggcccgagggccgaacgagtaggacggctaggaacttattactgtacgaggtacgaacgacgacctaaacttgtacatagttccgggaggtacgggacctaaagttcgaaccgttccgtgggtaccacggacccaacggccgtccgccccgttcgtccncttccgtccgttaccccacccttctacctctcctcgtacc

SEQ ID NO: 108160 - DNA, 759 bp, Homo sapiens
  misc_feature: GYAE6OF01E0JHH.49.40.D07.1.454.CMB.1.raw
  modified_base (238)..(238): a, c, t, g, unknown or other
  misc_feature (238)..(238): n is a, c, g, or t
  modified_base (286)..(286): a, c, t, g, unknown or other
  misc_feature (286)..(286): n is a, c, g, or t
  modified_base (332)..(332): a, c, t, g, unknown or other
  misc_feature (332)..(332): n is a, c, g, or t
tcagagtcgagagacacgaccggtgctcgatttagtgatagagcgtaacaacagaggggctgggcctcaggaagcagcagtcgggggtgccgcagccatggcctggaccgctcctccttctgacgcccttcttgcctctacttttacgaggttatgtcggccctcctaacgaagtgattcacgccctacgttccgtctcgaggtcggcccgtgggacaggaccggccaactaattccngtcgacggcgaagaacaatacgaaaataagaattacttcacgttgtanactaaacaaaacgcctaggccacggtcccttgttttcggtcctttntcggacgtacttcaacgtccggcccgtgtcgggtactcccgtgacgcgtattctcgtcggtcctccggacggtaccggggaacgcgggaccctacgtcgtacgaaccatccgtaactaccggaccggggtcccaagggggccgaacgtcgggtaggccgggtacttggtaaacctttagttacgtcggtaccgtacgggtaacggaaaccggtaccgtacctaaaacgtttcgtaactagttacggtcggggaacggggaacggtaacgttaaaccgttcgggtaccgttccggtacgggtacgacccgggaacccgtacgggtcccctacccgggtccccccgttagggtacccttacccggttcccctttacccggttacccccctcccgttccccttcttacccccttcggtcccgttaacccg

SEQ ID NO: 108161 - DNA, 573 bp, Homo sapiens
  misc_feature: GYAE6OF01BBND2.49.40.D07.1.454.CMB.1.raw
  modified_base (367)..(367): a, c, t, g, unknown or other
  misc_feature (367)..(367): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaaacaaaagcctggccaggcccctgttttggtcctttatcgagtacttcaattcggcccgtctgggactcccgtgacgcgattctctggcctccacggtcggggaacncgggccactctcgacatcatcgacgggcccaggggccgacgatggaggctagactattactgtcgaggtcgaagacgacccaacttgtaccagttactcgggacggaggaaccctaagttcgaccgtccgtgggtcacgcccgaaggcctcggcccccgtggtccacttccgtcgttccccgcccttcctcctctcgtccgtaccg

SEQ ID NO: 108162 - DNA, 662 bp, Homo sapiens
  misc_feature: GYAE6OF01BBASD.49.40.D07.1.454.CMB.1.raw
tcagagtcgagagacacgaccggtgctcgatttagtgatagagcgtaacaacagaggggctgggcctcaggaagcagcagtcgggggtgccgcagccatggcctggaccgctctccttctgagcctccttgctcactttacaggttatgtggcctcctacgaagtgattcagccacgttccgtctcagtggccctgggacagacggccacaattacctgtgacggcgaagaacaatacgaaataagaattattcactggtatacaaacaaaagcctggccaggtcccttgttttggtcctttatcgacgtacttcaagtccggcccgcgtgggactcccgtgacgcgtattctcgtggctccgacggtcggggaacacgggccactcgtacgaccatcacgtcgacgggacccgaggggcgacgagtggacgggtctacgtacttacgttacgtacggtccgtaggggtaccgaaacggaccgtaacccgtaaacgtttcggtaacctaagttacggttacgggacgggaacgggaacctaaagtttcggaccgttcgtcgggtaccgacggacccgaggtccctccggtccccccgtgggtccctaccgttcccgttccgttcccccctacccttcccttcccttccctcctccggtcccg

SEQ ID NO: 108163 - DNA, 709 bp, Homo sapiens
  misc_feature: GYAE6OF01COFH2.49.40.D07.1.454.CMB.1.raw
  modified_base (88)..(88): a, c, t, g, unknown or other
  misc_feature (88)..(88): n is a, c, g, or t
  modified_base (422)..(422): a, c, t, g, unknown or other
  misc_feature (422)..(422): n is a, c, g, or t
  modified_base (701)..(701): a, c, t, g, unknown or other
  misc_feature (701)..(701): n is a, c, g, or t
tcagagtcgagagacacgaccggtgctcgatttagtgatagagcgtaacaacagaggggctgggcctcaggaagcagcatcgggggtnccgcagccatggcctggaccgctctccttctgacgcctcttgctcactttacaggttatgtcggcctcctaacgaagtgattcagcctacgttccgtctcagtcggcccgtgggacaggacggtccaactaattacctggtacggacggcgaagaacaatacgaaataagaatattcacgtgtatacaaacaaagcctacggccacggtcccgttgttttcggtcctttagacggtaagtacctttacaacgtccgggaccccgtcgtacggggtacctcccgtaggacgtccgtattcctcgtcgggtactcccgacgggttaccggggaacncgggcctaccgtgtccgaactatccgagtccggacgggtacccgagggccgaagtacgtcggacgtacgtacgttaactacgtttacgacggttcgaacgggttaacgaacggaaccgaccttaaagttcgtaactagttacgttaccggggaggtaacgtaaaccgtacgtttaccggaccgttcggtacgggaccaacgtacccgacgggtcccgtacccgtccccgttacgccttcccgtcctacccggttcccctccccgttactctaccttccncggttacc

SEQ ID NO: 108164 - DNA, 817 bp, Homo sapiens
  misc_feature: GYAE6OF01EKPQX.49.40.D07.1.454.CMB.1.raw
  modified_base (563)..(563): a, c, t, g, unknown or other
  misc_feature (563)..(563): n is a, c, g, or t
  modified_base (610)..(610): a, c, t, g, unknown or other
  misc_feature (610)..(610): n is a, c, g, or t
tcagagtcgagagacacgaccggtgctcgatttagtgatagagcgtaacaacagaggggctgggcctcaggaagcagcagtcgggggtgccgcagccagtcggcctggaccgctcctccttcgtgacgccttcgttgcttactactttacgtaggttatcggtcgtacctaccgtaagtaagtcgacttcgacgcctacgttccgtctacgtggtcgccggtaggacacggaccgacctaactaacgttacgtggtacggaccggaagtaagaaaactaacgtaaacgtaaaattaaacggaactttacgttacgaacgttaaggtaacctaacaaaacggtaaacctccgggtacggacccgttaccggttcccggttttcgttttacggttacctttagacggtacttacgttaacgaccgtcccgggaccgtacggtcggacctcgtcgacgtacttcgttcgtcgcgtacgttaccggacgggtaccgacgtcggacctacgacgtacgacctagtaccgaacgtccggacgggccgacgggacgtacggtagtacggngtacggttactactaacggttacgtcgaacggtacggaaccgtaacncgtttaacgacgttagacgtagtacggtccgaacggttaccgtaacgtacggaccgttcggaccgtaggacccgtaaccggaccgggtacctaccccgggttcccgggtacccgtacccggtttacccgcggtttaccccctttaccccggtacccccttttaaccccggccttttacccggtcccctttaccggtcccgtaccggg

SEQ ID NO: 108165 - DNA, 864 bp, Homo sapiens
  misc_feature: GYAE6OF01DC18J.49.40.D07.1.454.CMB.1.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (282)..(282): a, c, t, g, unknown or other
  misc_feature (282)..(282): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctcttgctctactttacaggttatgtcggcctacctacgaagtgattcagccacgttccgtctcgaggttggcccctgggacaggaccggccaactaattaccnggtgaccgggngaagaaacaagtacgaaataagtaatagttcactggtaactanaaacaaaacgcctcggaccgtacggcccgtttgttttcggttacctttatccggtagtacttaccaagtccgggtacccgtcggtcggggaccttcccgtggacgtaccgtattctaccgtcggtccgtaccgtaccgggtacgggggaaccaccggggtaccctaccgtacgtacgacccgtaactccgtaacgtccggaaccggggtcccgacgggggtaccgaacggtacgtcgggacggtacgtcggtaacctttacgtttaaccgttacggtaccggtaacgggtaaccggtaaaaccggtaccccgtaaacccgtttaaacgtttacgggtaaccgtaacggtttaacgggttacccggggaaccggggggtaaaccggtaaaccccggttaaattacccggggtaacccggttccgggttaccggggtaccctacccgggtaaccccggacgggtaacccgttcccccgggtacccccccggttaggtaccccttccccggttacccgtttcccggtttacccccccggtccccccctttgttcccccgttttcccgccgttccccggttaaccg

SEQ ID NO: 108166 - DNA, 1200 bp, Homo sapiens
  misc_feature: GYAE6OF01ERVLG.49.40.D07.1.454.CMB.1.raw
tcagagtcgagagacacgaccggtgctcgatttagtgatagagcgtaacaacagaggggctgggcctcaggaagcagcagtcggggggtgccgcagccatggcctggaccgctcctccttctgagccttccttgctctactttacaggttatgtcgcctcctacgaagtgattcacgtcctacgttccgtctcgagtcggcccgtgggaccaggaccggcccaactaaacgtttacctggtcggaaccgggcgaaaggaaaacaaagttaccgaaaaattaaacgaatttaactttaccgaaacgtttaggttaaacttaaccaaaaaccgtaaaaaaacggtccccgttaacggggaccccgaaaccggggttcccccccgttttagggtttttttttacccgggtttaccccgtttttttaacgttaccccggttaaaacgggttaaccccgtttttacccgtaaaaaccggtttccccgggggtaccccccccggtccgggtttacggggggggttaaaaccccttttccccccggtttaacggggtaaaccggtccccggggtttaaactttttttacccggttaccccggtttcgggggtacccccgttacccccgggtaaaccccgggggtttaccccgggggggggaaaaaacccggtaccgggggggtacccccctaaaccgttttccccgttaaccggggaacccctttaaagttaccccgtaaaccgtttcccggggaaaccgggggggaccccccccgggtaaaggggggggtaacccccgggtaaaccgggtaacggttaccgggggaaccggggtaccggtttaaccggttaaaccgtttaacgttttaaccggttacggtttaccggtaacggggttaacccgggaaaaccgggttaccgggtaaaccccgtttaaaacggtttaccgttaaccggtaacgttttaacgggtttacccgggggtaacccgggggtaaaacccgggggaacccgttaaaaacggttttccggggtaaacccccgggtttacccgggtttaccggggttaaccccgaaccggggtacccccggttaaaaccggggtcccccgtttaaccccggggtccccccccccggtttacggggtttaaccccctaaccccggttttccccgtttaccccggttttacccccccccgtaaccccc

SEQ ID NO: 108167 - DNA, 644 bp, Homo sapiens
  misc_feature: GYAE6OF01CQ4R3.49.40.D07.1.454.CMB.1.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (218)..(218): a, c, t, g, unknown or other
  misc_feature (218)..(218): n is a, c, g, or t
  modified_base (344)..(344): a, c, t, g, unknown or other
  misc_feature (344)..(344): n is a, c, g, or t
  modified_base (383)..(383): a, c, t, g, unknown or other
  misc_feature (383)..(383): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctccttgcctcactttacaggttatgtggccctcctacgaagtgattcagccacgttccgtctcagtgccctgggacagacgccanaatccngngacggcgaagaacaatcgaaaataagaatattcactggtaatacaaacaaaagcctaggccacggtcccttggttttcggtcctttatcgagtacttacaacgtccggcccgtcgtgggactcccngtagcgtattctctcggcctccgacggtccggggaaacncgggaccactcgtcgaccatcaatcgacgggccagggacacgagtcggaggcctagactattacgtgtacgaaggtacggaaagaccgtaccaaacgtttgacaagttacgttcggggacggtacgggaacctaaagttcgacccgttaccgtgggtaccacgtcccgaaacggtcctacccggtccccccgtcggtacctacccttccggttcccgttaccccccgccccttccctaccttcccgtccgttaccgtcccg

SEQ ID NO: 108168 - DNA, 895 bp, Homo sapiens
  misc_feature: GYAE6OF01DY6N1.49.40.D07.1.454.CMB.1.raw
tcagagtcgagagacacgaccggtgctcgatttagtgatagagcgtaacaacagaggggctgggcctcaggaagcagcagtcgggggtgccgcagccagtggcctggaccgctctccttctgacgcctccttgctcactttacaggttatgtggcctctacgatgattcagccacgttcgtctcgagtggcccgtgggacaggaccggccactaattaccgtggtacggacggaccgaaggaaacctaagttaccggaaaaattaaaggaaatttactttccgaacgttgggttaacttaccaaaaacgtaaaaaacggtcccttacgggaccccgtaacggggtcccccctttaggtttttccgggttaccttttaacgtccggtaacggtaaccttttaccaaaccgttccggggcccccgtacgtttacgggggaccttaccccgtgggaacgtccgggtaacttttccgtaccgtttaccgggccttacccgacgggttaccgggggaaacctcgggggaccctacgttaccgtaacggtaaccctactccgtaacgttaccggacggggtaccccggtaaggggccgaaaccggtagtacgggaacgtcctagggtaacctttaagttaaccgttacgggtacgtacggtaacggaaacggacccgttaccgtaaaccgtttcgtacctaagttaccggttacgggacccggggtaaggtaacctaacgggtttccgacccgggttccgttacggggtacgtacccggaacccgtacgggtaccctcccgggtaccccgtttcgggtaccctaacccggtttcccttccggttacccccccggtacccgttacccgtaccccgtttcgtacccttccgggttaaacccgg

SEQ ID NO: 108169 - DNA, 697 bp, Homo sapiens
  misc_feature: GYAE6OF01BFWZI.49.40.D07.1.454.CMB.1.raw
  modified_base (209)..(209): a, c, t, g, unknown or other
  misc_feature (209)..(209): n is a, c, g, or t
  modified_base (262)..(262): a, c, t, g, unknown or other
  misc_feature (262)..(262): n is a, c, g, or t
tcagagtcgagagacacgaccggtgctcgatttagtgatagagcgtaacaacagaggggctgggcctcaggaagcagcatcgggggtgccgcagacatggcctggaccgctctccttctgagcctccttgctcactttacaggttatgtgcctcctacgaagtgattcagccacgttccgtctcaggtcgccctgggacagacggccanattacctgtcgacggcagaacaatacgaaatagaatattcactgtatacaaanaaagcctaggccacggtcccttggttttcggtccttttaagccgtacgtactttacgaaacgttccgggacccgtcgtacgggacttcccgtaggacgtcgtactttcctcgttcggccttccggacggtccggggaaactcggggccctacgtcgtacgaacctacgtcaacgtcggaacggggaccccgagggccgaacggtagtcggaacgggtctaggtaaccttaagttaaccgtggtaaccgaggggttaacgaaacgtaccgtaaccgtaactttacggtactaacggtacggttaccgggaccgggtaacgggtaacctaaacgttcggaacccgttcgtacgggtacgaccgtaccggacgtccgtacccgtcccgtagtaccctccgtccttcccggtcccgtcctccttccactccgtactccg

SEQ ID NO: 108170 - DNA, 695 bp, Homo sapiens
  misc_feature: GYAE6OF01CD7UA.49.40.D07.1.454.CMB.1.raw
  modified_base (119)..(119): a, c, t, g, unknown or other
  misc_feature (119)..(119): n is a, c, g, or t
  modified_base (141)..(141): a, c, t, g, unknown or other
  misc_feature (141)..(141): n is a, c, g, or t
tcagagtcgagagacacgaccggtgctcgatttagtgatagagcgtaacaacagaggggctgggcctcaggaagcagcatcgggggtgccgcagccatggcctggaccgctctccttcngagcctccttgctcactttacnggttatgtggcctcctagaagtgattcagccacgttccgtctcagtcggccctgggacagacggccacaattaccgtgtcgacggcgagaacaatcgaaataagatattcacgtgtatacaacaaagcctggccaggccccttaggttttcgtcctttatcgagtaccttcaatccggcccgtcgtgggactcccgtgacgcgtattctcgttcggccttccgacggttccggggaactacggggccactctcgacctatcactcgacgggcccgagggccgacgtatacggaggtctaggaccttagtaccgtgtacgagggtaccaaggacccgtaacgtaaccgtttcggactaagttacgttcgggacggtaacgggtaaccctaaaggttcggacccggtttccggtacgggttacccgacggtaccccgaaacgggtcccgttacccggaccccccgttacgggtaccctaacccggttcccgttaccggtttcccccccgtacccctttcccgttaccccgttcccgttcccgttcccggttacccg

SEQ ID NO: 108171 - DNA, 841 bp, Homo sapiens
  misc_feature: GYAE6OF01BOW1G.49.40.D07.1.454.CMB.1.raw
tcagagtcgagagacacgaccggtgctcgatttagtgatagagcgtaacaacagaggggctggcctcaggaagcagcagtcgggggtgccgcagccatggcctggaccgcttcctccttctgacgccttccttgctctactttacgaggttatgtcggccttccgtacgaagtgattcagccctacgtttccgtctcgaggtcggcccgtgggacaggaccggccaactaactttaccgtggtacggaccggacgaagaaaccaataaccggaaaattaaaggaattattaccgacgttaggttaactaccaaaacaaaaacggtcccgtacgggacccaaccgggtccccgttttggttttttacggttaccctttttacgtaccggtacggtacctttaccgtaaccgtcccggggccccgtacggttcggggtaccttccccgtggacggtcgtatttcccgtcgtcggtcccgtaccggtacggtacgggggaaccacggggtcccacgtccgtcgaaccataccgacgttccggaccgggacccgtacggggaccgacggtaacggtcggaacgggccttacggtaacctttacgtttaccgtacggttacgtacgggtacggtaaaccgtaacccgtaaccgttaacgtttcgtacgtaagttacggttcgggaacgggtaacgggaaccttaaacggttcggtaacccgttcggttacgggtaccaccggaccccgtacgggtcccgttacccggcccccgttggtaccctaccgtttcccttaccccgttacccctaccccgttccttaccctccgtttccgtcccgtacccg

SEQ ID NO: 108172 - DNA, 929 bp, Homo sapiens
  misc_feature: GYAE6OF01BPCBX.49.40.D07.1.454.CMB.1.raw
  modified_base (89)..(89): a, c, t, g, unknown or other
  misc_feature (89)..(89): n is a, c, g, or t
  modified_base (120)..(120): a, c, t, g, unknown or other
  misc_feature (120)..(120): n is a, c, g, or t
tcagagtcgagagacacgaccggtgctcgatttagtgatagagcgtaacaacagaggggctgggcctcaggaagcagcagtcgggggtnccgcagccatggcctggaccgctctccttcngagcctccttgctctactttacaggttatgtcggccctcctacgaagtgattcagccctacgttccgtctcgaggtcggcccgtagggacacggaccggccaactaattccgtggtacgacggacgaacgaaacaatacgaaaataagaattacttcacgttggtaatacaaacgaaaacgtccgtaggcccgaacggtcccctttggtttttcggtaccttttagtccgtaggtacctttacgaacgtccgggccccgtcggttagggacctcccggtaggacgtcgttatttccgttcgtacggcctaccgtacgggtaccgggggaaaccgaccggggtacccaacgttccgttacggaaccctactaccgtaacgtccgggaaaccggggcccccggaagggggcccggtaaaccggttaggtaacggggtacgtacggttaaccggttaacccgtttaaagttttccgggtaacggtaccggttaaacggggggttaccaaaaaccgggtaccccggttaaacccttaaaaccgttttcggtaacccgttaaacggttttaacgggttccgggggaaaccgggggaaaccggggttaaaaccccttaacgggtttaccggggttacccgtacccggggttacggtacccgggtaacccgggaccccggtaaaccggttcccggtcccccggttccccccggttagggtaccccgttccccgtttccccggtttccccggtttcccccccccggtccctttttccccggtacccctttccgggtttccccttccgggttaccccg

SEQ ID NO: 108173 - DNA, 841 bp, Homo sapiens
  misc_feature: GYAE6OF01D1N5R.49.40.D07.1.454.CMB.1.raw
  modified_base (195)..(195): a, c, t, g, unknown or other
  misc_feature (195)..(195): n is a, c, g, or t
  modified_base (495)..(495): a, c, t, g, unknown or other
  misc_feature (495)..(495): n is a, c, g, or t
  modified_base (802)..(802): a, c, t, g, unknown or other
  misc_feature (802)..(802): n is a, c, g, or t
tcagagtcgagagacacgaccggtgctcgatttagtgatagagcgtaacaacagagggctgggcctcaggaagcagcagtcgggggtgccgcagccatcggcctggaccgtctctccttctgacgtccttcttgcctctactttacgaggttatggtcgccttccgtaacgagtgattcagccctacgttcgtcncgaggtcggcctggacacggccggccactaagttccgtggtacgaacggacgaagaaactaagtacgaaaataagaattcttacacgttaggtaactaacgaaaaccgtaaacggtcccgtacggacccgtaccgggttccccgttttggtttttaccggtttaaccctttagtaccggtaaacgttaccccgtttacgtaaaccggttcccggcccggttacgtcggggtaacccttcccggtagtacgcccgttatttccggtacgtcggtacccttaccggacgggtacgggtaacnccgggtaccacgtcgacgtacctagaccgacgtacggacgggtacccggagggtaccaggtagtacggacggtcctagtaacttgttaacgcgtaaggtaacgtacgtaacgtacccgtaaggttaaccttcggtacgtaagtcgggtaccggtaaccgggtaaacggacttaacgtaccgggtaccgtaccgttcgggaaccgttaacggcccgtaaacccgggtcccctaaccccgggttaccccggttcgtaacccgttaacccggttcccgttacccccgttacccccccgggtttaaccccnccccgttttacccgtccgttaccccgtaagggtcccccg

SEQ ID NO: 108174 - DNA, 730 bp, Homo sapiens
  misc_feature: GYAE6OF01D1FYP.49.40.D07.1.454.CMB.1.raw
  modified_base (264)..(264): a, c, t, g, unknown or other
  misc_feature (264)..(264): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtgcctcctacgaagtgattcagcccacgttccgtctcagtggccctgggatagacggccacaattacctgtgacggcgagaacaatacgaaataagaatattcactggtatacaanaaaagcctggccacggtcccttgttttcggtcctttatcgagtacttcaactccggcccgcgtgggactcccgtagacgcgtattctcgtcggtcctccgacggtacggggaacgtcggggccctacgtcctacgacctactcctacgtaccggaccggggacccgaacgggggaccgaacggtacgttacgggacgggtacttacggtaactttaacttaccggttacggtaccggtaacggggtaccggaaaacggacccggtaacctaaacgtttcgtacctaagtttacggttccgggaacggggtaacgggtaacccgtaaagttccggtacccggttccggtgggtaccgacgaccccgaacgggtccctcccggtcccccgttacggttaccctaccgttcccgttccccgttacccccgtacccccttcccttacccgttccctccgttccgtacccg

SEQ ID NO: 108175 - DNA, 585 bp, Homo sapiens
  misc_feature: GYAE6OF01AU80C.49.40.D07.1.454.CMB.1.raw
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (331)..(331): a, c, t, g, unknown or other
  misc_feature (331)..(331): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctcttgctcactttacaggttatgtggcctcctacgaagtgattcagccacgttccgtctcagtggccctgggacaggacgcanaattcctgtgacggngagaacaatcgaaataagatattcactggtatcaacaaagcctggccagccctgttttggtctttatcgagtcttcatcggccgcgtgggactccctgagcgtattcncgtggctccgacggtcggggaacacgggccactctgaccagtcactccggagggcccagggacgacgagtggacggcgtagtacttacgttactgtacgagggtacgtaagacctccgtaaacttgtacattagtcggaggacggtaccgtaaagttcggaccctcgtagggtccacgcccgtaaggccgtaccgcccccgtaggtccctacctccgttccgttcccctacccttcctcctcctcgtcgtcccg

SEQ ID NO: 108176 - DNA, 652 bp, Homo sapiens
  misc_feature: GYAE6OF01AX5TF.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacaggttatgtggcctcctacgaagtgattcagccacgttccgtctcagtcggccctgggacaggacggccacaaattacctgtgacggcgaagaacaatacgaaaataagaattattcactggtatacaaacaaaacgcctggccacggtcccttggttttcggtccttttatcgacgtactttcaacgtccggcccgcgtgggtactcccgtgagcgtacttctctcggcctccgacggtacgggggaacgcgggcctacgtctcgacctatcgatccggacgggccgacgggacgacgagtggacggtctagtacttaacttacgtcgtacgaggtacgaacgaccgtacctaacttcgtactagttacgtcgggacgggaacggtaacctaacgttcggaccgttcgtacgggaccgacgacccgtacggtccgtcccggtccccgtccggtacctccgttcccgttccggttacccccgtccccttcccttctcccgttcgtcccgtccg

SEQ ID NO: 108177 - DNA, 775 bp, Homo sapiens
  misc_feature: GYAE6OF01BN7IS.49.40.D07.1.454.CMB.1.raw
  modified_base (122)..(122): a, c, t, g, unknown or other
  misc_feature (122)..(122): n is a, c, g, or t
  modified_base (761)..(761): a, c, t, g, unknown or other
  misc_feature (761)..(761): n is a, c, g, or t
  modified_base (768)..(768): a, c, t, g, unknown or other
  misc_feature (768)..(768): n is a, c, g, or t
tcagagtcgagagacacgaccggtgctcgatttagtgatagagcgtaacaacaggaggggctgggcctcaggaagcagcagtcggggggtgccgcagccatggcctggaccgctctccttcngagccctcttgctctactttacaggttatggtcggccctcctaacggaagtgtattcacgccctacgttcccgtctcgacggtcggcccgtggggacacgggaccggacccaactaatttaccgtggtacggaaccgggacgaagaaacaaagttaaccgaaaataaagtaaattacttacaacgttaggtaactaaccgaaaactaaaacggccgtacgggacccgtaccgggttccccgtttggtttttacggttccttttaagtaccgtaacgtactttacgaacgtcccgggtcccgtcggttcgggactcccgtagacggtcgtacttctcggtcggtcctaccggacgggtaccgggggtaagccgggacctacgttcgtaccgaacctataccacggtccggacggggacccggaggggaccgaacggtacggtagggacggtaccgttaacggtaaactttacgtttacggacgtttacggaacgggttacgaaacggtacctaaaccgtaactttggtaccagtttacggtacgggacgggtaacggtaactaacgggttcgtacccgtcggtacggacgaccgcgtacggccctccggccccgtgctcctcctccctaccctcccttcncgttccngtcgtcc

SEQ ID NO: 108178 - DNA, 681 bp, Homo sapiens
  misc_feature: GYAE6OF01EL3N5.49.40.D07.1.454.CMB.1.raw
  modified_base (242)..(242): a, c, t, g, unknown or other
  misc_feature (242)..(242): n is a, c, g, or t
  modified_base (324)..(324): a, c, t, g, unknown or other
  misc_feature (324)..(324): n is a, c, g, or t
  modified_base (353)..(353): a, c, t, g, unknown or other
  misc_feature (353)..(353): n is a, c, g, or t
  modified_base (378)..(378): a, c, t, g, unknown or other
  misc_feature (378)..(378): n is a, c, g, or t
  modified_base (410)..(410): a, c, t, g, unknown or other
  misc_feature (410)..(410): n is a, c, g, or t
tcagagtcgagagacacgaccggtgctcgatttagtgatagagcgtaacaacagaggggctgggcctcaggaagcagcagtcggggggtgccgcagccatggccctgggacccgcttccttccttctgacgcccttccttgcctcacttttacaggttatggtgcctcctacgaagtgtattcagcctacgttccgtctcgagtcggccctgggacagaccgccaacattacctgtgacggngagaacaatacgaaataagatattcatgtatacaaacaaaacgccgtaggacctacggtccctttggttttcgttcctttanaccggtatacttcgaacgtccgggcccgngttcgggacttcccgtggacacgtnttctcgtggccctccgacgggtacgggaccgngggcccactcgtacgaccatccatcggacgggcccgtaggggccgtaacgcgtaggacgtactacgtaacgttatacgtgttaccggacgggtacgaacgacgtaacccgttaagttcgtactaggttagtccggggaacgggtaacggtaacctaaagttcgaaccggttcgtagggtaccacgtccgacggtcctacccggccccgtacgttctaccgttccttaccggttcccccctcccttcccggttctccgttccgtccgtaccg

SEQ ID NO: 108179 - DNA, 980 bp, Homo sapiens
  misc_feature: GYAE6OF01ES901.49.40.D07.1.454.CMB.1.raw
tcagagtcgagagacacgaccggtgctcgatttagtgatagagcgtaacaacagaggggctgggcctcaggaagcagcagtcgggggtgccgcagccatggcctggaccgctctccttctgagcctccttgcctcactttacaggttatgtggcctcctacgaagtgattcagccacgtttccgtctcaggtcggcccctgggacacggaccggcccaactaactttaccctggtacggaaccgggcaagaaacctaagttacggaaaaataagtaatttacgttccaacgttggtaactaccaaaacgaaaaagcccgtaggaccaacgggtccccgtttggtttttcggttacccttttataccggtaagtaccgtttacaacgttccgggtaccccggtcgtacggggacttccccgtaggaacgccggttaatttccgttccgtcgggtaccctccggtaaaccgggttaccggggggaaaacctacgggggtacccctaaccgttccgttaccggaaccctaacgttaccgaacgttacccggaccgggggaccccgtaacggggggacccgtaaccggaacgtttacggggaaccgggtaccttacgggtaaaccgtttaacgtttaaccgttacggttacccggtaacggggttaaccggaaaccgggtaacccggtaaccccgtaaaacgttttcggttaacccgtaagttttaaccgggtttaccgggggaacccggggtaaacggggtaacccttaaaaacggtttcccgggaaacccgggttccggttacggggtaccccttaacgggaccccccgttaaaacggggccctttaccccggggtcccccccgtttaccggggtacccttaccccggttacccgtttaccccggggtttcccccccccggtaccccctttaccccgttttaccccgttaccccgtttcccccgttaccgggttaacccccg

SEQ ID NO: 108180 - DNA, 740 bp, Homo sapiens
  misc_feature: GYAE6OF01BAFR6.49.40.D07.1.454.CMB.1.raw
  modified_base (454)..(454): a, c, t, g, unknown or other
  misc_feature (454)..(454): n is a, c, g, or t
  modified_base (702)..(702): a, c, t, g, unknown or other
  misc_feature (702)..(702): n is a, c, g, or t
tcagagtcgagagacacgaccggtgctcgatttagtgatagagcgtaacgaacagagggctggcctcaggaagcagcatcggggtgccgcagccatggcctggaccgctctccttctgagcctcttgctctactttacgaggttatgtcggccttccgtacgaagtgattcgagtcctacgttcccgtctcgagtcggccctgggacagaccggaccaactaacttaccgtagtacggacgggcgaagaaacctaatacgaaaataagaattattcgacttaggtatacaaaacaaaacgcctaggcccacggtcccgttgtttttcggttaccctttagtcgtaacgtacgtttacaacgtccgggcccgtacgtgggacttcccgagacgtcgtacttctcgtcggccgtccgacgtacggggaacacgggccacgtcgacgaccatctacncgacggcccagggacacgagtcgacgtctacgtaacttacgttcgtacgtactagggtacccggaaagtaccgacccgttaaagttcgtacgtaacgttaggtacccgggacgggtaacggtaacccgttaaaaggttcccggttaacccgtccggttaacgggtacccgaccggtaacccggaacggcccgttccccgggacccccgttgggttaccctaccgtttcccgtaccccgttttaccccnccccgtttcccttaccgtacccttcgtaccgttacccg

SEQ ID NO: 108181 - DNA, 957 bp, Homo sapiens
  misc_feature: GYAE6OF01DA7L7.49.40.D07.1.454.CMB.1.raw
  modified_base (239)..(239): a, c, t, g, unknown or other
  misc_feature (239)..(239): n is a, c, g, or t
tcagagtcgagagacacgaccggtgctcgatttagtgatagagcgtaacaacagaggggctgggcctcaggaagcagcagtcgggggtgccgcagccatggcctggacccgctcttccttctagacgcccttccttgccttactactttaacgaggttatggtcggtccctaccgtaacggaagtgtatttcgacgtcccgtaccgttccgtctacgtaggtccggcccgtgggaaccncggaaccggccctaacgtaaactttacccgtggtcgggaaccgggtacggaaacgtaaactaaacgtacgtaaaaataaagtaacttactttacgacgttaggtaactacaaaaccgaaacgccgtacggacccgtaccggtccccgttttggtttttaccggttaccttttaacgtaccggttaacgtaacccgttttaccgaaaccggttccccgggtaccccggttacggtaccgggggtaccctttacccgggttacgaaccgggttaccgttaaccgttttcccggtccggttaccgggtaccccgttacccggggaacccggggttaccgggggaaaccgtacgggtacccctacgttacgtaccggtaacctacgtactaccggaccgggaccgggtaccccgaagggggacctaaacgggtacgtcgggtaaccggtgttaaccggttaaactttaccggtttaacgtacgggtaccggttaacgggaaccggtaaacccgggtaaccctacccggtttaaacggtttccgtaaccgttacggtttaccggggttacggaaccgggggtaaaccgtaaaccgttcggttaccggtaccccggttaccggtgggtaacccaccggaccgacccggtcctaccccggtccccgttcgtccctcccgttcccgttccccgttcccctaccttccctcttacctccgtacgtcc

SEQ ID NO: 108182 - DNA, 791 bp, Homo sapiens
  misc_feature: GYAE6OF01CQSN7.49.40.D07.1.454.CMB.1.raw
  modified_base (122)..(122): a, c, t, g, unknown or other
  misc_feature (122)..(122): n is a, c, g, or t
  modified_base (126)..(126): a, c, t, g, unknown or other
  misc_feature (126)..(126): n is a, c, g, or t
  modified_base (233)..(233): a, c, t, g, unknown or other
  misc_feature (233)..(233): n is a, c, g, or t
  modified_base (359)..(359): a, c, t, g, unknown or other
  misc_feature (359)..(359): n is a, c, g, or t
tcagagtcgagagacacgaccggtgctcgatttagtgatagagcgtaacaacagagggctgggcctcaggaacgcagcagtcgggggtgccgcagccatggccctggacccgctctccttcngacncctcttgctcgactttacaggttatgtcggcctcctagagtgattcagccacgttccgtctcgagtcggccctgggaaccaggaccggcctaactaactttacccgnggtacggaaccgggaccgtaaagaaacctaagtacggaaaaaattaagaattacttcgaacgttaggtactacaaaacgaaaacgccgtggacccaccggtcccttaggttttcggttccctttanacgtaacgtaccttactaacgtccggcccgtacgtcgggactcccgtaggacgcgtacttccgtcgttcggactccgacggtaccggggaacgcgggtacctactcgtacgacctacgtactacgtaccggacgggacccgagggccgaagcgaggacggtctacggtaacttaacgttacggtacgtacggaacgggttaccggaaacggtacccgtaaccgttaaacgtttccgtaagttaaccgttacgggtttacccgggaacgggaacggttaaaccctaaggttacccggtacccgtaccggtacgggtcccaacgggaccccgtaagggcccctcccggtaccccggttccgtacccggtaccttcccgttaccccgtcccccggtccctttaccccgtcccttcccggtcccttccgtacccgg

SEQ ID NO: 108183 - DNA, 659 bp, Homo sapiens
  misc_feature: GYAE6OF01C3FXM.49.40.D07.1.454.CMB.1.raw
  modified_base (221)..(221): a, c, t, g, unknown or other
  misc_feature (221)..(221): n is a, c, g, or t
  modified_base (312)..(312): a, c, t, g, unknown or other
  misc_feature (312)..(312): n is a, c, g, or t
  modified_base (545)..(545): a, c, t, g, unknown or other
  misc_feature (545)..(545): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctccttgctcactttacaggttatgtggcctcctacgaagtgattcagccacgttccgtctcgagtggccctgggaacagacggccaacaattaccngtcgacggcgaagaaacaatcgaaaataagaatattcactgatacaaactaaaagcctggaccaggtcccttaggttttcggtacctttancgtacgtacttacaacgttccggacccgcgttagggacctcccgtgaggtccgtagtttcctcgtgggccttcccgaacgggttacgggggaaaactaggggcccctaacgtcttaccggaaccctaagtacgaacgtccggaaaccggggccccgaagggggacgaacggaagtgaacgggctagacttaagttactagtacgagtacgaaaggaaccaccttaaactgtanagttagtcggacgggtaggaacctaaagttcgaccgtcgtcgggtacacgaccgaaggctccgccccgtacgctccgtaccgtctaccccctccctactcctcgtcctgtaccg

SEQ ID NO: 108184 - DNA, 722 bp, Homo sapiens
  misc_feature: GYAE6OF01ESMAF.49.40.D07.1.454.CMB.1.raw
  modified_base (90)..(90): a, c, t, g, unknown or other
  misc_feature (90)..(90): n is a, c, g, or t
  modified_base (124)..(124): a, c, t, g, unknown or other
  misc_feature (124)..(124): n is a, c, g, or t
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
  modified_base (317)..(317): a, c, t, g, unknown or other
  misc_feature (317)..(317): n is a, c, g, or t
  modified_base (361)..(361): a, c, t, g, unknown or other
  misc_feature (361)..(361): n is a, c, g, or t
  modified_base (549)..(549): a, c, t, g, unknown or other
  misc_feature (549)..(549): n is a, c, g, or t
  modified_base (711)..(711): a, c, t, g, unknown or other
  misc_feature (711)..(711): n is a, c, g, or t
tcagagtcgagagacacgaccggtgctcgatttagtgatagagcgtaacaacagaggggctgggcctcaggaagcagcgagtcgggggtnccgcagccagtcggcctggacccgctctccttcngacgtccctccttgctactacgtttacaggttatcggtgccctaccgtagagttgattcgacgcctaccgttcgtctcaggtcgccgtggacaggacgccaataattcngcgacgganaanaaacatacgaaaatagatntcatagactacaaanaaacgccgagaccgtacggtccttggtttctaccttancgtaacgtacttacgacgtccgtccgtgtcggtacctccggtanacgtctattccgcgtcggaccctacggaacgggtaccggtaacgcggtaccactcgtacgactacgactacgaccggtacgggcccagggggtaacctaaggtacgttacggagggtaccttaacgtaacttacgtacgtcggtaaacgacgggtaccggaacgtaaacccgtaacgttaaccggttntaacgtagttacgggtaccgggaacggtaacgtaaccgttaaacgttccgggtacgtttacccggaggggttaccaaccgggtcccgaaaccgttccgtccgtaaccccgtggtaaccctcggttaccctcccggtaaccccctcccgtacttcccggtccnccgttgtaccg

SEQ ID NO: 108185 - DNA, 706 bp, Homo sapiens
  misc_feature: GYAE6OF01BNH0L.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagccctcttgctcactttacaggttatgtggcctcctacgaagtgattcagccacgttccgtctcgagtcggccctgggaccaggaccgccaacaattacctgtgacggcgagaacaatacgaaataagaatactcacgtgtatcaaacaaagcctggacctacggtcccttgttttcgtctttagtcgaacgtctacacgtccggcccgtagtggacctcccgtagacgtcgttacgttctccgtcggcccttaccgacggtcggggaacctacgggtacccactcccgtcgaacctagtccagtccggaacgggccccgagggccgtaacgagtggaacggtctacggaacttacgttcgagtaccggtagggtaccgaaacggtacgtaaccctaacgttggtaactaacgttacggtccgggacggtaaacggtaaccctaaacggttccgaaccccgtttacgtacgggtaccaaccgggtacccgtaacggttcccgaacccggtcccccgtcggtcttaacccgttccttaccccgtccccctacccccttcttacccctccttcccgtcggtaccccg

SEQ ID NO: 108186 - DNA, 853 bp, Homo sapiens
  misc_feature: GYAE6OF01A2XJZ.49.40.D07.1.454.CMB.1.raw
tcagagtcgagagacacgaccggtgctcgatttagtgatagagcgtaacaacaggaggggctgggcctcaggaagcagcagtcgggggtgccgcagccatggcctggaccgctctccttctgacgccctccgttgcctcactttacgaggttatgtcggcccttcctaacggaagtgattcgagcccgtacgtttccgtcgtcagtcggcccgtgggaccaggaccggcctaactaatttacccgtggtacggacgggacgaacgaaacgaacttacggaaaaataaaggaattaacttccaacgttaggtaacttaaccgaaaactaaaacggtcccgttacggacccgtaccggtccccgttttgtttttaccggttacccttttagtaccggtaacttaaccgtttacgtaacggttcccgggaccccggtacggtacggggtacctcccgtggacgtacgttacttccgttcgtcggtacccgttcccgaccgggtacggggaaaccgtcggggtacccacgttcccgtacgacctactaccgtaaccgtccggaaccggggtccccgaaggggtacccgtaagggtcgtaacggaacgggtcctaacggttacctaagtttaccggttggtaacgtacgggttaaccgaaaccgtacccgtaaccttaaacgtttcggtaaccgtagtttccggttaaccgggaccgggtaccggttaaaccgtacgtttaccggacccgttcgtacgggtccgacccgaccgacggccctcccgggtacccttcccggtactcccgttaccgttcccctcccccgtacccgttccctacctcccttgtcccttaacg

SEQ ID NO: 108187 - DNA, 879 bp, Homo sapiens
  misc_feature: GYAE6OF01A1EJI.49.40.D07.1.454.CMB.1.raw
tcagagtcgagagacacgaccggtgctcgatttagtgatagagcgtaacaacagaggggctgggcctcaggaagcagcagtcgggggtgccgcagccatggcctggaccgctctccttctgacgcctccttgctcactttacaggttatgtggcctcctaacgagtgattcagcccacgtttccgtctcgagtcggccctggggaccaggaccggccaactaatttacccgtggtacggaccgggacgaaaggaaaccaaagttaccggaaaaattaagtaaattatttaccaacgttagggtaactaccgaaaacaaaaacggtcccgtacgggacccaacgggtccccctttggttttttacgggtacccttttaagtaccggtacgtaacctttcgaacgttcccgggaccccgtcgttacggggtaccttcccgtaggaacggtccgtaatttccgttccgtcgggcccttacccgtacggggtaccgggggaaacgaccggggtacccacttcgtacgaacctacgttaccacgtaccggaaccgggccccggaaggggtacccgacgtaggtaggacgggtacttacggaacttaactttacggtacgtaaccggaagggtaccgaaaaccggaaccgtaacccgtaaaacgtttcggtaaccaaggttaccgttacgggacggggtaaaccggaaccgttaaagttccggtacccccgttacgggtaccgggttaccaaccgggtaacccgtaaacgggtccccgttaccccggtcccccccgttagggtaccctacccggtttccccgttacccgggtttcccccccggtccctttccccggttaccctcccgttaccgtccggttacccg

SEQ ID NO: 108188 - DNA, 900 bp, Homo sapiens
  misc_feature: GYAE6OF01AD4FI.49.40.D07.1.454.CMB.1.raw
  modified_base (120)..(120): a, c, t, g, unknown or other
  misc_feature (120)..(120): n is a, c, g, or t
  modified_base (788)..(788): a, c, t, g, unknown or other
  misc_feature (788)..(788): n is a, c, g, or t
tcagagtcgagagacacgaccggtgctcgatttagtgatagagcgtaacaacagaggggctgggcctcaggaagcagcagtcgggggtgccgcagccatggcctggaccgctctccgttngacgcctcttgctcactttacgaggttatgtcgcctaccgtaacgagtcgattcagcctacgttccgtctcgaggtcggcccgtagggacaggaccggccaactaattaccgtgtacggaccggtcaagaactaacgtacgaaaattaagaacttattccagtaggtaatacaaacgaaaacgcctggacccgtaccggtccccgtttggttttacggttacctttagtacgtacgtaccgtttaccgtaacgtcccgggtaccccgtcggttacggggtaccttccccgttaggtaccggtaccggttaactttccgtaccggttcgggaccccgttaccccggtaaccggttaaccggggggaaccgtaccggggtaccctaaccgtttacccgtacggaacccttacggttacccaaccgttacccgggaaacccggggtacccccgggaacgggtacccggggtaaacgtacgggtacgggtaacggggtaccgtaacggtttaaccgtttaacggttttaacccgtacggttaaccggtacggggtaaccgaaaccggtaacccgtaaccctaacgtttacgtaccgtaagtttaccggttcggggaaccggtaaccggtaaccgttaacgttacccggttaccggtcccggtcgggtaaccnccgggacccgtaccgggtcccgtacccggttcccccgtcggttacctcccgttaccccgttcccgttaccccccgttacccttcccttcccgtcgttccccgccgttacccg

SEQ ID NO: 108189 - DNA, 646 bp, Homo sapiens
  misc_feature: GYAE6OF01DZ4JL.49.40.D07.1.454.CMB.1.raw
  modified_base (183)..(183): a, c, t, g, unknown or other
  misc_feature (183)..(183): n is a, c, g, or t
  modified_base (216)..(216): a, c, t, g, unknown or other
  misc_feature (216)..(216): n is a, c, g, or t
  modified_base (344)..(344): a, c, t, g, unknown or other
  misc_feature (344)..(344): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtntcagtgccctgggacagacggccacaattaccngtgacggcgagaacaatcgaaataagaatattcactgtatcaaacaaaagcctggccaggccccttgttttcggtacctttatcgagtacttcaatccggcccgctagggactcccgtgagcatttcnctggctccacggtcggggaacagggcccatctagaccatccatcgacgggccctaagggcgacgatggaggtctgacttattacgtgttacgaggtagaaacgaccgacctaaactttggtaccaagttagttacgggacgggagggtaaacctaaagtttcggaacccgttcgtacggggtacctaaccggacccgtaacgggcgttacccgggtccccccccgttgggtacccttacccgttccctttccggtaccccccctacccttacccctccgttttaccctcgttcccgtacccg

SEQ ID NO: 108190 - DNA, 828 bp, Homo sapiens
  misc_feature: GYAE6OF01A0P5O.49.40.D07.1.454.CMB.1.raw
  modified_base (185)..(185): a, c, t, g, unknown or other
  misc_feature (185)..(185): n is a, c, g, or t
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (324)..(324): a, c, t, g, unknown or other
  misc_feature (324)..(324): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtcggccctcctacgaagtgattcagccacgttccgtntcagtcggccctgggacagcgccataattccngtgaccggngaagaacatcgaaatagatattcatgtatacaacaaagcctaggccacggtcccttgttttcggtacctttagtcgagtacttcgaagtccggacccncgtgggctcccgtgagcgtaacttccgtcgtcgggtcctacccgaacggtcgggggaaaccacggggccctaacttccgtacggaaccctaacgtaccacgttaccggaaccggggtaccccgaggggaacccggttacggaacgttacgggacgggtaccttaacggttaccgtttaaaccgtttacggtaacggttaccggtaaccggggtttaacggaaaaccggtacccggtaaaccccgttaaaacggttttcgtaaccgtaaggtttaaccgggtttacccgggggaaccggggttaaaccgggtaaaccccttaaaacggtttcccgggaaccccggtttacccgtacgggggttcccaaccgggtaaaccccgtagggttccccgtacccggtacccccccggttgggtaaccccgttccccgttaaccgtttccccccggttaaccccctaccccggttccccttcctttaaccccgtctaccccgggttaaccg

SEQ ID NO: 108191 - DNA, 893 bp, Homo sapiens
  misc_feature: GYAE6OF01BHSLK.49.40.D07.1.454.CMB.1.raw
  modified_base (122)..(122): a, c, t, g, unknown or other
  misc_feature (122)..(122): n is a, c, g, or t
  modified_base (813)..(813): a, c, t, g, unknown or other
  misc_feature (813)..(813): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgancctcttgctctactttacgaggttatgtcgcctcctacgaagtgtattcacgtcctacgtttccgtctcgaggttcggccctgggaccacggaccggaccaactaacgtttaccgtggtacggaccggacgaacgtaaaaccaagttaaccggaaaaaattaaacggtaaactttaacgttttaccgaaccgtttagggtaaacttaaccaaaaaccgtaaaaaacgtcccgtacgggtacccgtaaccgggttcccccgttttagggtttttttaccggttaccctttttaacggtaccggtaacggtttaccttttaccgaaacgtttccccggggcccccgtacggttacggggtaaccttccccggttgggtaaccgtccgtttaacgtttcccgttaccggttccgggtccccgtttaacccggaaccggggtttaacccgggggaaacgacccgggggttaccccctaacgtttcccgtaaccggaaccctacgttaccaacggtttcccggaacccggggcccccggtaagggacccggtaaccggtagttacgggaacggttcgttaacgtacttacgttacgtacggtacgtacgggtacgaaacgaccgtaccttaaagttcgtatacttcggtacggacggtaacggtaactaacgttcggtaccctcggtacggtaccncgacccgtagcccgttacccgcccgttcgaccttccgttcgtcccttaccccgcccttacttccctccttccgtcgtccg

SEQ ID NO: 108192 - DNA, 767 bp, Homo sapiens
  misc_feature: GYAE6OF01A2VUR.49.40.D07.1.454.CMB.1.raw
  modified_base (89)..(89): a, c, t, g, unknown or other
  misc_feature (89)..(89): n is a, c, g, or t
  modified_base (231)..(231): a, c, t, g, unknown or other
  misc_feature (231)..(231): n is a, c, g, or t
  modified_base (429)..(429): a, c, t, g, unknown or other
  misc_feature (429)..(429): n is a, c, g, or t
tcagagtcgagagacacgaccggtgctcgatttagtgatagagcgtaacgaacagaggggctgggcctcaggaagcagcatcgggggtnccgcagccatggcctggaccgctctccttctgagcctccttgctcactttacaggttatgtcggcctcctacgaagtgattcagcccacgttccgtctcaggtcggcccgtgggacacggaccggccaactaagttacccgnggtcgaccggcgaagtaaacctaagtaccgaaaattacgaattacttccaagtggtatacaaacgaaacgcctacggcctacggtccccttagttttcggtacctttagtcgacgtactttcaaggttccggcccgtgtcgggactccccgtggacgcgtactttctacgttggccctaccgacggtacggggaaccncggggtcccacgtcgtcgaaccataccgatccgaccggtaccgagggaccgagtagacgtacggtcgtactaccgttaattacgtcgttaacggacggtacggaaacgtaccgtaaccttaacggttcgtactacgtttaacggttccggggaacgggttaccggggaaaccttaaacgttccgggttacccggttaccggtagggttacccgacggtaaccccgtaaacgggtccccggtaaccccgttcccccgggtacgggttaccctccggttaccctcccccggtttaccctaccccgttccccgtacccttccttacccgtccggttacccg

SEQ ID NO: 108193 - DNA, 974 bp, Homo sapiens
  misc_feature: GYAE6OF01AE0H9.49.40.D07.1.454.CMB.1.raw
  modified_base (211)..(211): a, c, t, g, unknown or other
  misc_feature (211)..(211): n is a, c, g, or t
tcagagtcgagagacacgaccggtgctcgatttagtgatagagcgtaacaacaggaggggctgggccctcaggaagcagcagtcggggggtgcccgcagccatggcctgggacccgctcctccttctgacgcccttccttgccttctacttttacgaggttatggtcggcccttcctaacgaagtgacttcacgccctaccgttcccgtcncaggtcggcccgtggggaccagaccggtaccaactaacttaccgtggtggaaccggcggaagaacaagtaccggaaaattaacgaattacttccaacgttaggttaactaacgaaaacccaaaacggtcccgtcgggtacccgacccgggttcccccttttagggttttttaccggttaacccgtttttagtaccggtaacgttacctttaacccgtaacggtccccgggtacccccggtaccggttaccggggtaaccttccccggtaggtaccggtaccggttaccgttttccgttccggtccggtcccggttaacccggaccggggttaacccgggggaaccggtacccgggcccgtaacccgttcgtaccccgtaacgtactaccgtacgtacccggggaacccgggcccgggacgggtaccgggaacggtacgtacgggtcggtacgtacgttaaccttaagttacccgttacgggtacgtaacgggtaccgggaaaccgtaacccgtaacccgttaacgtttacgtagttaccggtacgggttacggggaaccggggtaacgggtaaccgtaacggtttaccggtaccccgggttacggtacccgggtacccgtaaccggtaccccggaaccggtccccggttccccggtcccccggtacccggttacccgtaccccggtttccccgtttaccccccggttaccccccttacccccgttacccttaccccttcccttaacccgttcccggtaacccg

SEQ ID NO: 108194 - DNA, 850 bp, Homo sapiens
  misc_feature: GYAE6OF01CFP5W.49.40.D07.1.454.CMB.1.raw
  modified_base (90)..(90): a, c, t, g, unknown or other
  misc_feature (90)..(90): n is a, c, g, or t
  modified_base (94)..(94): a, c, t, g, unknown or other
  misc_feature (94)..(94): n is a, c, g, or t
  modified_base (123)..(123): a, c, t, g, unknown or other
  misc_feature (123)..(123): n is a, c, g, or t
  modified_base (254)..(254): a, c, t, g, unknown or other
  misc_feature (254)..(254): n is a, c, g, or t
tcagagtcgagagacacgaccggtgctcgatttagtgatagagcgtaacaacaggaggggctgggcctcaggaagcagcagtcgggggtnccgnagccagtcggcctggaccgctctccttcngacgtccctcttgctccactttacgaggttatggtcggccctaccgtacgaagtgattcacgccctacggtttccgctacgaggtcggcccgtggggaaccaggaccggaccctaactaacgtttacccgnggtacggaccgggtacgaaagaaactaaacgtacgaaaaataacggaattacgttacgaacgtttaggtaactaccgaaaacaaaacgccgtaggacccacggtaccccgtttggttttacggttaccctttaaggtccgtaacgtaaccgtttacgaacgttcccggtcccgacggttaccgggaccttccccgtggaacgtcgtacgttccgtcgtccggcctccggtaacggtacggggaaccgtacggggaccctacgtactaccgaacctacgttcaaccggttacggacccggacccggtaacggggccgaacggtaggtaccggaggtaccgtaacgtacgttaactttaccggtcgtacggtacggtaacggaacgtaccggtaacccttaacgtagttacaacggttaacggttccgggaaccgggtaacggaacccgttaaaggttcccggaaccggttaccgggtacgggtccaaaccgggtcccgtaaacccgggtcctaccccgggtaccccccttagggtccctacccgttcccgttcccggttaccccctccccggtactcccgtctacccgtcgtacccg

SEQ ID NO: 108195 - DNA, 676 bp, Homo sapiens
  misc_feature: GYAE6OF01AVX17.49.40.D07.1.454.CMB.1.raw
  modified_base (432)..(432): a, c, t, g, unknown or other
  misc_feature (432)..(432): n is a, c, g, or t
  modified_base (623)..(623): a, c, t, g, unknown or other
  misc_feature (623)..(623): n is a, c, g, or t
tcagagtcgagagacacgaccggtgctcgatttagtgatagagcgtaacaacagaggggctgggcctcaggaagcagcatcggggggtgccgcagccatggcctggaccgctctccttctgacgcctccttgctcactttacaggttatgtgcctcctacgaagtgattcagcctacgttccgtctcaggtcggccctgggacagacggccacaattacctgtgacggcgaagaacaatacgaaaataagaatattacacgtggtatacaaacaaaagcctaggaccacggtcccttaggttttcggttaccttttacgtcgaacgtacctttacaacgtccggacccgtcgtacgggactcccgtgacgcgtattctcgtcggtcctaccgaccggtacggggaaccgacgggccacctcgtacgacctanacagtaccgaacggcccgtagggacgaccgagtacggaggtctagtacttacttacgtgtaccgagggtccgaaaggacctacctaaacttcgactaagttacgttcgggacgggtaaggtaaccctaagttcgtacccgtcggtacggtaccaccgaccgaacggtcctcccggccccgttacgtacccncttcccgtccgttaccccctacccgttcccttacctcccgtcgtccgtacccg

SEQ ID NO: 108196 - DNA, 921 bp, Homo sapiens
  misc_feature: GYAE6OF01B3JE6.49.40.D07.1.454.CMB.1.raw
  modified_base (257)..(257): a, c, t, g, unknown or other
  misc_feature (257)..(257): n is a, c, g, or t
tcagagtcgagagacacgaccggtgctcgatttagtgatagagcgtaacaacaggaggggctgggcctcaggaagcagcagtcgggggtgccgcagccatcggcctggaccgcttccttccttctgctcccttcgttgctctactttacgaggttagtgtaccgtcctccgtaagtaaggtgtacttacgacgtccctacgttccgactacgtcgttccggccgtagggacacggaccgcctaaactacgtttaccnggtacggacggaacgaacgaaacctaagtaaaccaaagtaacgtaacttacgttactaggttacgtaacgtaacgaaaacgaaaccgtcccgtaacggtaccgtacccggttaccgtttcggtttttacggttaccttttacgtacgtaacgttacttaccgtaacggtccggtccgaccggtcggtcctaccggtagtacgtccgttacgtccgtccgtcggtccgtaccggttaacggggtaccggaaaccgtaccggggtaccacggttacccaacgtaaccctacgtacctaccggaaccggaccgggaccggtaccggaacgtaccggtaacggtacggacgggttactacggttaaacctttaggttaacgtaccgggttaacgaacgggttaaccgaaccggtacccgttaaaccgttacgtacggttaacgttacggtttaacgggaccggttaacggggtaaccgttaaccgttaaccggttaccggtaccgtttaccgggaccggtaaccggtacccgtaccgggtaccgttacccggttaccccgtaccccgttacccgtaacttcccccggttaacccgtcccccgttttaccccccgtaccggtttaccccttaccccgggtaccttttccccgggtacttacccccgggg

SEQ ID NO: 108197 - DNA, 960 bp, Homo sapiens
  misc_feature: GYAE6OF01D0KEJ.49.40.D07.1.454.CMB.1.raw
  modified_base (319)..(319): a, c, t, g, unknown or other
  misc_feature (319)..(319): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctccttgctcctactttacaggttatgtggcctcctacgaagtgattcagcctacgttccgtctcagtcggccctgggacagaccgccacaattcctgtcgacggcgaagaacaatacgaaaataagaatacgttcaagttgtatacaaacaaaacgcctaggccacggtccccttggttttcggtcctttaacncgtacgtactttcaagttcccgggcccgtcggtacgggacttcccgtaggaacggtccgtaatttccttaccgtcggtacctacccggtaaccgggtaccgggggaaaccgtacgggggacccctaccgttcgtaaccgaacccgtaactacgtaaccggtaccggaaccggggacccccggaacgggggaaccgtaaccggtaacgttacggggaaaccgggttcctaacggttaaaccttttaacgtttaacgttccgggtaacggttaccggggtaaaccggtaaaaccggtaaccccgttaaaccccgtaaaacggtttttcggtaaacctacgggtttaaaccgggtttccgggggtaaccggggtaaaccggggtaaaccccgtttaaaaagggtttcccggggtaaaccccccgggttttccgggttaccccggggggttaacctaaccccgggggtaccccccgggtaaaaacggttcccccggttacccccgggtccccccccggttttacggggtttacccccttaccccggtttacccccgggttttacccccgtttccccccccccggttaccccctttaccccggtttccccgtttccccgtttccccggttccccggttaacccggg

SEQ ID NO: 108198 - DNA, 532 bp, Homo sapiens
  misc_feature: GYAE6OF02HEYI9.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacgtcggggaacagggccactctgaccatcatcagggcccagggcgacgatgaggctgactattactgtcaggtcgaagacgccaaacttgtcatattcggcggagggaccaaagttcgaccgtctggtcagcccaggctcgccccctcggtccactctcgttcccaccctcctcctctcctcgacc

SEQ ID NO: 108199 - DNA, 532 bp, Homo sapiens
  misc_feature: GYAE6OF02F2HGC.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacgtcggggaacagggccactctgaccatcatcagggcccagggcgacgatgaggctgactattactgtcaggtcgaagacgccaaacttgtcatattcggcggagggaccaaattcgaccgtcctgggtcagcccaggctcgccccctggtccactctcgttccccacctcctctcctctcgtacc

SEQ ID NO: 108200 - DNA, 525 bp, Homo sapiens
  misc_feature: GYAE6OF02G35AO.49.40.D07.1.454.CMB.1.raw
  modified_base (335)..(335): a, c, t, g, unknown or other
  misc_feature (335)..(335): n is a, c, g, or t
  modified_base (513)..(513): a, c, t, g, unknown or other
  misc_feature (513)..(513): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaagcctggccaggcccctgtttggtcctttatcgagacttcaatcggcccgctgggatccctgagcgattcnctggctccacgtcggggaacagggccactctgaccatcatcagggcccagggcgacgatgaggctgactattactgtcaggtcgaagacgccaaacttgtcatattcggcggagggaccaaagttgaccgtctggtcagcccaggctcgcccctggtcactctgttcccgcccttccncctctctcgtac

SEQ ID NO: 108201 - DNA, 536 bp, Homo sapiens
  misc_feature: GYAE6OF02I96VN.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacgtcggggaacagggccactctgaccatcatcagggcccagggcacgatgaggctgactattactgtcaggtcgaagacgccaaacttgtacattagttcggcggagggaccaaagttgaccgtcgtgggtcagcccaggcctcggcccctcggtccactctcgttccccacctcctctctcctcgtacc

SEQ ID NO: 108202 - DNA, 540 bp, Homo sapiens
  misc_feature: GYAE6OF02GRTLG.49.40.D07.1.454.CMB.1.raw
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
  modified_base (412)..(412): a, c, t, g, unknown or other
  misc_feature (412)..(412): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccccctgttttggtcctttatcgagacttcaatcggcccgctgggatccctgagcgattctctggctccacgtcggggaacngggccactcngaccatcatcaggcccagggcgacgatgaggctgactattacngtcaggtcgaagacgccaaacttgtcatattcggcggaggaccaaagttgaccgtcctggtcagcccgaggcctacggccccctggtccacgtcctcgttccccgccctcctccgtcctcgtcgtacc

SEQ ID NO: 108203 - DNA, 527 bp, Homo sapiens
  misc_feature: GYAE6OF02FTLW9.49.40.D07.1.454.CMB.1.raw
  modified_base (524)..(524): a, c, t, g, unknown or other
  misc_feature (524)..(524): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacgtcggggaacagggccactctgaccatcatcagggcccagggcgacgatgaggctgactattactgtcaggtcgaagacgccaaacttgtcatattcggcggaggaccaaagttgaccgtcctgggtcagcccaggctggcccctcggtccactctgttcccaccctcctctcctcnctc

SEQ ID NO: 108204 - DNA, 523 bp, Homo sapiens
  misc_feature: GYAE6OF02GIQVY.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccccctgttttggtcctttatcgagacttcaatcggcccgctgggatccctgagcgattctctggctccacgtcggggaacagggccactctgaccatcatcagggcccagggcgacgatgaggctgactattactgtcaggtcgaagacgccaaacttgtcatattcggcggagggaccaaattcgaccgtctggtcagcccagctcgcccctcggtcactctgttcccgcctcctctctctctc

SEQ ID NO: 108205 - DNA, 523 bp, Homo sapiens
  misc_feature: GYAE6OF02G797Z.49.40.D07.1.454.CMB.1.raw
  modified_base (508)..(508): a, c, t, g, unknown or other
  misc_feature (508)..(508): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgtttggtcctttatcgagacttcaatcggcccgctgggatccctgagcgattctctggctccacgtcggggaacagggccactctgaccatcatcgagggcccagggcgacgatgaggctgactattactgtcaggtcgaagacgccaaacttgtacatattcggacggaggaccaaagttcgaccgtcgtggtcagccagctcgcccctcggcactctcgtcccncctcctctctctcgc

SEQ ID NO: 108206 - DNA, 525 bp, Homo sapiens
  misc_feature: GYAE6OF02G77FM.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccccctgtttggtcctttatcgagacttcaatcggcccgctgggatccctgagcgattctctggctccacgtcggggaacagggccactctgaccatcatcagggcccagggcgacgatgaggctagactattactgtcaggtcgaagacgccaaacttgtcatacttcggacggagggaccaaagttcgaccgtctggtcagcccagctgcccctggtcactctgtcccacctcctctctctcgtac

SEQ ID NO: 108207 - DNA, 530 bp, Homo sapiens
  misc_feature: GYAE6OF02GDY5L.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacgtcggggaacagggccactctgaccatcatcagggcccagggcgacgatgaggctgactattactgtcaggtcgaagacgccaaattgacatattcgggcggaggaccaaagttcgaccgtctgggtcagcccaggcctcgcccctggtccactctcgttcccaccctcctctctctcgtacc

SEQ ID NO: 108208 - DNA, 565 bp, Homo sapiens
  misc_feature: GYAE6OF02IEBN0.49.40.D07.1.454.CMB.1.raw
  modified_base (525)..(525): a, c, t, g, unknown or other
  misc_feature (525)..(525): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaaataagaatattcactggtatcaacaaaagcctggccaggcccctgttttggtcctttatcgagacttcaatccggcccgctgggactccctgagcgattctctggctccgacgtcggggaacacgggccactctgaccatcatcagggcccagggcgacgatggaggctgactattactgtcaggtcgaagacgaccaaacgttgtacatagttccgggacgggagggaaccaaagttcgaacccgttcgtgggtcacgcccaaggcctacgcccccgtcggtccnccgttctcgttccccgcccttcctcctcctcctccgtacc

SEQ ID NO: 108209 - DNA, 532 bp, Homo sapiens
  misc_feature: GYAE6OF02H5MNO.49.40.D07.1.454.CMB.1.raw
  modified_base (507)..(507): a, c, t, g, unknown or other
  misc_feature (507)..(507): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacaggttatgtggcctcctacgaagtgattcagccacgttccgtctcagtggccctgggacagacggccacaattacctgtgacggcgagaacaatcgaaataagaatattcactggtatcaacaaaaagcctggccaggcccctgttttggtcctttatcgagacttcaattcggcccgctgggatcccctgagcgattctctggctcacgtcggggaacagggccactctgaccatcatcagggcccagggcacgatgaggctgactattactgtcaggtcaagacgaccaaaacttgtacatagttcggacggagggaccaaattcgaaccgtcctgggtcagcccaggctcgcccctggtcactcngttcccacctcctcctctctctacc

SEQ ID NO: 108210 - DNA, 527 bp, Homo sapiens
  misc_feature: GYAE6OF02FF9LE.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaatagaatattcactggtatcaacaaaagcctggccaggccccctgttttggtcctttatcgagacttcaatcggcccgctgggatccctgagcgattctctggctccacgtcggggaacagggccactctgaccatcatcagggcccagggcgacgatgaggctgactattactgtcaggtcgaagacgccaaacttgtcatattcggcggagggaccaaagttgaaccgtctgggtcagcccaggctgccccctggtcactctgttcccaccctcctctctctcgtac

SEQ ID NO: 108211 - DNA, 571 bp, Homo sapiens
  misc_feature: GYAE6OF02HML2A.49.40.D07.1.454.CMB.1.raw
  modified_base (358)..(358): a, c, t, g, unknown or other
  misc_feature (358)..(358): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggactccctgagcgattctctggctccacgtcgggaacngggccactctgaccatcatcagggcccagggcgacgatgaggctgactattactgtcaggtcgaagcgacctaaacttgtacattacgttcgggacgggagggaacctaaagttcgaacccgttccgtagggtaccacggcccaagggcctccggcccccctcgggtccaccgttcgtcgttccccacccttcctcctccttcctccgtaccg

SEQ ID NO: 108212 - DNA, 531 bp, Homo sapiens
  misc_feature: GYAE6OF02G7TUX.49.40.D07.1.454.CMB.1.raw
  modified_base (513)..(513): a, c, t, g, unknown or other
  misc_feature (513)..(513): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacgtcggggaacagggccactctgaccatcatcagggcccagggcgacgatgaggctgactattactgtcaggtcgaagacgaccaaacttgtacatacttcggacggaggaccaaagttcgaccgtcgtggtcagcccaggctcgcccctggccactctcgttcccnccctcctctctctcgtac

SEQ ID NO: 108213 - DNA, 616 bp, Homo sapiens
  misc_feature: GYAE6OF02HT9WB.49.40.D07.1.454.CMB.1.raw
  modified_base (316)..(316): a, c, t, g, unknown or other
  misc_feature (316)..(316): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaaataagaatattcactggtatcaacaaaagcctggccaggcccctgttttggtcctttatcgagacttcaatcggccnctggatccctgagcgattctctggctcacgtcggggaacagggccactctgaccatcatcagggcccagggcgacgatgaggctgactattactgtcaggtcgaagacgacctaaacgttgtcaattagttccgggacggagggaccctaaaagtttcggaaccgttcccgtagggtaccacggaccccgaagggcctcccgggccccccttccgggtccaacccgtttccgttacccggtttccccccaacccccgttcccctttacccgttccccgttacccgtacccgttaaccccg

SEQ ID NO: 108214 - DNA, 532 bp, Homo sapiens
  misc_feature: GYAE6OF02F4SCX.49.40.D07.1.454.CMB.1.raw
  modified_base (521)..(521): a, c, t, g, unknown or other
  misc_feature (521)..(521): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccccctgttttggtcctttatcgagacttcaatcggcccgctggggatccctgagcgattctctggctccacgtcggggaacagggccactctgaccatcatcagggcccagggcgacgatgaggctgactattactgtcaggtcgaagacgccaaattgtcatattcggcggaggaccaaattgaccgtcctgggtcagcccaggctcggcccctcggtcacctctgttccccaccctcctcnccttctcgtac

SEQ ID NO: 108215 - DNA, 538 bp, Homo sapiens
  misc_feature: GYAE6OF02FVP8W.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacgtcggggaacagggccactctgaccatcatcagggcccagggcgacgatgaggctgactattactgtcaggtcgaagacgaccaaacttgtcatattcggcggagggaccaaagttgaccgtcctgggtcagcccaggcctcgccccctcggtccacttcctcgttccccaccctcctctcctcctcgacc

SEQ ID NO: 108216 - DNA, 540 bp, Homo sapiens
  misc_feature: GYAE6OF02I8CFP.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactgtatcaacaaaagcctggccaggccccctgttttggtcctttatcgagacttcaatcggcccgctgggatccctgagcgattctctggctccacgtcggggaacagggccactctgaccatcatcagggcccagggcgacgatgaggctgactattactgtcaggtcgaagacgccaaacttgtacatattcggcggaggaccaaagttcgaccgtctggtcagacccaggcctcggccccctggtcctacgtcctcgttccccacccttcctcctctcctcgtacc

SEQ ID NO: 108217 - DNA, 522 bp, Homo sapiens
  misc_feature: GYAE6OF02HNV9E.49.40.D07.1.454.CMB.1.raw
  modified_base (493)..(493): a, c, t, g, unknown or other
  misc_feature (493)..(493): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactgtatcaacaaaagcctggccaggccccctgtttggtcctttatcgagacttcaatcggcccgctgggatccctgagcgattctctggctccacgtcggggaacagggccactctgaccatcatcagggcccagggcgacgatgaggctgactattactgtcaggtcgaagacgccaaacttgtcatattcggcggagggaccaaattgaccgtcgtggtcagccagctcgcccctcggcnctctcgttcccaccctcctctctctcgtc

SEQ ID NO: 108218 - DNA, 590 bp, Homo sapiens
  misc_feature: GYAE6OF02IKWKH.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagtctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacgtcggggaacagggccactctgaccatcatcaggcccagggcacgatgagctgactattactgtcaggtcgaaagacgacctaaacttgtacattacgttcgggacggtacgggaacctaaaagttcggacccgttccgtagggtccaagccccgaagggtccgtaccggccccccgttcgggtccctaaccgttccgtccggtttcccccgcccttcccttccgtcccttcctccgtacccg

SEQ ID NO: 108219 - DNA, 525 bp, Homo sapiens
  misc_feature: GYAE6OF02HNMID.49.40.D07.1.454.CMB.1.raw
  modified_base (327)..(327): a, c, t, g, unknown or other
  misc_feature (327)..(327): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactgtatcaacaaaagcctggccaggcccctgtttggtccttatcgagacttcaatcggcccgctgggactccctgngcgattctctggctccacgtcggggacagggccactctgaccatcatcaggcccagggcagatgaggctgactattactgtcaggtcgaagcgaccaaacttgcatattccggacggaggaccaaattcgaccgtcgtggtcagcccgagcctcgccccctggtctacctctcgttcccgccctcctctcctctcgtc

SEQ ID NO: 108220 - DNA, 602 bp, Homo sapiens
  misc_feature: GYAE6OF02JC8B1.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacgcgagaacaatcgaaatagaatattcactgtatcaacaaagcctggccaggcccctgtttcggcctttatcgagacttcaatcggcccgctgggactccctgagcgattctctgctccacgtcggggaacagggccactctgaccatcatcgaggcccagggcacgatgagctagactatactgtcgaggtacgaagtaccgacctaaacgttgtacaacgttagttcgggacggtaacgggacctaaagttcggaacccgttccgtacgggtaccaacggtaccccgaagggtcctaccggtccccccgttacggtaccaaccgttccgttaccgttcccccggtcccttcccgttaccgtcccttcctaccgtacccg

SEQ ID NO: 108221 - DNA, 553 bp, Homo sapiens
  misc_feature: GYAE6OF02G9U1S.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccccctgttttggtcctttatcgagacttcaatcggcccgctgggatcccctgagcgattctctggctccacgtcggggaacagggccactctgaccatcatcgagggcccagggcgacgatgaggctgactattactgtcaggtcgaagacgccaaacttgtacatagttcggacggacgggaccaaagttcgaccgttccgtgggtccagcccaaggcctcgcccccgtcggtccacctcgtcgttccccgcccttcctcctcctcctcgtacc

SEQ ID NO: 108222 - DNA, 621 bp, Homo sapiens
  misc_feature: GYAE6OF02HG4V3.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccccttgttttcggtcctttatcgagtacttcaatccggccccgcgtgggactccctgacgcgattctctggcctccgacggtcggggaacacgggccactctcgaccactcactcgacgggcccgagggcgacgatggaggctgacttattactgtcgaggtacgaagaccgacctaaacttgtacattacgttcgggacgggacggtaacctaaagttcgacccgttccgtcgggtaccacggacccgaagggcctcccggtcccccgtcgggttacccaccgttcccttaccggtttacccccaccccgttcccttaccctccttccgtcccgtaacccg

SEQ ID NO: 108223 - DNA, 557 bp, Homo sapiens
  misc_feature: GYAE6OF02F8OU3.49.40.D07.1.454.CMB.1.raw
  modified_base (359)..(359): a, c, t, g, unknown or other
  misc_feature (359)..(359): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacggtcggggaacngggccactctgaccatcatcgagggcccagggcgacgatgaggctgactattactgtcaggtcgaagaccgaccaaacttgtactatagttcgggacggagggaaccaaagttcgaccgtccgtgggtacacgcccaggcctcgcccccgtcggtccaccgttcgtcgttccccacccttccctctcctcctcgtacc

SEQ ID NO: 108224 - DNA, 527 bp, Homo sapiens
  misc_feature: GYAE6OF02FPZ3Q.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccccctgtttggtcctttatcgagacttcaatcggcccgctgggatccctgagcgattctctggctccacgtcggggaacagggccactctgaccatcatcagggcccagggcgacgatgaggctgactattactgtcaggtcgaagacgaccaaacttgtcatattcggcggagggaccaagttgaccgtctggtcagcccaggctcgcccctggtccactctcgttcccaccctcctctctctcgtcc

SEQ ID NO: 108225 - DNA, 535 bp, Homo sapiens
  misc_feature: GYAE6OF02FWB7F.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacgtcggggaacagggccactctgaccatcatcagggcccagggcgacgatgaggctgactattactgtcaggtcgaagacgaccaaacttgtcatattcgggcggagggaccaaagttgaccgtcctgggtcagcccaggctcgccccctcggtcactctcgttcccacccttcctctcctctcgtacc

SEQ ID NO: 108226 - DNA, 566 bp, Homo sapiens
  misc_feature: GYAE6OF02GOD9K.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctaggccaggccccctgttttggtcctttatcgagacttcaatcggcccgctgggactccctgagcgattctctgctccacggtcgggaacagggccactctgaccatcatcagggccagggcgacgatgagctgactattactgtacaggtcgaaagaccgacctaaacgttgtacattaacgttcggacgggaggaacctaaagttcgaccgtcctgggtcacgacccaggcctccggccccctggtaccacccttccgtccgttccccgcccttccctcctccttcgtcctaccg

SEQ ID NO: 108227 - DNA, 556 bp, Homo sapiens
  misc_feature: GYAE6OF02FV4FE.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacaggttatgtggcctcctacgaagtgattcagccacgttccgtctcagtggccctgggacagacggccacaattacctgtgacggcgagaacaatcgaaataagaatattcactggtatcaaacaaaagcctggccaggcccctgttttggtcctttatcgagtacttcaatccggcccgctgggactccctgagcgtattctctggctccacgtcggggaacagggccactctgaccatcatccagggcccagggcgacgatgaggctgactattactgtcgaggtacgaagacgacctaaacttgtacatattcggacggaggaccaaagtcgaccgtcctaggtccacgacccaggccgtccgtcccccgtggttccaccttccgtcgttccccgccctcctctctcctcgtacc

SEQ ID NO: 108228 - DNA, 551 bp, Homo sapiens
  misc_feature: GYAE6OF02G74CW.49.40.D07.1.454.CMB.1.raw
  modified_base (535)..(535): a, c, t, g, unknown or other
  misc_feature (535)..(535): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggccccgctgggactcccgtgacgcgattcctctggcctccgacggtcggggaacacggggccactctgaccatcatcgacgggcccaggggcacgatggaggctgactattactgtcagggtcgaagaccgaccaaattgacattagttcgggcggaacgggaccaaagttcgacccgtcgtgggtcacgccaggcctcgccccttggcctcgtctcgttcccncctcctctcctctctc

SEQ ID NO: 108229 - DNA, 620 bp, Homo sapiens
  misc_feature: GYAE6OF02GWQEC.49.40.D07.1.454.CMB.1.raw
  modified_base (270)..(270): a, c, t, g, unknown or other
  misc_feature (270)..(270): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgaccggcgagaacaatcgaaaataagaatattcaactggtatcaacaaaancctaggccacggcccctgttttggtcctttatcgtagacttcaatcggcccgcgtgggtactccctgagcgattctctggctccgacgtcggggaacacgggccaactctacgacctaactcgaactccaacggggccccaaggggcggaaccgaatcggaaggcctagacttattacgtagtcgaacggtcgaaacggaccgaccctaaattcgtcaattagttcgggacggaagggacctaaagtcgtacccggacttcggggacacggcccgaaggtccgtcggcccccttacggtcctaactccgttcgttaccccacccttccctccctccttcctacccgtccg

SEQ ID NO: 108230 - DNA, 564 bp, Homo sapiens
  misc_feature: GYAE6OF02HRKTC.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacaggttatgtggcctcctacgaagtgattcagccacgttccgtctcagtcggccctgggacaggacggccacaatttacctgtcgacggcgagaacaatcgaaaataagaatattcactgtatcaacaaaagcctggccaggcccctgttttggtcctttatcgagacttcaagtcggcccgctgggactccctgacgcgtattctctggtctccgacgtcgggggaacaggggcccactctgaccatcatcgaggcccagggcgacgatggacgctgactattactgtcaggtcgaagcgacaaacttgactatatcggaggaggaccaaattcgaccttcgtggtcacggcccaggtcctcggccccttcggtaccaccttccgtcgttcccccaccgttcctcccgttcttcctaccgtaccg

SEQ ID NO: 108231 - DNA, 661 bp, Homo sapiens
  misc_feature: GYAE6OF02GJ1AX.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgtttggtcctttatcgagacttcaatcggcccgctgggatccctgagcgattctctggctccacggtcggggaacagggccactctgaccatcatcgagggcccagggcgacgagtgaggctgactattactgtcaggtacgaagaccgacctaaacttgtactagttacgttccgggacgggtaacgggaaccctaaaagtttcggaacccggttcccgtacggggttaccaacgggtacccccgtaaggggtcccttacccgggtccccccccgttacgggttacccctacccgtttcccggtttcccggtttaccccccgtaaccccccgtttccccgtttacccttccccgtttacccgttcccggttaaccccg

SEQ ID NO: 108232 - DNA, 563 bp, Homo sapiens
  misc_feature: GYAE6OF02G7IQ3.49.40.D07.1.454.CMB.1.raw
  modified_base (369)..(369): a, c, t, g, unknown or other
  misc_feature (369)..(369): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccccctgttttggtcctttatcgagacttcaatcggcccgctgggatccctgagcgattctctggctccacgtcggggaacagggccactcngaccatcatcacgggcccagggcgacgatggaggctgacttattactgtcaggtcgaagacgaccaaacttgtacattagttcgggcggacgggaacctaaagttcgaccgttccgtgggtccacgcccgaggcctccggccccctcggtccaccgttctcgttcccctaccctccctcctccttcctccgtcc

SEQ ID NO: 108233 - DNA, 603 bp, Homo sapiens
  misc_feature: GYAE6OF02JYQ6Z.49.40.D07.1.454.CMB.1.raw
  modified_base (216)..(216): a, c, t, g, unknown or other
  misc_feature (216)..(216): n is a, c, g, or t
  modified_base (311)..(311): a, c, t, g, unknown or other
  misc_feature (311)..(311): n is a, c, g, or t
tcagagtcgagagacacgaccggtgctcgatttagtgatagagcgtaacaacagagggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattaccngtgacgcgagacaatcgaaataagatatcactgtatcaacaaagctaggccaggtcccctgtttcggtcctttatcgtagacttcaatcggcccncgtagggacttccccgtgacgcgaacttctcgtggcctccgacgtccggggaactagggccctatcgcgtaccatcatcgaggcccagggcacgagtgacggcgtagactagttactacgtcgaggtcgaaaggaccgacgaaaccttgacctatacgttcggacggtaacgggacctaaagttcggtaaccgtccggtaggtaccacgacccgtacggccgttccggcccccttggtccaaccgttccgttccgttaccccacccgttcccttcctaccctcctccgtacg

SEQ ID NO: 108234 - DNA, 596 bp, Homo sapiens
  misc_feature: GYAE6OF02G7NHN.49.40.D07.1.454.CMB.1.raw
  modified_base (361)..(361): a, c, t, g, unknown or other
  misc_feature (361)..(361): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggactcccgtgagcgattctctggctccgacgtcggggaacngggccactctcgaccatcatcgacgggcccagggcgacgagtggagctgacttatactgtcgaggtcgaagaccgacctaaacttcgtacagttacgttccgggacggtacgggaacctaaagttcgacccgttccgtgggtaccgacgcccgaacggcctccggcccccgttggtcctaccttcctccgttaccccgtaccccttcccgttccctaccgttcctaccgtacccg

SEQ ID NO: 108235 - DNA, 546 bp, Homo sapiens
  misc_feature: GYAE6OF02GX3UE.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactgtatcaacaaaagcctggccaggcccctgtttggtcctttatcgagacttcaatcggcccgctgggactccctgagcgattctctggctccacggtcggggaacagggccactctgaccatcatcgacgggcccagggcgacgatggagctgacttattactgtcaggtacgaagcgacctaaattgtacagtagttcggacggacggaaccaagttcgaccgtcgtggtcacgcccgagcctcgccccctggtacactcctcgttccccacccgtcctcctctccgtcctac

SEQ ID NO: 108236 - DNA, 555 bp, Homo sapiens
  misc_feature: GYAE6OF02H9Z5N.49.40.D07.1.454.CMB.1.raw
  modified_base (374)..(374): a, c, t, g, unknown or other
  misc_feature (374)..(374): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaaataagaatattcactggtatcaacaaaagcctggccaggcccctgttttggtcctttatcgagacttcaatcggcccgctgggatccctgagcgattctctggctccacgtcggggaacagggccactctgaccntcatcagggcccagggcgacgatggaggctgacttattactgtcaggtcaagacgccaaacttgacatagtttcgggacgggacggaacctaaagttcgaccgtccgtgggtccagtcccaagggcctacggccccctcggtccaccgtctcgttccccaccctcctcctctcctcgtacc

SEQ ID NO: 108237 - DNA, 575 bp, Homo sapiens
  misc_feature: GYAE6OF02IFDSH.49.40.D07.1.454.CMB.1.raw
  modified_base (317)..(317): a, c, t, g, unknown or other
  misc_feature (317)..(317): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgntgggactccctgagcgatttctctggcctccgacggtcggggaacacgggccactctcgaccatcatcgacggcccgagggcgagagtggaggtctagacttatactgtacaggtacgaaagaccgactaaacttgactatacgttcgggacgggacgaacttaaagtcggtaccgtcgtggtaccacgcccgaggcctccgccccgtcggtaccaccttcgtccgtccccctaccttccctctccttccgtcgtacc

SEQ ID NO: 108238 - DNA, 586 bp, Homo sapiens
  misc_feature: GYAE6OF02J1RZK.49.40.D07.1.454.CMB.1.raw
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (426)..(426): a, c, t, g, unknown or other
  misc_feature (426)..(426): n is a, c, g, or t
tcagagtcgagagacacgaccggtgctcgatttagtgatagagcgtaacaacagaggggctgggcctcaggaagcagcatcgggggtgccgcagccatggcctgggaccgctctccttctgagcctccttgctcactttacaggttatgtggcctcctagagtgattcagcccacgttccgtctcaggtggccctgggacaggacggccanaattacccngtgaccggcgagaacatcgaaataagaatattcactggtatcaacaaagcctagccaggccccctgtttcggtcctttatccgtagaccttcaatccggcccgcgtcgggtactccccgtgacgcgtattctcgtggcctaccgacggtccggggaacacgggccctactcgtacgaccatcatccgacgggtcccagggcgacgntcggaggctgactattacgtgtcgtaggtcgaacgacgacctaacgttgtcatacgtcggacggaggtacctaaagtcgaccgtccgtaggtcacgccgacggctccggccccgtcgtcaccttcctccgttcccacccgtcctccctctcctccgtacc

SEQ ID NO: 108239 - DNA, 523 bp, Homo sapiens
  misc_feature: GYAE6OF02GQXC3.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccccctgttttggtcctttatcgagacttcaatcggcccgctgggatccctgagcgattctctggctccacgtcggggaacagggccactctgaccatcatcagggcccagggcacgatgaggctgactattactgtcaggtcgaagacgcaaacttgcatattcggcggaggaccaaagttcgaccgtctggtcagcccaggctcgcccctggtcactctcgttcccgcctcctctctctcgtac

SEQ ID NO: 108240 - DNA, 901 bp, Homo sapiens
  misc_feature: GYAE6OF02J3OOI.49.40.D07.1.454.CMB.1.raw
  modified_base (113)..(113): a, c, t, g, unknown or other
  misc_feature (113)..(113): n is a, c, g, or t
tcagagtcgagagacacgaccggtgctcgatttagtgatagagcgtaacaacagaggggctgggcctcaggaagcagcagtcgggggtgccgcagccagtcggcctgggaccnctctccttcgtgacgtccttccttgccttactactttacgaggtttatcggtcggtcccttacctaacggtaagttgtacttccaggtccctaccgtttccgtctcacggtcggacccttggggacacggaccggccctaaacgtaactttccgtggtacggaccgggacgaaacgtaaacctaaagtaaccggaaaattaacggaaacttcgttaccaacggtttaaggtaacctaacaaaacgaaaacggtcccgtacggacccgtaaccggtccccgtttggtttttaccggttacccgttttaacggtccgtaacggttaccttaccgtaaacggtccccgggtccccgtacggttacggggtaacccttccccggtaggaccgtaccggtacctttccgttccggtccgggtaccctttacccggacccgggggttaacgggggaacccgtacggggtaccccttaccgttacccggtaaccggtaaacccacttacccggttaacgacccggggtaacggggaccccgtacggggtaccgacggtacggacggtaccggtcgtaacgtacttacggtacctggtaccgtaggtaccgacgaccgtactaaacgttctaacgtagttacgtcgggaaccgtacggaactaacggttccggacctccggtagacccgtacggacccgtacggtccttcccggtaccccgtgttaacccgtccgttcccgttacccggttcccccgttccctcccgtttccgttccccgtacgtcccggtacccg

SEQ ID NO: 108241 - DNA, 666 bp, Homo sapiens
  misc_feature: GYAE6OF02IPFO9.49.40.D07.1.454.CMB.1.raw
  modified_base (210)..(210): a, c, t, g, unknown or other
  misc_feature (210)..(210): n is a, c, g, or t
  modified_base (325)..(325): a, c, t, g, unknown or other
  misc_feature (325)..(325): n is a, c, g, or t
  modified_base (371)..(371): a, c, t, g, unknown or other
  misc_feature (371)..(371): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtcggccctgggacagacggccanaattacctgtgacggcgagaacaatcgaaataagaatattcactggtatcaaacaaaagcctaggccaggccccttgttttcggtcctttatcgagtacttcaactccggcccgntgggactccctgagcgtattctctcggctccgacggtcggggaacncgggcctacgtctcgaccatcactcgaacgggccagggccgacgagtcggaggtctcgtaactactacttggacgtaggtacgaaagtaccggaccctaaaacgttcgtactaacgttacggttaccgggacgggaacgggtaaccctaaagtttccggaacccgtttcccgtggggtaacccacggtcccgaacggtccgttacccggcccccggttcggttacccacccgttccgtttaccggttccccccctaccgtttccccttaccgttcccgttacccgtccgtacccg

SEQ ID NO: 108242 - DNA, 595 bp, Homo sapiens
  misc_feature: GYAE6OF02JJTOE.49.40.D07.1.454.CMB.1.raw
  modified_base (414)..(414): a, c, t, g, unknown or other
  misc_feature (414)..(414): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaatagaatatcactgtatcaacaaaagcctaggccaggcccctgtttcggtcctttatcgagtacttcaatcggacccgcgtgggactccctgagccgatctctggctccacggtcgggaacagggccacgtcgtcgaccatccgatccgagggcccctagggcgacgatggagtcngtactatacgtgtacaggtcgaaagacgaccctaaacgttgtacagttacgtcgggacggagggaaccctaaagttccggaccgtccgtagggcagccccgaggtcctccggacccccgttggtacctacccgtcgttccgttaccccaccccgttccgttcctcccttccggtcctaccg

SEQ ID NO: 108243 - DNA, 624 bp, Homo sapiens
  misc_feature: GYAE6OF02HDKK3.49.40.D07.1.454.CMB.1.raw
  modified_base (303)..(303): a, c, t, g, unknown or other
  misc_feature (303)..(303): n is a, c, g, or t
tcagagtcgagagacacgaccggtgctcgatttagtgatagagcgtaacaacgagaggggctgggcctcacggaagcagcatcgggggtgccgcagccatggcctggaccgctctccttctgacgcctccttgctcactttacaggttatgtggcctcctacgaagtgattcagcccacgttccgtctcagtggccctgggacagacggccacaattacctgtgacggcgagaacaatcgaaaataagaatattcactggtatcaaacaaaagcctggccaggcccctgttttggtcctttancgagtacttcaatccggcccgcgtgggactcccctgacgcgacttctctggctccgacggtcggggaacagggccactctgaccatccatcgacggcccgagggccgacgatggaggctagactattacgtgtcgaggtacgaagaccgacctaaacgtttgactagttacgttccgggacgggtaacgggaacctaaagttcggaacccgttccggtacgggtaccacgtacccgacggccttcccggcccccgtcggtaccctaccgttccgttcccgttcccccgtccccttccctccttcccgttacctccgtaccg

SEQ ID NO: 108244 - DNA, 713 bp, Homo sapiens
  misc_feature: GYAE6OF02F8ZGL.49.40.D07.1.454.CMB.1.raw
  modified_base (114)..(114): a, c, t, g, unknown or other
  misc_feature (114)..(114): n is a, c, g, or t
tcagagtcgagagacacgaccggtgctcgatttagtgatagagcgtaacgaacagaggggctgggcctctaggaagcagcatcggggggtgccgcagccactggcctaggaccnctctccttctgagcctacttcgctcactttacaggttatgtcggcctccgtaacgaagtcgattcgagccctacgtttccgtctcgagtggccctgggacagacggccacaacttacctgtgacggcgaagaacatcgaaataagaagtattcacgtggtaatacaacaaagcctggaccacggtccccttgttttcggtcctttagtcgtagtacttacaacgtcggcccgcgtagggtactcccgtgacgcgtagttctcgtcggcctccgaccggtacgggggaaactcggggtccacgttcgtacgaccgtaatcaacgtaccgaacgggcccgaggggtccgaacgagtacggaacggtccgtagtaacgttaactttacgtggtaccgagggttaccgaaacgaccgtaccgtaaacgtttcgggtactacgttacgttcgggacggtaacgggaaccctaaaggttcgaaccgttcgtagggttaccacgtacccgaagggcccgtaccggccccccgttaggtaccccttaaccgttccgttaccggtttacccccacccgttcccttacgttcccttccgtaccgtaccg

SEQ ID NO: 108245 - DNA, 654 bp, Homo sapiens
  misc_feature: GYAE6OF02IND5E.49.40.D07.1.454.CMB.1.raw
  modified_base (369)..(369): a, c, t, g, unknown or other
  misc_feature (369)..(369): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatatcactggtatcaacaaagcctggccaggccccttgttttcgtcctttatcgagacttcaagtccgggcccgcgtggggactcccgtgacgcgattctcgtggctccgacggtacggggaacncgggcccactctcgaccatcatcgacgggcccagggcacgatggaggctagacttattacgtgtcaggtcgaagacgacctaaacgttcgtacattacgttcgggacgggtacgggaacctaaagttcggaacccggtttccgtcggggttaccacggaccccgaacgggtcccttacccgggcccccgttaccggggttccctaaccccgtttcccgtttcccggtttaccccccctaaccccgtttccccgttacccttacccgtttcccgtaccggtacccg

SEQ ID NO: 108246 - DNA, 678 bp, Homo sapiens
  misc_feature: GYAE6OF02HT3OF.49.40.D07.1.454.CMB.1.raw
  modified_base (261)..(261): a, c, t, g, unknown or other
  misc_feature (261)..(261): n is a, c, g, or t
  modified_base (361)..(361): a, c, t, g, unknown or other
  misc_feature (361)..(361): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtcgcctgggacaggacggccaacaattacctgtgacggcgagaacaatcgaaataagaatattcactgatcaanaaaagcctggccaggcccctgtttcggtcctttatcgagtacttcaatccggccgacgtggactccctgagcgattctctggcctcgacgtcggggaacngggccactctcgaccatcatcgacgggccagggcgacgagtggaggctaggtacttaagttactgttcagggtaccgaaagaccgacctaaaacgttgtaccagttacgtccgggacgggaagggtaaccctaaaagttccggtaacccgtccggttacgggtacgaccgggtaccccaagggtcccgtttcccggaccccccccgttacgggttacccctaaccggtttaccccctttcccgggtttaacccccccgtaccccccgtttaccccgtttccccgtttacccctttccccggttaccggtaacccccg

SEQ ID NO: 108247 - DNA, 624 bp, Homo sapiens
  misc_feature: GYAE6OF02JGXP7.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagatattcactgtatcaacaaaagcctggccaggccccctgtttggtcctttatcgagacttcaatcggcccgctgggatccctgagcgattctctggctccacgtcggggaacagggccactctgaccatcatcagggcccagggccagatcgaggctgactatacctgtcaggtcgaaagacgacccgaaacttcgtcaacttagttaccgggtccgggaacggggtaaccctaaagtttcggaaccccgttccgtaggggtcccaagcccccgtaaggggcctaccggtccccccccggtcggttaccgaacccgttccgtttccggtttaccccccggccccctttacccgtccctttcccgttccttacccgtacccg

SEQ ID NO: 108248 - DNA, 672 bp, Homo sapiens
  misc_feature: GYAE6OF02HZZRB.49.40.D07.1.454.CMB.1.raw
  modified_base (217)..(217): a, c, t, g, unknown or other
  misc_feature (217)..(217): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggcctgggacagacggccaacaattaccngtgacggcgagaacaatcgaaaataagaattattcattggtatacaaacaaaagcctggccaggtcccccttggttttcggtccttttatccgagtaccttacaaacgttccgggcccgtcgtcgggactccccgtgacgcgtattcctcgtcggcctccgacggtcggggaaccacggggccactcgtcgacctatacatcgacgggcccagggccgaacgatggacggtctagtacttacttaacgtgtaccgagggtacggaaacgaccgaacctaaacttggtaccaagttacgttccgggacgggaacgggtaaccctaaaggttcgacccggttccgacgggttaccacgggacccctaagggcccttaccggccccccgttcggtaccctaccgttccgttacccgttcccccggccccttcccgttccctcccttcctcccgtaccg

SEQ ID NO: 108249 - DNA, 571 bp, Homo sapiens
  misc_feature: GYAE6OF02IKH7S.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccccctgttttggtcctttatcgagacttcaatcggcccgctgggatcccgtgagcgattctctggctccgacgtcggggaacagggccactctgaccatcatcgagggcccagggcgacgatgaggctgactatactgtcaggtcgaagacgcctaaacttgtacagttagttcggacgggaggacctaaagttcgacccgttccgtgggtccacggcccgaggcctaccggcccccgttacggtccaccttccgttccgttccccacccgttccctcctcctcctccgtacc

SEQ ID NO: 108250 - DNA, 622 bp, Homo sapiens
  misc_feature: GYAE6OF02GDA1L.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggactccctgagcgattcctctggcctccgacgtcggggaacagggccactctcgaccatcatcgacgggcccagggcgacgatgagctgacttattactgtcaggtcgaaacgaccgacctaaacttcgtacagttacgttcggaaccgggagggaaccctaaagttcgaacccgttccgtcgggtaccacggaccccaagggtcctccggtccccccttccgggttcctaacccgttcccgttacccggtttccccccggtccccttccccgttcccgttcccttcccgtcccgtaacccg

SEQ ID NO: 108251 - DNA, 547 bp, Homo sapiens
  misc_feature: GYAE6OF02FZONO.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatacaacaaaagcctggccaggcccctgttttggtcctttatcgagacttcaactcggcccgctgggactccctgagcgtattctctggctccacggtcggggaacagggccactctgaccatcatcgacggcccagggcgacgatggagctgactattactgtcaggtcgaagacaccaaacttgactatacgttcgggacggtacgggacctaagttcgaaccgtcgtgggtcacgcccaggctcgcccctcggtcacctcgtccgtcccgccctcctctcctctcgtc

SEQ ID NO: 108252 - DNA, 606 bp, Homo sapiens
  misc_feature: GYAE6OF02GL9BN.49.40.D07.1.454.CMB.1.raw
  modified_base (337)..(337): a, c, t, g, unknown or other
  misc_feature (337)..(337): n is a, c, g, or t
  modified_base (358)..(358): a, c, t, g, unknown or other
  misc_feature (358)..(358): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattcnctggctccacgtcggggaacngggccactctgaccatcatcagggcccagggcgacgatgaggctgactatactgtcaggtcgaagacgaccaaacttgtacatagttcgggacggacgggacctaaagttcgaaccgttccgtggggtaccacggaccccgaaggcctaccggccccccgttacgggtacccaaccgtttcccttaccggtttcccccctaacccccgtttccccttacccgttcccttacccgtcccgttaaccccg

SEQ ID NO: 108253 - DNA, 781 bp, Homo sapiens
  misc_feature: GYAE6OF02JNYWD.49.40.D07.1.454.CMB.1.raw
  modified_base (147)..(147): a, c, t, g, unknown or other
  misc_feature (147)..(147): n is a, c, g, or t
  modified_base (212)..(212): a, c, t, g, unknown or other
  misc_feature (212)..(212): n is a, c, g, or t
  modified_base (214)..(214): a, c, t, g, unknown or other
  misc_feature (214)..(214): n is a, c, g, or t
  modified_base (236)..(236): a, c, t, g, unknown or other
  misc_feature (236)..(236): n is a, c, g, or t
  modified_base (384)..(384): a, c, t, g, unknown or other
  misc_feature (384)..(384): n is a, c, g, or t
tcagagtcgagagacacgaccggtgctcgatttagtgatagagcgtaacaacagagggctgggcctcaggaagcagcagtcggggtgccgcgagccatggcctggaccgctctccttctgacgcctccttgctcactttacaggttntgtgcctctacgagtgattcagccacgttccgtctcagtcggccctggacagcggccacattccngngacggcagaacaatcgaaatanatatcactgtatacaacaaagcctggaccaggcccctgttttcgtcctttatcgtagtacttcaactcggcccgcttacggggacttccccgtgtaacgccgtaatttccgtcgtcgggtcctcccgaacggttccgggggtaaaccncggggtaccccaccgttacgtccggaaccctaatcccaagttacccggaccggggacccccgtaaggggtacccgggtaaccgtacggtaccggtaacgggacccgttaggtaaaccgttacgtttaaccgtcggttaacgtacgggttaaccgaacggtaaccgaaccgtaaaccgtttcgtaaccgtaacgttaaccgttaccggggtaaccggtacgggaaacccgttaaacggttaccggtaacccgttacccggttagggtaccgtaacggtaccccggtacggttaaccgtcccggttaaccccccttggtacccctaaccgtttcccgttacccgttacccccgtaccccgttccccgttcccgtttcccgttaccctaacccgttcccg

SEQ ID NO: 108254 - DNA, 672 bp, Homo sapiens
  misc_feature: GYAE6OF02HYLYE.49.40.D07.1.454.CMB.1.raw
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgaagaacaatcgaaaataagaatatcactggtatacaacaaaagcctggccaggtccccttgttttcggtcctttatcgagtacttcaagtccggcccgcgtgggactccctgagcgtattctcgtggcctccgacggtcggggaacncgggccactcncgaccatcatccgacgggcccgagggccgaacgagtggaacggctagtaactattacgtgtacgaagggtacgaaacggaccgaccctaaaactttcgtactaattacgttcgggaccgggtaacgggaaacctaaagttcggaacccgttccgtacggggtaccacggaccccgtaagggtccctcccggtccccccgttaccgggttaccctaacccgttcccgtacccggtttaccccccacccccgtttcccttcccgtttcccttcccgttacccgtaacccg

SEQ ID NO: 108255 - DNA, 522 bp, Homo sapiens
  misc_feature: GYAE6OF02G18M4.49.40.D07.1.454.CMB.1.raw
  modified_base (316)..(316): a, c, t, g, unknown or other
  misc_feature (316)..(316): n is a, c, g, or t
  modified_base (357)..(357): a, c, t, g, unknown or other
  misc_feature (357)..(357): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgtttggtcctttatcgagacttcaatcggcccgntgggatccctgagcgattctctggctccacgtcggggaacngggccactctgaccatcatcagggcccagggcgacgatgagctgactattactgtcaggtcgaagaccgcaaacttgtacagtatcggacggaggaccaattcgaccgtctggtacagcccaggctcgcccctggtcactctcgtcccgcctcctctctctcgtc

SEQ ID NO: 108256 - DNA, 634 bp, Homo sapiens
  misc_feature: GYAE6OF02IHHIR.49.40.D07.1.454.CMB.1.raw
  modified_base (378)..(378): a, c, t, g, unknown or other
  misc_feature (378)..(378): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagcccacgttccgtctcagtcggccctgggacagacggccacaattacctgtgacggcgagaaacaatcgaaaatagaatattcactgtatcaaacaaaagcctggccaggccccctgttttcggtcctttatcgagtacttcaatccggccccgcgtgggactccccgtgacgcgacttctcgtggcctccgacggtccgggggaacncggggcccactcgtcgaccagtcatcgacgggcccgagggcgacgatggacggctagacttaattcgtgtacgtaggtccgaaaggaccgtacctaaacgttgtaccaagttacgttccgggagggtacggggaacctaaaacggttcgacccgttccgtgggtaccacgacccgaggcctccggcccccgttggtccacccgttcctaccgttcccccaccctttcccgtaccttccgttccctaccggtacccg

SEQ ID NO: 108257 - DNA, 685 bp, Homo sapiens
  misc_feature: GYAE6OF02IQFY4.49.40.D07.1.454.CMB.1.raw
  modified_base (664)..(664): a, c, t, g, unknown or other
  misc_feature (664)..(664): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacaggttatgtggcctcctacgaagtgattcagccacgtccgtctcagtgccgtcggacgacgacggccaccaattactcgtgacggcgagaacaactacgaaataaagaataattctactagtatacaaacaaaagaaccgtcggccgacggccccgttccgttttggttccgtttacttcggacgacgttacaacgtaccggccccggccgtgggtacgtccctcgaggacgagtttactctcggcgtcctacggtacgggggaaacgacggcccgactcgtcgaccactcactacgacgggcccacgggcgacgagtaggacggctagacttaacttacgtcgttacgagggtaacgaacgtaacgaacccttaaacttcgtacagtttaacgttccggggacgggtaacgggtaaaccaaacgtttacggacccgttacgttcgggtaacaccggtaccggaccgggcttcccgggcccccttacggctaccttaccgttccgtttccccgaccccgtttccnccttaccttccgtacctaccg

SEQ ID NO: 108258 - DNA, 567 bp, Homo sapiens
  misc_feature: GYAE6OF02GQAKA.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggccccctgttttggtcctttatcgagacttcaatcggcccgctgggatccctgagcgattctctggctccgacgtcggggaacagggccactctgaccatcatcaggcccagggcgacgatgagctgactattactgtcaggtcgaagcgactaaacttgtacagttacgttcggcggagggacctaaagttcgacccgttccgtagggtccaacggccctaagggcctcggcccccttgggtcccaccgttcctcggttccccaccccttccgtcctccttcctcgtacc

SEQ ID NO: 108259 - DNA, 579 bp, Homo sapiens
  misc_feature: GYAE6OF02GW1TH.49.40.D07.1.454.CMB.1.raw
  modified_base (370)..(370): a, c, t, g, unknown or other
  misc_feature (370)..(370): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgcgtgggatccctgacgcgattctctggctccacgtcggggaacagggccactcncgaccatcatcacgggcccagggcgacgatggaggctggactagttactgtcgaggtcgaaagtaccgacctaaacgttgtaccagttacttcgggacggaagggacctaaagttcgaccgttcgtcgggtacacgacccgtagcgtaccggcccccttcggtccaccgtccttcgttacccctccgtcccttctccttctccgtaccg

SEQ ID NO: 108260 - DNA, 589 bp, Homo sapiens
  misc_feature: GYAE6OF02GQSCX.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgaagaacaatcgaaaataagaatattcactggtatcaacaaaagcctggccaggccccttgtttggtcctttatcgagtacttcaatccggcccgctgggactcccctgagcgtattctctggctccgacggtcggggaacacgggcctacgtctcgaccatcatcgacgggcccagggcgacgagtgaggctgactattactgtcgaggtcgaaagaccgacctaaacttgactatacgttcgggacgggaacgggacctaaagttcggaccgttccgtagggtaccacgacccgagtccgtccggcccccgttcggtcctaccttctccgttccccacccttccttccctcttcctccgtac

SEQ ID NO: 108261 - DNA, 636 bp, Homo sapiens
  misc_feature: GYAE6OF02GGDVZ.49.40.D07.1.454.CMB.1.raw
tcagagtcgagagacacgaccggtgctcgatttagtgatagagcgtaacgaacaggaggggctgggcctcaggaagcagcatcgggggtgccgcagccatggccctggaccgctctccttctgagcctccttgctcactttacaggttatgtggcctcctacgaagtgattcagccacgttccgtctcagtggccctgggacagacggccacaattacctgtgacggcgagaacaatcgaaatagaatagttcacgtggtatcaacaaagcctggccaggccccctgttttcggcctttagtcgagtacttcaatccggcccgctgggactccctgacgctacttctactcggcctccgaacgtcggggaacacgggccacgtctacgaccatcacgtcgacgggcccaggggccaacgatacggacggctagactaacttacgtgtcgagggtacgaacgaccgaccgtaaagttcgactagttagttcggacggacgggacctaaagtcgaccgttaccgtgggtaccacggtacccgaaggtcctaccgggccccccttagggtcctaaccgtttccgttacccgtttacccccgacccgtttcccctaccttccttacccgtaccgtacccg

SEQ ID NO: 108262 - DNA, 632 bp, Homo sapiens
  misc_feature: GYAE6OF02JGX60.49.40.D07.1.454.CMB.1.raw
  modified_base (217)..(217): a, c, t, g, unknown or other
  misc_feature (217)..(217): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattaccngtgacggcgagaacaatcgaaataagaatattcactggtatcaacaaaagcctggccaggcccctgttttggtcctttatcgagacttcaatcggacccgctgggatccctgagcgattctctggctccgacggtcggggaacagggccactctgaccatcatcagggcccagggcgacgatgaggctgacttatactgtcgaggtcgaaagacgacctaaacgttgtccagttattccgggacgggtaacgggacctaaagtttcggacccgttccgttaggggtccaacggaccccgaaggtccgtccggtacccccccgttcgggttacccaaccccgtttccgtttacccggtttaccccctaacccccgtttccccgttacccgtaccctttcccgttacccgtaccccg

SEQ ID NO: 108263 - DNA, 607 bp, Homo sapiens
  misc_feature: GYAE6OF02FOH34.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgcgtgggactccctgagcgattctctggctccacggtcggggaacacgggccactctgaccatcatcgacgggcccagggcgacgatggagctagactatacgtgtacgaggtacgaagaccgacctaacgttgtactagtacgttcgggacggacgggtaacctaaagttcgaacccgttccgtcgggtaccacggacccgtaacggccgtaccgtccccccgtggtaccctaccgttccgttcccggttcccccgcccctttcccgtccttcccgttccttccgtacccg

SEQ ID NO: 108264 - DNA, 613 bp, Homo sapiens
  misc_feature: GYAE6OF02I8S5P.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatatcactggtatcaacaaagcctggccaggcccccttgttttcggtcctttatcgagtacttcaatcgggcccgcgtgggactccccgtgagcgtattctcgtggctccgacggtcgggggaacacgggccactctacgaccatcatcgacgggcccagggcgacgagtgaggctagacttattacgtgtcacgggtcgaagaccgacctaaacgttgtactagttacgttcgggacggacgggtaaccaaagttcggaccgttccgtagggtccacggtacccgaggtcctccggcccccgttcggtcctaccgttccgttaccgttcccccgtcccttccccgtccttcccgttcctccgtacccg

SEQ ID NO: 108265 - DNA, 648 bp, Homo sapiens
  misc_feature: GYAE6OF02GRJZP.49.40.D07.1.454.CMB.1.raw
  modified_base (216)..(216): a, c, t, g, unknown or other
  misc_feature (216)..(216): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacaggttatgtggcctcctacgaagtgattcagccacgttccgtctcagtggccctgggacagacggccacaattaccngtgacggcagaacaatcgaaatagaatattcactgtatcaacaaaagcctggccaggcccccttgttttcggtacctttatccggaagtactttcaacttccgggccccgtctgggactccccgtggacgcgtatttctcgtcggcctccgacggttcgggggaaacacggggcccaactcgtagacccagtcctatccgacggggcccaaggggccgaacgagtcggaaggctagacttaacttactgtcgaggacgaaagaccgaacctaaacgttgtacctaagtacgttccgggacggaacgggtaaccctaaaagttcgaaccggttccgtgggtaccacgaccccgagggtccctcccggtcccccgtggtcctaccgttcttaccggtcccctaccccgtcttcccgttactcccgtccgtaccg

SEQ ID NO: 108266 - DNA, 535 bp, Homo sapiens
  misc_feature: GYAE6OF02FY18L.49.40.D07.1.454.CMB.1.raw
  modified_base (217)..(217): a, c, t, g, unknown or other
  misc_feature (217)..(217): n is a, c, g, or t
  modified_base (471)..(471): a, c, t, g, unknown or other
  misc_feature (471)..(471): n is a, c, g, or t
  modified_base (524)..(524): a, c, t, g, unknown or other
  misc_feature (524)..(524): n is a, c, g, or t
  modified_base (530)..(530): a, c, t, g, unknown or other
  misc_feature (530)..(530): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattaccngtgacggcgagacaatcgaaatagaatattcactggtatcaacaaaagcctggccaggccccctgttttggtcctttatcgagacttcaatcggcccgctgggatccctgagcgattctctggctccacgtcggggaacagggccacgtctgaccatcatcagggcccagggcgacgatgaggctgactattactgtcaggtcgaagacgacaaacttgtcagtattcggcggaggaccaaattcgaccgtccngggtcacgccaggctcggcccctggtccacgtcttcgttccccacctccctcnccttcncgtac

SEQ ID NO: 108267 - DNA, 634 bp, Homo sapiens
  misc_feature: GYAE6OF02F5WM1.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaaataagaatattcactggtatcaacaaaagcctggccacggcccctgttttggtcctttatcgagtacttcaatcggcccgctgggactcccgtgagcgattctctgctccgacgtcggggaacagggccactctgaccatcatcgacgggccccagggaccgacgagtggacggctggaacttagttactgtcgaggtacgaagaccgccaaacgttcgtacaagtacgttcggaccgggtaacggtacctaaacgttggaaccccggttccgtagggtaccaccggacccgaaggtcccgtaccggtcccccgttacgggtcctaacccgttccggttacccgtttcccccggtaccccttcccgttccctacccgttcccttacccggtaccc

SEQ ID NO: 108268 - DNA, 756 bp, Homo sapiens
  misc_feature: GYAE6OF02ISNZH.49.40.D07.1.454.CMB.1.raw
tcagagtcgagagacacgaccggtgctcgatttagtgatagagcgtaacaacagaggggctgggcctcaggaagcagcatcggggggtgccgcagccatggcctggaccgctctccttctgagcctccttgctcactttacaggttatggtggcctcctacgaagtgattcagcctacgttccgtctcagtcggccctgggacaggaccggccaactaatttacctggtcggacggcgaagaaaccaagtacgaaataagaatattcacgtggtactacaaacaaaagcctacggccacggtccccttgttttcggtcctttactcgacgtacttacgaagttccgggcccgtcgtgggactcccgtagagcgtattctcgtgcctccgacggtaccggggaacgaccgggccacgtctacgtaacctagtcacgtaccggaacgggcccgaaggggccggaacggaacgtacgggacggtcgtagttaaccgtttacttacgtgtaaccggtacgggtaaccgaaacggtacccgtaaccttaaacgttcgtacaacgttacggtaccgggacgggtaacgggtaacctaacgttaccggtacccggttaccggttcggtaccgaccggtacccgtaacggtccgttacccccggtccccgtttaccggtaaccttcccgttacccgtttaccccgtttacccccctaccccgtttccctcccgtttaacccgttaccccgttccgttaccccgg

SEQ ID NO: 108269 - DNA, 679 bp, Homo sapiens
  misc_feature: GYAE6OF02HW7HY.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacaggttatgtggcctcctacgaagtgattcagccacgttccgtctcagtggccctgggacagacggccacaattacctgtgacggcagaacaatcgaaaatagaatatcactggtatacaacaaaagcctaggccaggtccccttgttttggtcctttatcgagtacttcaattccggccccgtcgtgggactcccgtgacgcgtatttcctctggcctcccgaacggtcggggaaacacggggcctacgtccgtagaacctatcctaatcgacggggcccaggggtccgaacgactggacggctgaacttattacgtagtaccgaaggtccgaaaggaccgacctaaacgttcgtactaaacgttacgttacgggacggtaaggggtaacctaaaggttacgaccggttcccgtaggggtaccacggtaccccgaagggtccctaccggccccccgtttacgggtaacctacccgttccgttacccggtttacccccgaccccgtttcccttcccgttacccttcccgtacggtaccccg

SEQ ID NO: 108270 - DNA, 865 bp, Homo sapiens
  misc_feature: GYAE6OF02JLTFL.49.40.D07.1.454.CMB.1.raw
  modified_base (140)..(140): a, c, t, g, unknown or other
  misc_feature (140)..(140): n is a, c, g, or t
  modified_base (163)..(163): a, c, t, g, unknown or other
  misc_feature (163)..(163): n is a, c, g, or t
  modified_base (217)..(217): a, c, t, g, unknown or other
  misc_feature (217)..(217): n is a, c, g, or t
tcagagtcgagagacacgaccggtgctcgatttagtgatagagcgtaacaacagagggctgggcctcaggaagcagcatcgggggtgccgcagccatggcctggaccgctctccttctgagcctccttgctcactttacnggttatgtgccttctacgaagtnattcagccacgttcgctcagtcgtccgtaggacacggccgccataacttaccgngtagccggacgagaacaatacgaaataacgatactacacgttagtactacaaacaacgtacgtacggaccgtaccggtacccgtttcggttttaccgtttaccgtttaccgttacgtaccgttacttaccggtaaaccttcgtcccgggacttcccgggggtaagtacccgttccggtaattcccggtacgttacggtccttaccgtacgttccgggaacctacggggggtacccaacgggtcccgacgtacccctagtaccaacttcgaacggtccctagggggccctaacgggacggtaccgaacggtccgtagggaccgttacggtaaccgtacgtttaccgacggttaccgtaaacgggtaccggtaacggtaaaccggttcccgtaaaaccgttacgttaccgttacggtacggttaacggggtacccggtaaacgggtttaccggaaaccgtttccgggttaaccgggttacccgttacggggtacccgtaacgggtacccgtaacccgggtccccggttacccgggtacccccggttacccggtttacccggttaccccgttacccccgttaccccgttttacccccgttacccggtccccctttacccgttaccgtttacccctttacccggttacccgg

SEQ ID NO: 108271 - DNA, 690 bp, Homo sapiens
  misc_feature: GYAE6OF02IYF9M.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacaggaccggccaacaattacctgtgacggcgagaaacaatcgaaaataagaatattcactgtatcaaacaaagcctggccaggcccctgttttggtcctttatcgagtacttcaatccggcccgtcgtcgggactcccgtgacgcgtattctcgtggcctccgacggtcgggggaactacgggcctactccgtagaccatcatccgaacgggcccgagggacgacgacgtggacgcgtagacttatacgtgtacgaggttacgaaacgaccgtacctaaacgtttcgtactaagttacgttacggggaccgggtacgggtaaacctaaagttccggaaccccggtttaccggtacggggttaaccaaccgggtaccccgtaacggggtcccttacccgggcccccccgtttcgggtaccctaaccgtttcccgttcccgtttaccccccgaccctttcccgtaccccgttccgtttcccgtcccgtaacccg

SEQ ID NO: 108272 - DNA, 646 bp, Homo sapiens
  misc_feature: GYAE6OF02JXYT6.49.40.D07.1.454.CMB.1.raw
  modified_base (221)..(221): a, c, t, g, unknown or other
  misc_feature (221)..(221): n is a, c, g, or t
  modified_base (315)..(315): a, c, t, g, unknown or other
  misc_feature (315)..(315): n is a, c, g, or t
tcagagtcgagagacacgaccggtgctcgatttagtgatagagcgtaacaacagagggctgggcctcaggaagcagcatcgggggtgccgcagccatggcctggaccgctctccttctgagcctccttgctcactttacaggttatgtggcctctacgaagtgattcagcccacgtttccgtctcagtggccctgggacaggaccggccaacaattacccngtgacggcgagaacatcgaaatagatatcactgatcaacaaagctggccagcccctagtttcggtcctttatcgagacttcaattcggcccgtntcggactccctgacgcgattctcgtggctccgacgttcggggaactacgggcctaacgtctcggacctactcaatccgacggcccgagggccgacgatcggaggtctgaaccttattaccgtgtaccgtagggtcgtaaacgacgtaccgtaaaacgtttgaacgtatttaacgttcgggacgggtaacggaaccgtaaagttcggaacccgttccgtcgggtaaccgtacgaccccgtacgggcttcccggcccccgttaggtacctaccggttccgtaccggtttcccccgcccgttacccttcccgtaccttcccgtaccgttacccg

SEQ ID NO: 108273 - DNA, 698 bp, Homo sapiens
  misc_feature: GYAE6OF02IZPDC.49.40.D07.1.454.CMB.1.raw
  modified_base (380)..(380): a, c, t, g, unknown or other
  misc_feature (380)..(380): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggccctcctacgaagtgattcagcccacgttccgtctcagtcggccctgggacagacggccacaattacctgtgacggcgagaacaatcgaaaatagaatattcactgtatacaaacaaaagcctggccacggtccctgttttggtccttatcgacgtacttcaagtccggcccgtacgtggactcccgtgacgcgtattccgtctcggctaccgtacggtacggggaacncgggcctacgttcacgtacctactctactacgacgggtcccgaagggtccgaacgtagtaggacgggtctacggtaccttaagttacgtcggtcgtaacgggttacgaaacgaccgtaaccgtaaacttcggtactaacgttacgttacggggtagggtaaccgggaaaccgtaaagttccggaacccgttccggtacgggtacgaccgtacccgtagggtcccgtaccggtcccccgtccggttacctacccgttccgtttaccgttaccccccgttacccttcccttacccgttacccgttccgttacccgtaccg

SEQ ID NO: 108274 - DNA, 656 bp, Homo sapiens
  misc_feature: GYAE6OF02JZQ4N.49.40.D07.1.454.CMB.1.raw
  modified_base (139)..(139): a, c, t, g, unknown or other
  misc_feature (139)..(139): n is a, c, g, or t
  modified_base (228)..(228): a, c, t, g, unknown or other
  misc_feature (228)..(228): n is a, c, g, or t
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (405)..(405): a, c, t, g, unknown or other
  misc_feature (405)..(405): n is a, c, g, or t
tcagagtcgagagacacgaccggtgctcgatttagtgatagagcgtaacaacagagggctgggcctcaggaagcagcatcggggtgccgcagccatggcctggaccgctctccttctgagcctccttgctcactttacnggttatgtggcctcctacgaagtgattcagccacgttccgctcagtcggccctgggacagaccggccaacaattcctgtgaccggcganaacaatcgaaataagaatattcactgtatcaacaaagcctaggccaggcccctgtttcggtccttatcgagtacttcaatcggcccgcttgggactccctgagccgtattcnctggcttccacgtccgggaacncgggtccactcgtgaccatcatccgaggcccagggccgacgancggagcgtgacttacgtacgtgtcgacggtcgaaacgaccgtaccgtaaacgttgtacaacgttacgttaccgggacgtaacgggtaaccctaaagtttcggaacccgttccggtagggtactaaccggccgtaacgggcccttaccgggcccccccgtttagggtcccaacccggtttcccgttacccgggtttaccccccgtccccggttacccctttccgttaccccgtttccgtccccggttaaccg

SEQ ID NO: 108275 - DNA, 724 bp, Homo sapiens
  misc_feature: GYAE6OF02H66T5.49.40.D07.1.454.CMB.1.raw
tcagagtcgagagacacgaccggtgctcgatttagtgatagagcgtaacaacagaggggctgggcctcaggaagcagcatcggggggtgccgcagccatggcctggaccgctctccttctgagcctcttgctcactttacaggttatgtggcctcctacgaagtgtattcacgcctaccgtttccgtctacaggtccggcccgtgggacaggaccggaccaataaacttaccgtggtacggaccggacgaagaaactaataacgaaaataagaattatacacgtaggtactaacaaaacaaacgccgtaggaccgaccggtcccctttggttttcggttaccttttagtacgagtaccttacaacgtccggcccgtgtggacctccgtagacgtcgtattcctcgtcggcctaccggacgggtaccggggaaacgtaccgggcctaccgtcgtacgaacctatactacgtccggaccgggacccggacgggggaccgaacggtgtacgggaacgttcgtaacgtaaactttaacgttacgtcggtaggtaacggtaccggaaacgtaccgtaactaaaccgtttgactaattcggttacgggacgggacgtaacctaagttccggaccgtcggtaggacctacgaccgacgtccgtacccgcccgttacgtactacccgttcgttaccccgtccccgtcccttcctacttccttccgtgtaccg

SEQ ID NO: 108276 - DNA, 611 bp, Homo sapiens
  misc_feature: GYAE6OF02I4NWD.49.40.D07.1.454.CMB.1.raw
  modified_base (207)..(207): a, c, t, g, unknown or other
  misc_feature (207)..(207): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggcctgggacagacgccanaattacctgtgacggcgagaacaatcgaaataagaatatcactgtatcaacaaaagcctggccaggcccctgtttgtccttatcgagacttcaatcggcccgcgtgggactccctgagcgattctctggctccgacgtacggggaacacgggccacgtctgaccagtcatcgacggccagggcgacgatggagctagattacttacgtgtcgaggtcgaaagaccgaccctaaacgttcgtactattagttaccgggacgggtaacgggaacctaaacgttcggtaacccggttcgtacgggtacgaccgtacccgacggccttccggcccccgttacggtccgtaaccttccgtttaccgttcccccggtcccttcccgtcccttccgttccgtccgtacccg

SEQ ID NO: 108277 - DNA, 579 bp, Homo sapiens
  misc_feature: GYAE6OF02GZW5D.49.40.D07.1.454.CMB.1.raw
  modified_base (360)..(360): a, c, t, g, unknown or other
  misc_feature (360)..(360): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgaagaacaatcgaaaataagaatattcactggtatcaacaaagcctggccaggcccctgttttggtcctttatcgagacttcaatcggcccgctcgggatccctgagcgattctctggctccacgtcggggaacngggccactctgaccatcatcacgggcccagggcgacgatgaggctgactattactgtcgaggtcgaagaccgtaccaaacgttcgtactaagtagttacgggacgggtaacgggacctaaagttcgaccgttccgtggtccacgcccgaaggcctcggcccccttcggtcacccttcgtaccgttcccaccccttccgtcctcccttcgtcccgtaccg

SEQ ID NO: 108278 - DNA, 670 bp, Homo sapiens
  misc_feature: GYAE6OF02JDKBJ.49.40.D07.1.454.CMB.1.raw
  modified_base (139)..(139): a, c, t, g, unknown or other
  misc_feature (139)..(139): n is a, c, g, or t
  modified_base (215)..(215): a, c, t, g, unknown or other
  misc_feature (215)..(215): n is a, c, g, or t
tcagagtcgagagacacgaccggtgctcgatttagtgatagagcgtaacaacagagggctgggcctcaggaagcagcatcgggggtgccgcagccatggcctggaccgctctccttctgagcctcttgctcactttacngttatgtggcctcctacgagtgattcagccacgttccgtctcagtggccctgggaccaggacggccacaattaccngtgacggcgaagaacaatcgaaaataacgatacttcaacgttggtactacaacaaaagcctacggaccacggtaccccgttgtttcggtacctttagtcgacgtacttacgaatccggaccgcgttcgggaactccccgtgacggcgtattcgtctcggctcccgacggtacggggaacacgggccaacgtcgtacgaccagtccagtccgacggcccgagggaccgaccggtacgtacggacggtacgtaggtacttacgttacgtcgttacggacggtacgtaaagtacccggaacctaaacgttcgtactaagttacgtccgggtacggaacgggtaacctaaaggttcgaaccgttccgtacgggtctacggacccaggtcctccggccccgtcggactaccgtcctaccgttccccacccgttcccgtcctacccgttccgtccgtaccg

SEQ ID NO: 108279 - DNA, 675 bp, Homo sapiens
  misc_feature: GYAE6OF02F52GW.49.40.D07.1.454.CMB.1.raw
  modified_base (358)..(358): a, c, t, g, unknown or other
  misc_feature (358)..(358): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactgttatcaacaaaagcctggccaggcccctgtttggtcctttatcgagacttcaatcggcccgctgggactccctgagcgattctctggctccacgtcggggaacngggccactctgaccatcatcgaggcccagggcacgatggaggctggacttattacgtgtacagggtcgaaacgaccgtaccaaacgtttcgtactagtacgttccgggacgggtaacggggaacctaaaacggtttcgaacccggtttcccgttaggggtaccctaccgggaccccggtaagggtccccgtttaccgggccccccccgttaccggggttaccctaaccccgtttcccggttttaccccggttacccccccttaccccccgtttccccgtttcccgttcccctttacccggttccccggttaaccccg

SEQ ID NO: 108280 - DNA, 972 bp, Homo sapiens
  misc_feature: GYAE6OF02JEWAX.49.40.D07.1.454.CMB.1.raw
  modified_base (110)..(110): a, c, t, g, unknown or other
  misc_feature (110)..(110): n is a, c, g, or t
tcagagtcgagagacacgaccggtgctcgatttagtgatagagcgtaacaacagaggggctgggcctcaggaagcagcatcgggggtgccgcagccatggcctgggaccnctctccttctgagcctccttgctcactttacaggttatgtggtcccttcctacgaagtgattcagccctacgttccgtctcaggtcggaccctgggacaggtaccggccaacgtaaagtttaccctggtacggaaccgggcgaaggaaaccaaatccggaaaaattaaggtaaacttaacgtttccaacgttacgggttaacttaccgaaaaccgaaaaaaggtccccgtacggggtaccccaacggggttacccccccgtttaggttttttaccggggttaccccgttttaacgttacccgggtaagggtaacccttttaccgaaaaccggtttcccgggtacccccgggtaccgttacggggggtaacctttccccccggtttagggaacggtacccggttaaacgtttcccgttaccggttcggggtaccctttaccccggaaccgggtttcccggggggaaacgtaacggggcccctaaacgtccgttacggaaccctagttccaacgttccgaaccggggacccgtacgggggtaccgaaccggtaacgttcgggtaacgggtaccgtacggtaaccgttaaacgtttacccggttaggtaccgtaacgggttaaccgggtaaaaccggtaccgggttaaccccttaaaaccgtttcgttaacccaagtttaaccgttaccgggtaaccggggaacggtaaacccgtaaagttccgggtaaacccgttccgtacgggttaaccacgtaccccgaaggtcccggtacccgtcccccggtacggttacctacccgttaccgttacccgttacccctaacccgttcccgttacccgtttcccgttccgtaccgttacccg

SEQ ID NO: 108281 - DNA, 612 bp, Homo sapiens
  misc_feature: GYAE6OF02FYYJ6.49.40.D07.1.454.CMB.1.raw
  modified_base (210)..(210): a, c, t, g, unknown or other
  misc_feature (210)..(210): n is a, c, g, or t
  modified_base (339)..(339): a, c, t, g, unknown or other
  misc_feature (339)..(339): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccaanaattacctgtgacggcgagaacaatcgaaataagaatattcactggtatcaaacaaaagcctggcaggcccctgtttgtcctttatcgagacttcaatcggcccgtctgggatccctgagcgtattctntcggctccacggtcggggaacagggccactcctagaccatacatccgagggcccagggcgacgatgaggctgactattactgtacaggtacgaagacgacctaaaacgttgtactaattacgttcgggacgggtacggaacctaaagttcgaccgtccgtcgggttacacggccccgaaggtcctacccggcccccgttacgggtcctaacccgttccgttacccgtttcccccaaccccgtttccctccgttcccttccgtacccgtacccg

SEQ ID NO: 108282 - DNA, 689 bp, Homo sapiens
  misc_feature: GYAE6OF02FO62G.49.40.D07.1.454.CMB.1.raw
  modified_base (119)..(119): a, c, t, g, unknown or other
  misc_feature (119)..(119): n is a, c, g, or t
  modified_base (362)..(362): a, c, t, g, unknown or other
  misc_feature (362)..(362): n is a, c, g, or t
tcagagtcgagagacacgaccggtgctcgatttagtgatagagcgtaacaacagaggggctgggcctcaggaagcagcatcgggggtgccgcagccatggcctggaccgctctccttcngagcctccttgctcactttacaggttatgtggcctcctacgaagtgattcagccacgttccgtctcagtggccctgggacagacggccacaattacctgtgacggcgagaacaatcgaaataagaatattcactggtatcaacaaagcctggccaggcccctgtttggtcctttatcgagacttcaatcggcccgctgggactcccgtgacgcgtattctctcggctccgacggtcgggaacngggccactcgtcggccatcatcgacgggcccaggggccacgagtggaggctagactattacgtgtacgacggtacggaagaccgacctaaacgttgtactaagttacgttccgggacgggtaacggggaaacccttaaaggttccggaacccgggtttccgtacggggttaccaaccgggtccccgtaaacggggtccctaccccgggtacccccccggtaccgggttaccccgtaacccgtttcccgtttcccgggtttacccccccgtcccccgttttaccccgttccccggttacccgtttccccgttacccggttaaccccgg

SEQ ID NO: 108283 - DNA, 537 bp, Homo sapiens
  misc_feature: GYAE6OF02GSBYM.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactgtatcaacaaaagcctggccaggcccctgttttggtcctttatcgagacttcaatcggcccgctgggatccctgagcgattctctggctccgacgtcggggaacagggccactctgaccatcatcagggcccagggcagatgaggctgactattactgtcaggtcgaagacgcctaaacttgtacatacgttcggacggaggaccaaagttcgaaccgtctggtcacgcccgaggcctcgcccctcggtccacgtctcgttccccacctcctctcctctcgtcc

SEQ ID NO: 108284 - DNA, 640 bp, Homo sapiens
  misc_feature: GYAE6OF02IIWSH.49.40.D07.1.454.CMB.1.raw
  modified_base (217)..(217): a, c, t, g, unknown or other
  misc_feature (217)..(217): n is a, c, g, or t
  modified_base (368)..(368): a, c, t, g, unknown or other
  misc_feature (368)..(368): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattaccngtgacggcgagaacaatcgaaataagaatattcactggtatcaaacaaaagcctggccaggcccctgttttcggtctttatcgagacttcaatcgggcccgcgtgggactccccgtgacgcgattctctggcctccgacggtcgggggaanacggggccactctcgacctatcaactcgacgggcccaggggacgacgagtcggaggctaggacttagttactgtacgaggtacgaagacgtaccaaacgtttcgactaagttcgttcgggaccgggtaggaacctaaagttcggacccgttccgtaggggtaccaggtacccgaacggcctaccggccccccgttacgggtcctaacccgttccgttaccgttcccccctacccgttccccttcccgttacccgttcccttaccggtacccg

SEQ ID NO: 108285 - DNA, 606 bp, Homo sapiens
  misc_feature: GYAE6OF02HTRT9.49.40.D07.1.454.CMB.1.raw
  modified_base (317)..(317): a, c, t, g, unknown or other
  misc_feature (317)..(317): n is a, c, g, or t
  modified_base (328)..(328): a, c, t, g, unknown or other
  misc_feature (328)..(328): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
  modified_base (428)..(428): a, c, t, g, unknown or other
  misc_feature (428)..(428): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcagaacaatcgaaaataagaatattcactggtatcaacaaaagcctggccaggcccctgtttcggtccttatcgagacttcaatccggcccgntggtactcccngacgcgattctcgtggcctccacggtcgggaacngggccactctacgaccntcactcgacgggcccaggggaccgacgatggacgggctagacttattcngtacgagtcggaaacgccgacctaaacgttgtacagttagtccgggacggtagggaacctaaagttacgaccgttacgtcggtacacggtaccccaggccgtaccggcccccgttagggtcctaaccgttccgtaccgtttccccgcccttcccctctacccgttccgtcgtaacccg

SEQ ID NO: 108286 - DNA, 690 bp, Homo sapiens
  misc_feature: GYAE6OF02GZ6WH.49.40.D07.1.454.CMB.1.raw
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtgccctgggacagacggccacaattacctgtgacggcgagaacaatcgaaataagaatattcactggtatcaaacaaaagcctggccaggcccctgtttcgtcctttatcganacttcaatcggcccgngtacgggactcccgtgacgcgtattcctctcggcctccgacggtaccggggaacacgggccactctcgaccatacagtcgacgggcccagggtccgacgatcggacggtctagacttagttaccgtgtacgagggttacgaaacggtacccgtacctaaacttcgtaactagttacgttaccggggaacgggacgggtaacctaaaggtttccggaacccgtttaccggtacggggttaccaaccgggaccccgtaacgggtcccgttacccgggtccccccgttcgggttaccctacccgtttcccgttacccggtttaccccccgtacccctttccccgttcccttaccccgttcccgttacccgttacccg

SEQ ID NO: 108287 - DNA, 724 bp, Homo sapiens
  misc_feature: GYAE6OF02IG5QF.49.40.D07.1.454.CMB.1.raw
  modified_base (313)..(313): a, c, t, g, unknown or other
  misc_feature (313)..(313): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacaggttatgtggcctcctacgaagtgattcagccacgttccgtctcagtcggccctgggacaggaccgccacaattacctgtcgacggcgagtaaacaatacgaaaataagaattatcacgtggtatacaaacaaaacgctggaccacggtccccttagttttcggtacctttancgtagtactttacaacgtccggcccgacgtcgggaactccccgtagacgtcgtattaccgtcgtcggtcctacccgtacggtaccgggggaaacgtacggggaccctacgttccgtacggaaccctaactacaacgttccggaccgggtaccccgaagggggaccgaacggaagtcgggaacggcttacggaactttacttaacgtcgttacgaacgggttaccgaaacggtacccgtaaacctaaacgtttgtacaacgttacgttcgggacggtacgggaaacctaaagttcgacccgttacgtcgggtaacacggacccgaggtcctaccggcccccgttggtaccctaccgttccgtttacccgtaccccctacccgttccttccgtcccgttccgtacccgtaccg

SEQ ID NO: 108288 - DNA, 633 bp, Homo sapiens
  misc_feature: GYAE6OF02HEV94.49.40.D07.1.454.CMB.1.raw
  modified_base (433)..(433): a, c, t, g, unknown or other
  misc_feature (433)..(433): n is a, c, g, or t
tcagagtcgagagacacgaccggtgctcgatttagtgatagagcgtaacaacagaggggctgggcctcaggaagcagcatcgggggtgccgcagccatggcctgggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttcggtcctttatcgtagacttcaacgtccggcccgctgggatccctgagcgattctctggctccacgtcggggaacagggccacgtctcgaccatccatcgaggggccccgaggggcgacgagtgacgggtctagactatttacgngtcgaggtacgaacgaccgtaccaaacgttcgtacattacgttccgggacgggtacgggtaacctaaagttacgacccggttccgtacgggtaccaccggacccgacgggccgttccggccccccgttcggtcctaccgttcccgttaccgtttccccccacccgtttccccttaccgttcccttcccgttccgtacccg

SEQ ID NO: 108289 - DNA, 748 bp, Homo sapiens
  misc_feature: GYAE6OF02J10VO.49.40.D07.1.454.CMB.1.raw
  modified_base (109)..(109): a, c, t, g, unknown or other
  misc_feature (109)..(109): n is a, c, g, or t
  modified_base (218)..(218): a, c, t, g, unknown or other
  misc_feature (218)..(218): n is a, c, g, or t
  modified_base (324)..(324): a, c, t, g, unknown or other
  misc_feature (324)..(324): n is a, c, g, or t
tcagagtcgagagacacgaccggtgctcgatttagtgatagagcgtaacaacagaggggctgggcctcaggaagcagcatcgggggtgccgcagccatggcctggaccnctctccttctgacgcctccttgctcactttacaggttatgtggcctcctacgaagtgattcagccacgttccgtctcagtcggccctgggacagacggccacaattccngtcgacggcgagaacaatcgaaatagaatattcactgtatcaacaaagcctggaccacggccccttgttttcggtcctttatcgagtacttcaattccggcccgtntgggactccctaggagtcgacttctcgtggccttccgaacggttcggggaaactcgggcccacgttcgacgaacccgtataccgtataccgaccggggccccgaggggcccgaacgtacgtacggtacgggcgtacgtacctaacgtttacgtacgttacgacggtacggtaaacggaaccgtaaccgttaaaaccgttcgtaccgtaagtttaacggttaccggggtaccgggaacgggtaacccgtaaaacggtttaccggtaaccccggttaccgttcggggtaaccctaaccggtacccggaacgggtcccttacccgggtcccccccggttacggttacccgtaacccgtttccccgttaccggttcccccccgtcccgttacccgttcccgtttccgttcccgttacccgttacccgg

SEQ ID NO: 108290 - DNA, 621 bp, Homo sapiens
  misc_feature: GYAE6OF02H4O36.49.40.D07.1.454.CMB.1.raw
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctctacgaagtgattcagccacgttccgtctcagtggccctgggacagacggccacaattacctgtgacggcgagaacaatacgaaatagaatatcactggtatcaacaaaagcctaggccaacggccccttgtttttcggtccttttatcgagtacctttcaagttccggcccgcgtgggactcccgtgancgtattctcnggctccacggtcggggaacncgggccatctgaccntcatcgacggcccgagggcgacgagtcgaggtctagacttagttactgtcgaggtcgaacgtacgactaaacgttgtactagttacgttacgggacgggaacggaactaagttcgaccgttcgtcggacacggacccacggtcctacccggtcccccgttacgggtccctaccgttccgttacccggttacccccaccccgttccgttcccttcccttccgtacccgtaccg

SEQ ID NO: 108291 - DNA, 664 bp, Homo sapiens
  misc_feature: GYAE6OF02IQ0MP.49.40.D07.1.454.CMB.1.raw
  modified_base (185)..(185): a, c, t, g, unknown or other
  misc_feature (185)..(185): n is a, c, g, or t
  modified_base (315)..(315): a, c, t, g, unknown or other
  misc_feature (315)..(315): n is a, c, g, or t
  modified_base (341)..(341): a, c, t, g, unknown or other
  misc_feature (341)..(341): n is a, c, g, or t
  modified_base (353)..(353): a, c, t, g, unknown or other
  misc_feature (353)..(353): n is a, c, g, or t
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (642)..(642): a, c, t, g, unknown or other
  misc_feature (642)..(642): n is a, c, g, or t
tcagagtcgagagacacgaccggtgctcgatttagtgatagagcgtaacaacagaggggctgggcctcaggaagcagcagtcgggggtgccgcagccatggcctggaccgctctcctctgagcctccttgctcactttacaggttatggtcggcctcctacgaagtgattcagccacgttccgtntcgagtcggccctgggacaggacggccaactattaccgtgtgacggcgaagaacaatacgaaatagaatatcacgtggactacgaaaacaaagccgtggaccacggtccccttaggttttcgtaccttancggacgtacttcgaacgtccgccgtntcggcttcccgngaacgtcgattcgtcgtggcctaccgaggtccggggaaactcgggaccncgttcncgacctagtcagtccggaccgggtcccgaggggacctagacttcgggacgacgtcgtaaacttgtacgtacggttagacgggttaacaaggacccgtaccttaaagtctaacagtacgtccgggcgggtaacgactaacttccggacccgttggtcggctaacgcccggaggtccctaccggtccccggtgtaccgtcccttcggttacccgtcccggtaccccttcgttcccnccgtttacccggaccgttaccg

SEQ ID NO: 108292 - DNA, 795 bp, Homo sapiens
  misc_feature: GYAE6OF02HPLXO.49.40.D07.1.454.CMB.1.raw
  modified_base (88)..(88): a, c, t, g, unknown or other
  misc_feature (88)..(88): n is a, c, g, or t
  modified_base (119)..(119): a, c, t, g, unknown or other
  misc_feature (119)..(119): n is a, c, g, or t
  modified_base (307)..(307): a, c, t, g, unknown or other
  misc_feature (307)..(307): n is a, c, g, or t
tcagagtcgagagacacgaccggtgctcgatttagtgatagagcgtaacaacagaggggctgggcctcaggaagcagcatcgggggtnccgcagccatggcctggaccgctctccttcngagcctccttgctcactttacaggttatgtggcctctacgaagtgattcagccctacgttccgtctcaggtcggccctgggacaggacggccaacaattacctggtgaccggcgaagaacaatacgaaaataagatatcacgtgtatcaaacaaagcctggccacggccccttgtttcggtcctttancgtagtacttcaatccggcccgcgtgggactccctaggacgcgtattctcgtcggcctccgaccggtacggggaacacgggccaacgtctacgacctatcacgtccgacgggtcccgaggggtccgaacggtagtacgggacgggtaccgtacggtaacgtttaactttacgtacggttaaccggtaacggggtaccggaaaacggtaaccccggtaacccgttaaaaaccgtttcggtaaacctaacggtttaaccggtttaccgggggaacccggggttaaacgggtaaaccccttaaaaggtttacccgggtaaccccggttttaaccgggtccgggggttaacctaaccgggaaccccggtaacgggtacccggttaccccggtaacccccccggttgggttacccctaaccggtttcccgtcccggtttccccccggtaccccttccgtttacccgttcccttaccggttacccgttacccgg

SEQ ID NO: 108293 - DNA, 830 bp, Homo sapiens
  misc_feature: GYAE6OF02IJ6RS.49.40.D07.1.454.CMB.1.raw
  modified_base (221)..(221): a, c, t, g, unknown or other
  misc_feature (221)..(221): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtcggccctgggacaggacggccacaattacctgngacggcgagaacaatcgaaataagaatatcactgtatacaaacaaaagccgtggaccacggccccttggttttacggttcctttagtcgagtacttcaagtccggccgtcgtcgggactcccgtgacgcgtacttctcgtcggtcctccgacggtaccggggaaacgacgggaccctacttccgtacgaaccctataccaacgttccggaaccggggccccgacggggaccgaccggtaacgtaggtacgggtcctaggtaactttaacgttacgttacggttacggtaacgggttaccggaaaccgtaacccggtaaacccttaaaaccgtttcgttaaccgtaaagtttaacgggttacccggggtaacgggggtaaaccggggttaaacccgtaaaaacggttttccgggtaaaccccggtttcccgggtttaaccggggtacctaaaccgggtaccccccgggtaaggggtcccccgttacccccgggccccccgtttaaccgggtccccgtaaacccgttttcccggttccccggttttcccccccgtacccccgttttccccgttccccgtttacccgtttcccgttaccccggttaacccgg

SEQ ID NO: 108294 - DNA, 649 bp, Homo sapiens
  misc_feature: GYAE6OF02JZZDB.49.40.D07.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
  modified_base (409)..(409): a, c, t, g, unknown or other
  misc_feature (409)..(409): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacngacgccacattccngtgacgcgaagacaatcgaaatagatatcactggtatacaacaaaagcctggaccacggccccttagttttcggtcctttatcgagtacttcaatcggacccgctgggactccctgagcgtattcnctggcctccgacggtcgggaacncgggccacgtcncgaccactcacgtcacgggcccagggcgaacgtngacggtctagactattacgtcgtacaggtcgaaagccgacctaaacgttgtactaattacgtaccgggacggtaacgggtaaaccctaaagtttcgggaacccgttccggtacgggtacctaacgcccggtaagtcccggttacccggccccccgggttcgtaccgtaacccgttccgttacccggttacccccgtccccgttcccgtttacccgttacccgttcccggttaccgtcccg

SEQ ID NO: 108295 - DNA, 555 bp, Homo sapiens
  misc_feature: GYAE6OF02HQ48W.49.40.D07.1.454.CMB.1.raw
  modified_base (147)..(147): a, c, t, g, unknown or other
  misc_feature (147)..(147): n is a, c, g, or t
  modified_base (200)..(200): a, c, t, g, unknown or other
  misc_feature (200)..(200): n is a, c, g, or t
  modified_base (263)..(263): a, c, t, g, unknown or other
  misc_feature (263)..(263): n is a, c, g, or t
  modified_base (550)..(550): a, c, t, g, unknown or other
  misc_feature (550)..(550): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttangtggcctcctacgaagtgattcagccacgttccgtctcagtggccctgggacngacggccacaattacctgtgacggcgagaacaatcgaaaataagaatattcactggtatcaanaaaagcctggccaggccccctgttttggcctttatcgagacttacaatccggcccgtctgggatccccgtgacgcgattctctggctccgacggtcggggaacagggccactctgaccatcatcagggcccagggcgacgagtgaggctgactagtactgacaggtcaaacggacgaccaaacttgctaatacgttcggacggagggaccaaattcgaaccgttcgtggtaccagcccaaggtctaccgcccctcggtcactcctgtccccacctccctcctcctcnctacc

SEQ ID NO: 108296 - DNA, 918 bp, Homo sapiens
  misc_feature: GYAE6OF02IRRDT.49.40.D07.1.454.CMB.1.raw
tcagagtcgagagacacgaccggtgctcgatttagtgatagagcgtaacaacagaggggctgggcctcaggaagcagcagtcgggggtgccgcagccatggcctggaccgctctcctttctgagcctccttgctcactttacagttatgtgcctctacgaagtgattcagccacgttccgtctcagtggccctgggacaggacggccacaattacctgtgacggcgagaacaagtacgaaaataacgaaataattacactaggtaataccaaacaaaagcctagggaccgacggtccccttaggttttcggttaccttttatacgaacgtacttcaaacgtccgggcccgtacgtacgggtacttccccgtagacggaccgttactttaccgtacgtcggtccgtacccgaccgggttacggggggaaactaacgggggaccccttaacgtcctaacggtaaccctaacttaccgtaaccgtaccggaaacccgggggtccccggaagggggtacccgtaaaccggggtaagttacggggaacgggttaccgtaacgggtaactttaaacctttaacccgggttacgtttaccggaaacgggggttaccgtaaaacgggtaacccgtaacccggttaaaaaccgttttccgggtaactaacgggttttaaccggtccgggggtaaaccggggtaaacgggtaaccccgttaaaaggttttacccggggaaccccgttttaacccggtgggggttaaccccgaaccgggttaaccccggtaacgggtacccggtttccccgggtaacccccccggttaaccgggttcctaaacccggttttccccgttaacccggttcccccccttaaccccggtttacccttcccgtttacccgtttacccgtacccgttaaccccgg

SEQ ID NO: 108297 - DNA, 661 bp, Homo sapiens
  misc_feature: GYAE6OF02GJU4C.49.40.D07.1.454.CMB.1.raw
  modified_base (298)..(298): a, c, t, g, unknown or other
  misc_feature (298)..(298): n is a, c, g, or t
  modified_base (376)..(376): a, c, t, g, unknown or other
  misc_feature (376)..(376): n is a, c, g, or t
  modified_base (424)..(424): a, c, t, g, unknown or other
  misc_feature (424)..(424): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgaagaacaatcgaaataagaatattcactggtatcaaacaaaagcctaggccaggcccctgtttgtcctttancgtagacttcaatccggcccgtcgtgggactccccgtgacgcgtattccgtctcggcctccgacggtcgggggaaacncggggcccacgttcgtacgaccatccatccgagggcccagggcacgangaggctagacttatactgtacgaggtacgaaagaccgacctaaacttcgtacaattagttccgggacgggtaacgggaacctaaaggttccggaaccgttccgtcgggtacaaccggaccccgtaacgggtcctacccggcccccgttccgggttacccgtaacccgtttacccgttccggtttaccccccggtcccctttcccctacccgtttcccgttacccgttccgtaccccg

SEQ ID NO: 108298 - DNA, 686 bp, Homo sapiens
  misc_feature: GYAE6OF02IJT3D.49.40.D07.1.454.CMB.1.raw
  modified_base (391)..(391): a, c, t, g, unknown or other
  misc_feature (391)..(391): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctagaagtgattcagccacgttccgtctcagtcggcctgggacaggacggccacaattacctgtgacggcgagaacaatacgaaataagaatatcatgatacaacaaaagctgccacgcccttgtttggtccttagtcgtacgtacttacaagtccggccgcgtggactccgtgacgcgtattctcgtcgcctaccgtacggtacggggaacacgggccacgtcgtacgacctacncactcggaccgggccacggggaccgaacgagcggaagggccttacggaactttaaacttacgtacgtacgtaggtaaccgaaacggtacctaaccgtaaacgtttcgaactagttaacgtccggggaagggtaaccgggtaaacctaaacggtttccggaacccgttaccggtcgggtaacccacggaaccccgacggtcccgtacccggtcccccgtccggtaccgtacccgttccgtcccgtttacccccgtccccgttcccgtttacctcccttacccgtcccgtaacccgg

SEQ ID NO: 108299 - DNA, 646 bp, Homo sapiens
  misc_feature: GYAE6OF02GBMH9.49.40.D07.1.454.CMB.1.raw
  modified_base (431)..(431): a, c, t, g, unknown or other
  misc_feature (431)..(431): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctggttttggtcctttatcgagacttcaatccggcccgctgggactcccctgagcgtattctcgtggcctccacggtcggggaacacgggccactcctgaccagtcactcacgggcccagggccgacgatggaggctagtactatttacgngttacgaggtacggaaacgaccgtaccgtaaactttcgactaagttacgttccgggacgggtaaggtaaccctaaagtttcggaacccgttcgtagggtaccaacggcccctaaggcccgtaccggtccccccggtcggtccctaacccgttccgttaccggttacccccctacccgttccccgtttacccttcccgtacccgttccgtaacccg

SEQ ID NO: 108300 - DNA, 999 bp, Homo sapiens
  misc_feature: GYAE6OF02HRY51.49.40.D07.1.454.CMB.1.raw
tcagagtcgagagacacgaccggtgctcgatttagtgatagagcgtaacaacagaggggctgggcctcaggaagcagcatcggggggtgccgcagccatggcctggaccgctctccttctgagcctccttgctcactttacaggttatgtggcctcctacgaagtgattacgagcctacgttccgtctcgaggtcggtccgtagggacaggaccggaccaactaacttaccgtggtaggaccggacgaagaaacaagtaacgaaaattaaagaattactactaacgttagtaactaaccaaaacgaaaacgtccgtacggaccgaaccggttccccgttttaggttttaccggttaccttttaagtaccggtaacggttaaccctttaacgtaaccggttcccgggaccccggttacggttacgggtaaccctaccccggttagggacggtaccgttactttccgttaccggtcggtacccttaccccggtaacggggtaccggggggaaaccgaccggggtacccttaccgttacgttacggaacccgttaatacccggtaaacgttacccggggaaccggggaaccccgggtaacgggggggacccggttaaaccggtaacggttacggggtaaaccggggttcctaaccggggttaaaacttttaaacgtttaaccggtacggttaacgggtaaccgggttaaaccgggaaaaccggttaaccccggaaacccttttaaaacgtttccggtaaaccttaaacggtttaccggggttaccggggaacgggggttaaccggtaaaacccgtttaaaacggggttccggtaaccccgggttaccggggttaacgggtaaccgtaaccggaacccggtaaccggtcccggttaacccccggcccccgtttaccgggtacccttaaccgttccgtttaccccggttaaccccctccccgttacccgttacccttacccgttacccggtacccgttaaccgg

SEQ ID NO: 108301 - DNA, 756 bp, Homo sapiens
  misc_feature: GYAE6OF02G987G.49.40.D07.1.454.CMB.1.raw
  modified_base (300)..(300): a, c, t, g, unknown or other
  misc_feature (300)..(300): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaaataagaatattcatgtatacaacaaaagcctagccaggccccttagttttcggtcctttancgtagactttcaatccggcccgcgtgggactcccgtagagcgtattcctcgtggcctaccgacggtacggggaacacggggccctaacgtcgtacgaacctaattcaacgtcgacggggaccccgaggggtaccgaccggtaagtcggaacgggtacctaggtaaccttaaacgttacgtaccggttacgaagggttaccggaaaacggacccgtaacccgaaaacgttttcggaacctaagttaacgttcggggaacgggacgggtaaaccctaaaagtttaccgaacccggtttcccggttagggtaccgaacccgggtaccccggaaagggtcccgtacccgggtcccccccggttaccggttacctaaccccggttaccgtttccccggtttacccccctaccccgtttcccccttacccgtttcccgttaccccgtaccggttaacccccg

SEQ ID NO: 108302 - DNA, 687 bp, Homo sapiens
  misc_feature: GYAE6OF02IOXS6.49.40.D07.1.454.CMB.1.raw
  modified_base (353)..(353): a, c, t, g, unknown or other
  misc_feature (353)..(353): n is a, c, g, or t
  modified_base (382)..(382): a, c, t, g, unknown or other
  misc_feature (382)..(382): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtgcctcctacgaagtgattcagccacgttccgtctcagtcggcctgggacaggacggccacaattacctgtgacggcgagaacaatacgaaataagatatcactgtatacaaacaaagcctggccaggtccccttgtttcggtcctttatcgagtaccttcaacgtccggcccgcgtgggaccttcccgtagacgcgtacttccncgtcggcctccgacggtacgggggaaacncgggcctacgtcgtacgacctatacacgtcgaccggggacccgagggtaccgacgaagtcggaggtctagtacttaagtacgtgtacgacgggtacgaaacggtaccgaacctaaacgttcgtaactacgttaacggttcgggaacgggtaacgggaaccttaaagttccgaacccggttcggtacgggttaccgaccggtaacccgaacggtccgttacccggtcccccgtaggttaccctaccgttaccctccggttaccccctaccccgttccgttaccctacccgttccgtacccgtaccg

SEQ ID NO: 108303 - DNA, 710 bp, Homo sapiens
  misc_feature: GYAE6OF02HX91H.49.40.D07.1.454.CMB.1.raw
  modified_base (221)..(221): a, c, t, g, unknown or other
  misc_feature (221)..(221): n is a, c, g, or t
  modified_base (370)..(370): a, c, t, g, unknown or other
  misc_feature (370)..(370): n is a, c, g, or t
  modified_base (449)..(449): a, c, t, g, unknown or other
  misc_feature (449)..(449): n is a, c, g, or t
  modified_base (478)..(478): a, c, t, g, unknown or other
  misc_feature (478)..(478): n is a, c, g, or t
tcagagtcgagagacacgaccggtgctcgatttagtgatagagcgtaacgaacagaggggctgggcctcaggaagcagcagtcgggggtgccgcagccatggcctggaccgctctccttctgagcctccttgctcactttacaggttatgtcggcctcctacgagtgattcagccacgttccgtctcagtcggccctgggacagacggccacatttaccgngtcgacggcgaagacaatcgaaataagatattcgactaggtatcaacaaaaagcctggccgacgtcccctgttttcggtaccttttatcgtagtacttacaaacgtccgggcccgtcgtacggggtatccccgtgacgcgtaactttcncgtcggctccgaacgtcggggtaacgaggccgactctagtacccgatacgactcgaacggtcccggagggccgaacggntacgggacgactgtaacgttactttacgnggtaccagggtccgaaacggcgaacctaaaactttcggtacacgttaagttccggggacgggaacgggtaaacctaaaggtttaccgaacccgggttccggtaacgggttccgaaccgggtaacccgttaacgggaccctacccgggtcccccgttccgggtaaccctccgttaccgtcccggtttacccccggccccttcccgtacccggtttactcccgtaccctaccgg

SEQ ID NO: 108304 - DNA, 637 bp, Homo sapiens
  misc_feature: GYAE6OF02FS4XV.49.40.D07.1.454.CMB.1.raw
  modified_base (303)..(303): a, c, t, g, unknown or other
  misc_feature (303)..(303): n is a, c, g, or t
  modified_base (367)..(367): a, c, t, g, unknown or other
  misc_feature (367)..(367): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtcggccctgggacagacggccacaattacctgtgacggcgagaacaatcgaaaataagaatattcactggtatcaacaaaagcctggccaggcccctgtttcggtcctttatcganacttcaatccggcccgctgggactccctgacgcgtattctcgtggctcctacggtcggggaacncgggccactctcgaaccatcatcgacgggcccgagggaccgacggatggacggtcgtacgacgttacgttacgtgtacgaggtaccgaaacggacgtaaccctaaacgtttcgtactaagttacgttacgggcggaaccgggtaactaaacgttcgaaccgttccgtacgggtccacgacccgtaggcccgtaccggtccccccgttaggtccacccgtttcctcgtttacccccgtacccttcccttaccttcccgtcctccgtacccg

SEQ ID NO: 108305 - DNA, 747 bp, Homo sapiens
  misc_feature: GYAE6OF02HQAXH.49.40.D07.1.454.CMB.1.raw
  modified_base (229)..(229): a, c, t, g, unknown or other
  misc_feature (229)..(229): n is a, c, g, or t
tcagagtcgagagacacgaccggtgctcgatttagtgatagagcgtaacaacagaggggctgggcctcaggaagcagcatcgggggtgccgcagccatggcctggaccgctcctccttctgagcctcttgctcactttacaggttatgtggcctcctacgaagtgattcagcctacgttccgtctcagtcggccctgggacagacggccaacaattacctgtcgacggnagaacaatcgaaatagatattcatgtatacaacaaagcctgaccacggccccttgttttcggtcctttatcgagtacttctaacgtccgggacccgcgtcgggactccccgtagacgacgtacttcctacgtcggctaccgacggtcggggaacgacgggaccacgtcctagaccgatacactcggacgggtaccgacgggtaccgacgacgtcggacggtactacgaactttagttaaccgtgttaaccgagggttaccgaaacggtaccgaacccgtaaacgtttcgactaacgtttacggttccggggaaccggaacgggtaacctaaaggttccggtaccccggttaccggtacgggtaccgtaaccgaccccgggttaacgggccccgttaacccggtccccccgttaccggggttcccgtaacccgttttcccgtttaccccggttttaaccccctcccccgtttaccccggttacccttttacccccggttccttacccgggtttaacccg

SEQ ID NO: 108306 - DNA, 835 bp, Homo sapiens
  misc_feature: GYAE6OF02I7YLA.49.40.D07.1.454.CMB.1.raw
tcagagtcgagagacacgaccggtgctcgatttagtgatagagcgtaacaacagaggggctgggcctcaggaagcagcagtcgggggtgccgcagccatggcctggaccgctctccttctgagcctcttgctcactttacgagttatgtcggcctctacgaagtgacttcagccacgttccgtctcgagtcggcctgggacaggacggccaacaattcctgtgacggcgaagaacaaacgtcgaaaataagaatatcgaacgttagtactacaaaacgaaacgccgtcggaccaacggtcccccgtttggtttttccgggttaccttttaataccggtaagtaccgtttaacgaacgtccggtccccgtacgtcgggacttcccgtgacgtacgtaactttccgtcgttcggccttaccgaaccggttacggggaacgtaccgggccgtaaccgttcgactaaccgtacgtaccaaccgtaccgggaccgggacccggaacggggaccggaacgggaacgttagggtaacgggcgttaagaacctttacgttaccgttacggtaacgacgggtaaccgtaaacggtaccgaaacccttaacgttaacgtaccgtaactttacgggtaccggggtaacgggaccggtaaaacgtaaaacgttcccgggtaaccgttaccggttacgggtaccgtaaccgaacccggtacggtcccgttaccccgtacccccgggttaaccggttacccttacccggttaccccgttccccggttaaccccttaccccccggttacccgttcccccgttacccggtttccgttaccccgttacccgg

SEQ ID NO: 108307 - DNA, 664 bp, Homo sapiens
  misc_feature: GYAE6OF02I3EBO.49.40.D07.1.454.CMB.1.raw
  modified_base (221)..(221): a, c, t, g, unknown or other
  misc_feature (221)..(221): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctccttgctcactttacaggttatggtcggcctcctaagaagtgattcagccacgttccgtctcagtcggccctgggacagacggccactaattccngtacgacggcgaagaacaatcgaaaataagaatacttcacgtggtatcaaactaaagcctggccacggccccttgttttcggtccttagtcgtagtacttacgaactccggccgtcgtgggtactcccgtgacgcgtattctcgtcggacctccgtacggtcggggaacacgggccactcgtcgacctactctacgtaccgcggggcccaagggccgacgtaggtacggacgggtcctcggtaacttaagttcgtcgtacggtaacggtcggaaacgtacgttaccgtaaacgttcgtcctaaagttcggttccgggacggacggtaacctaaacgttcgaccgttcgttacggcacgtcccgagtccgtcgacccccgttggacctaccgttccgttaccggttacccctcccgttcctacccgtccgtacctcccgtaccg

SEQ ID NO: 108308 - DNA, 726 bp, Homo sapiens
  misc_feature: GYAE6OF02HOEWM.49.40.D07.1.454.CMB.1.raw
  modified_base (267)..(267): a, c, t, g, unknown or other
  misc_feature (267)..(267): n is a, c, g, or t
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggccctcctacgaagtgattcagcctacgttccgtctcagtcggccctgggacagaccggccaacattacctgtgaccggcagaaacaatacgaaaatagaatatcactgtatacaanaaagctgccacggtcccttgtttcgtcttancgagtactcaagtccggccgngtcggactcccgtagacgcgtacttccgtcgttcggaccttaccgtaacggtaccggggtaaaccgacgggaccctacctcgtacgaacctaacgtcaacgtccggaacgggtacccgaaggggccgaagtacgtaggtacgaccgtacgtaacgttaactttaccgtggtaaccgtaacggtaacggaaacgtacccgtaaccgttaaaacgtcgttaacctaagtttacggtaccgggggaacgggtaaccggtaaacctaaaggtttcccgggtaaccgttcccggtagggtacccgaacgacccggtaacggtccgttaccggaacccgtcccgttacgggtaccctaccgttcgttaccccgttaccccacccctttcccgttacttcccttcccgtaccgg

SEQ ID NO: 108309 - DNA, 729 bp, Homo sapiens
  misc_feature: GYAE6OF02FQRSY.49.40.D07.1.454.CMB.1.raw
  modified_base (214)..(214): a, c, t, g, unknown or other
  misc_feature (214)..(214): n is a, c, g, or t
  modified_base (221)..(221): a, c, t, g, unknown or other
  misc_feature (221)..(221): n is a, c, g, or t
tcagagtcgagagacacgaccggtgctcgatttagtgatagagcgtaacaacagaggggctgggcctcaggaagcagcagtcgggggtgccgcagccatggcctgggaccgctctccttctgagcctccttgctcactttacaggttatggtgcctcctacgaagtgattcagcctacgttccgtctcaggtcggccctgggacaggacgccanattaccngtgacggcaagaacaatcgaaatagaatattcagtgtatcaacaaagcctggccacggccccttggttttcggtcctttagtcgagtaccttacgaatccgggacccgctagggactcccgtgacgcgtattctcgtcgctccgacggtacggggaacacgggccactcgacgaccactcactacggacggacccgagggcgacgagtggaggtctagtacttatacgtcgtacgaggtacgaagtacccgtaaccttaaagttcgtactaacgttacggttaccggggaccgggtaacgggaaccttaaggttaccggtacccggttaccggttacgggtacccgaacgggtaccccgtaacgggtcccgttacccgggtaacccccccggtttcggggtaacccttacccccggtttccgtttaccccccggtttaccccccggtttacccctttacccccggtttaccccgttacccgtttaccccggttaccccgttaacccgg

SEQ ID NO: 108310 - DNA, 799 bp, Homo sapiens
  misc_feature: GYAE6OF02FQYQ7.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacaggacggccacaattacctgtgacggcgaagaacaatcgaaataagaatatcactgtatcaacaaagcctggccaggcccctgttttcggtcctttatcgagtacttcaagtccggcccgctgggactccctgacgcgtacttctcgtggcctccgacggtacggggaacacgggcccactcgtacgacctatcctaagtcggaacggggtccccgaagggggccgaaccgggtaagtcgggaacgggtccgttacggtaaccgtttaactttaaccggtggtaccgaacggggtttaaccggaaaacggtacccgtaacccgttaaaaccgtttcggtaacccttaaaggttaccgggtttaccgggggaaccggggttaaacggggtaaaccctaaaaaggtttcccggtaaccccgggttccggttacggggtacctaacccggggtacccccgtaacggggtccccgttaccccgggtccccccggttaccgggttaaccctacccggtttcccgtttaccccggtttacccccccgttaacccccgttaccccctttcccggtttacccccttacccgttacccggttaccccgg

SEQ ID NO: 108311 - DNA, 781 bp, Homo sapiens
  misc_feature: GYAE6OF02IKOAS.49.40.D07.1.454.CMB.1.raw
  modified_base (140)..(140): a, c, t, g, unknown or other
  misc_feature (140)..(140): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacngttatgtggcctcctacgaagtgattcagcctacgttccgtctcgagtcggccctgggacaggaccggccaactaattaccgtggtacgacggcgagaaacaatacgaaaatagaatactcacgtgtatcaaacaaacgcctaggaccacggtccccttagtttttcggtcctttaagtccgaggtaccctttacgaaacgttccgggtacccgcggttacgggaacttccccgtggaacgtcgttacttcgtcgtcggctaccgacggtacggggaacacgggtacctactcgtacgaccctaagtctagaccggtaacggggtcccgaacggggtaccgaacggtacgtacgggtacggtacccttaggtaaacctttacgttacgtcggttaaccgaaggttaaccggaaacgtaacccgaacctttaaaacgtttcggtaactaaacgtttaccgggttcggggaaccggtaagggtaaacccttaaaggttcggaaaccccggtttcgtacgggacctaaccggtacccggaacgtccccgtaccggtcccccggttccggttacctaacccgttccgttacccggttcccccttaccgttcccgttacccgtccgttacccgttacgtaccccgg

SEQ ID NO: 108312 - DNA, 777 bp, Homo sapiens
  misc_feature: GYAE6OF02IF8LJ.49.40.D07.1.454.CMB.1.raw
  modified_base (355)..(355): a, c, t, g, unknown or other
  misc_feature (355)..(355): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctccttgctcactttacaggttatggtggcctcctagaagtgattcagcctacgtttccgtctcagtcggcctgggacagacggccaactaattaccgtgtgacggcgagaaacaagtacgaaaataagaattattccacttggtaactacaaaacgaaaacgccgtcggaccacggtccccttggtttttcggtaccttttagcgtaagtacttacaacgtccggtaccncgtcggactccgagagcgtattctcgtgacctacgacggtccggggaacacgggacctactcgtagacctagtacaagtaccggacgggacccggaggggtacccgaacgtacgtacggaccgggtaccgtaacggtaactttaacgtttaccgtaggtttaccggaacgggttaacccggaaaacggtaccccggttaaacttaaaacccgtttgtaaccgtaaacggtttacgggttacccggggacgggtaaacgggtaaaccttaaacgggttccgtaaaccggttcccggttaacggggccctaaccgggacccgtaacggtccgtccccggtaccccggtccggttaccaccgtttcccgtacccgtttcccccgtccctttccccgttaccgtcccttacccgtacccgttaccg

SEQ ID NO: 108313 - DNA, 631 bp, Homo sapiens
  misc_feature: GYAE6OF02JADMA.49.40.D07.1.454.CMB.1.raw
  modified_base (185)..(185): a, c, t, g, unknown or other
  misc_feature (185)..(185): n is a, c, g, or t
  modified_base (480)..(480): a, c, t, g, unknown or other
  misc_feature (480)..(480): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctnagtggccctgggacagacggccacaattacctgtgacggcgagaacaatacgaaaataagaatattcactggtatacaaacaaaagcctggccaggtcccccttgttttggttccttttatcgagtacttcaatcggcccgcgtgggactcccgtgacgcgtattctcgtggtcctccgacggtacggggaacgtacggggcccacgttcgtacgacccataccatcgacgggcccagggccgacgatggacgctgacttattactgtcgaggtacgacgacgacctaaacgttntactattagtcggaccggtaggaaccgtaagttcgacccgttcggtcgggtccacggtaccgacgtccgtaccgtcccccggttacgtcctacccttccgttaccggttcccctccccgttccttcccttccgtacccgttcccgttaccg

SEQ ID NO: 108314 - DNA, 803 bp, Homo sapiens
  misc_feature: GYAE6OF02H5OXF.49.40.D07.1.454.CMB.1.raw
  modified_base (220)..(220): a, c, t, g, unknown or other
  misc_feature (220)..(220): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggccctcctacgaagtgattcagccacgttccgtctcaggtcgccctgggacaggacggccacaattaccngtaggacggcgaagaacaatacgaaaataagaattattccaacgttggtaactacaaacaaaagccgtaggcccacggtaccccgttggtttttccggtaccttttacgtacgacgtacctttacaaacgttccggggacccgtcgtacgggtaacctccccggtaggacgtccggaactttccgtccgtagggacctttacccggaaccggggttaccgggggaaacctacggggtacccttaaccgttcgtacgtaacccgtataccgagtaccggacggggacccgtaggggaccgtaacgtcggtacgggaacggtctaacggtaactttacgttccgtacggtacggtaacggtaccgaaacgtaccgtaaacgtaaccgtttacgacttaagttacgtaccgggacggggtaacgtaaccgttaaagtcccggtaacggtcccgtagggtacccgtacggtacccgacggttcccgtacccgggtcccccgttaccgggtcctaacccgttcccgttaacccggttcccccgttaccccttccgttacccgttccgttacccgtccccggttaccgg

SEQ ID NO: 108315 - DNA, 626 bp, Homo sapiens
  misc_feature: GYAE6OF02GOH00.49.40.D07.1.454.CMB.1.raw
  modified_base (337)..(337): a, c, t, g, unknown or other
  misc_feature (337)..(337): n is a, c, g, or t
  modified_base (373)..(373): a, c, t, g, unknown or other
  misc_feature (373)..(373): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtggccctgggacaggacggccacaattacctgtgacggcgagaacaatcgaaatagaatatcactggtatcaacaaagcctggccacggccccttgttttcggtcctttatcgtagtacttcaacgtccggcccgcgtcgggactcccgngagcgtattctcgtcggctccgacggtcggggaacncgggccactctgaccatcatcgacggcccagggcacgagtcggagctgaacttatacgtgtcgaggtacgaagaccgtacctaagttcgtacagttacgtcgggacggacgggtaacctaaggtttccgacccgttcgtacggtaccgacgacccggtacggtcctacccgggtcccccgttcgggtacctaccgttccgttcccggttacccccaccccgtttcccttccgttcccttccgtccgtaacccg

SEQ ID NO: 108316 - DNA, 845 bp, Homo sapiens
  misc_feature: GYAE6OF02FNYMR.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctcctgctccactttacgaggttatgtcggcctcctacgaagtgattcagcctacgttccgtctcaggtcggacccgtgggaccaggaccggccaacgtaattacccgtggacgacgggcaagaacaagttacgaaaataacgaattacttacacgtagtatacaaactaaaacgccttcggacctacgggtccccctttggtttttcggttacccttttagtccggaacggttaaccctttccgtaaacggtcccgggtaccccgtcggttacgggggtaccttaccccggtggaacggtccggttaactttccgtaccgttcggtacccttcccggaccggttaccggggggaaactaccggggacccctcgtaccggtacggaaccctacttacgacgttacccgggacgggacccccggtaaggggacccggtacgtaacggtcgggaacggggtacctttacggaacccgtttaatttacccgggacggttaccggtaccgggttaaacggaacggtacccggtaacctaaaccgtttcgtaccgtaacgtttacggttacgggaccgggtaacggtaacctaaacgtttcccgggtaaccgttccggttacggaccgtacccgggaccgttacggcccttaccggtccccgttcccggacttaccgtcgtttaccccgtaccctaccccttccgtccttaccgtcctcgttacccg

SEQ ID NO: 108317 - DNA, 810 bp, Homo sapiens
  misc_feature: GYAE6OF02GC3HN.49.40.D07.1.454.CMB.1.raw
tcagagtcgagagacacgaccggtgctcgatttagtgatagagcgtaacgaacgagaggggctggcctcaggaagcagcagtcgggggtgccgcagccatcggcctggaccgctctccgttctgacgccttccgttgtcgtcctactttacaggtttagttcgttcggtcccttccttaacgtaaaggtggtatttcagccgtacgttccgtctcagtcggtcccgtgggactacggacgggccacgtaagttacccgtggtcggaccgggcgaacgtaaacgaagttacgaaaataacgtaattacttccacgttggttaactacgaaaacctaaaacgtcccgttacggacccgtaaccggtcccccgtttggtttttacggttaccctttttaagtccggtaacgtaccgtttcgtaaccgttccgggaccccgtcgtacgggacctcccgtggacgtcggtactttcgtcgtcggtcttaccgacggtacggggaagtacgggtaccacgtactacgaacctatacgacgtcggacgggcccgagggtaccgacggagtcggacggtcttacggtaaccttacgttacgtacggtaccgaggttaaccggaacgtaccgtaaccgttaacgttcgtaccgtaagttacgtacgggacgggtaacggtaaacctaagttccggaaccgttccgtacgggtacgaccggtacccgtaggtcccgtaccggtccccgttacggtacctaccggttccttcccgttaccccgtaccctttaccgtcctaccgttccgtaccgtacccggg

SEQ ID NO: 108318 - DNA, 756 bp, Homo sapiens
  misc_feature: GYAE6OF02JHQO0.49.40.D07.1.454.CMB.1.raw
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (360)..(360): a, c, t, g, unknown or other
  misc_feature (360)..(360): n is a, c, g, or t
tcagagtcgagagacacgaccggtgctcgatttagtgatagagcgtaacaacagaggggctgggcctcaggaagcagcactcgggggtgccgcagccatggcctggaccgctctccttctgagcctccttgctccactttacaggttatcgtggcctcctacgaagtgattcagccacgttccgctcagtggccctgggacagacgccacaatcngtgacgcanaacaatcgaaaatagaatatcactgtatcaaacaaagctggccagtcccctgtttcgtaccttancganacttacaactcggcccgctaggactcccgtgacgtcgattcacgtggcctccacggtcggggaaccncgggaccctaactcgtacacccgtatccgaatcccggaacgggtccccaggggtaccaacgtaagtcggacgtaccgtacggtaacttaacgttaccgagggtttcccaaacggggttccgaaaacggtaacccgtacccgtaaaacgtttccgggtaactaaccggttaaccgttaccggggacggtaaaccggggtaaccctaaacggtttacgggtaacccgtttccccgggttaaaggggttcccaaacgggaaccccgtaacggggttcccgtaccccggttaccccccggtttagggtaacccttaccccggtttaacccgttccggtttaccccccgtaaccccgtttccccttacccgttaacccggtttcctaccccggttaacccg

SEQ ID NO: 108319 - DNA, 680 bp, Homo sapiens
  misc_feature: GYAE6OF02HHB7L.49.40.D07.1.454.CMB.1.raw
  modified_base (216)..(216): a, c, t, g, unknown or other
  misc_feature (216)..(216): n is a, c, g, or t
  modified_base (305)..(305): a, c, t, g, unknown or other
  misc_feature (305)..(305): n is a, c, g, or t
  modified_base (386)..(386): a, c, t, g, unknown or other
  misc_feature (386)..(386): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctcttgctcactttacaggttatgtggcctcctacgaagtgattcagccacgttccgctcagtggaccctgggacagacgcaacaattaccngtagacggcgagaacaatcgaaataagaatattcactggtatacaaacaaaagcctaggacctacggccccttaggttttcgcctttancgtagtactcaactcggacccgctagggactcccgtagacgcggtacttctacgtcggcctacgaccggtcgggggaaacncgggacctacgtcgtacggacctatcaacgtcgaacggggtacccaggggacctacgagtcggaggactacgaattactacggttagccgtaggtacgaaacgtaccgaaccgttaaacgttcgtactacgttaacgtcgggacccgggtaaggaccgttaaaacgttcgaacccggttccgtaacggccgtaaccggtccgaacgttccggtcccgtccccgtacgggtcctaccgtaccgttaccgttccccggttaaccctccgttcccgtaccgtttcgaccgttaaccg

SEQ ID NO: 108320 - DNA, 759 bp, Homo sapiens
  misc_feature: GYAE6OF02HFEYL.49.40.D07.1.454.CMB.1.raw
  modified_base (220)..(220): a, c, t, g, unknown or other
  misc_feature (220)..(220): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctagaagtgattcagcccacgttccgtctcagtcggccctgggacaggacggccactaattaccngtgacggcgagaacatacgaaataagaatattcactggtatacaacaaaagcctggccacggtcccctgttttcggcctttatcgacgtaccttacaacgtccgggccccgcgtcggggtacttccccgtaggacgtacggactttcctccgtggccttaccgacggttaccgggggaacacggggccctaaccgtccgtaacgaacccagtccgacgtccggaacgggtcccaaggggccgaacggagtggaacgggtctacgtaacgtactttacgtggtacgacgggttacaacggtaaccgacccgtaaacgtttcgtacgtaacgtttacgtcggggtaaccgggtacgggtaaccgtaaacgtttcggtaaccccggttccggttacgggaccgaaccgggacccggtacggggtacctccccgggtaacccccggttacgggttaccctacccggtttacccgtttaccggtttaccccccgttaaccccctttccccgtacgtttccccgttaccgtacccccggtaaccg

SEQ ID NO: 108321 - DNA, 701 bp, Homo sapiens
  misc_feature: GYAE6OF02FM1U9.49.40.D07.1.454.CMB.1.raw
  modified_base (217)..(217): a, c, t, g, unknown or other
  misc_feature (217)..(217): n is a, c, g, or t
  modified_base (323)..(323): a, c, t, g, unknown or other
  misc_feature (323)..(323): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagcccacgttccgtctcagtggccctgggacagacggccacaattccngtgacggcgagaacaatcgaaataagaatatcactggtatcaacaaagcctggccacggtcccctgttttcggtccttttatcgagtacttcaatccggtccccgngtgggactccccgtggagcgtattctcgtggcctccgacggtacggggaaccacgggccctactcctcggaccctatccgtaacgtcgaccggggaccccgaggggacgtaccggactcgggacgggtcttaggtaccgttaactttacgtcgttaccggtagggtaccggtaaacgaccgtaacctaaacttcgtactaagtttaacggttccgggacgggtacgggtaacctaaaggtttcggaacccgttccggttacgggtaccgtaccgacccggaacggcctcccgggtcccccctcggttccaacccgttcccgtttccggttcccccccgtccccgttcccgttccctccccgtttacgtacccggtccc

SEQ ID NO: 108322 - DNA, 849 bp, Homo sapiens
  misc_feature: GYAE6OF02GNC07.49.40.D07.1.454.CMB.1.raw
  modified_base (301)..(301): a, c, t, g, unknown or other
  misc_feature (301)..(301): n is a, c, g, or t
tcagagtcgagagacacgaccggtgctcgatttagtgatagagcgtaacaacagaggggctgggcctcaggaagcagcagtcgggggtgccgcagccagtggcctggaccgcttccttccttcgtgacgtcccttccttgctctaactttacgaggttatgtcggcctcctaacgaagtgtattcgacgcctaccgttccgtctcacggtcggcctgggacacggaccggacctaactaaccgttaccgtggtacggaccggtacgaagtaaacctaaacgtacgaaaataaacgtaattnttaccacgttaaggttaacctaacgtaaaaccgaaaacgtccgtacggaccccgtaccgggtacccccttttggttttacggtttacccttaacgtaccggtaacgtttaaccctttaacgtaaccgttaccgggcccccggtaggttaccgggtaccttccccggtaggtaaccggtaccgttagtttcccgttcgtaccggtcctaacccgggtacgggtaaccggggacgtaccgggtccaacgttccgacgtaccacttcgacgtaccgggaccgtaccggacgggtgaaccgtgtacgggacgtacgttacgtaacttacgttacgaggtaacccgggtaagtaaccggaccgtaaccgtaaccgtaattcgtagtaacgttcgtaccgggtaagggacctaacgtacggtacgtcccgggtagtaccggtccgaccgttagacccgtcccggtaccggccccgttacgtacccgtaccggtttacccgttcccgttaccccccgtcgtttaccccgtccttttaccggcccgttacccgtcg

SEQ ID NO: 108323 - DNA, 851 bp, Homo sapiens
  misc_feature: GYAE6OF02HZNY9.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacaggttatgtggcctcctacgaagtgattcagcctacgttccgtctcaggtggcccgtgggacaggacggccaactaattacctgtgacggcgagaacaatacgaaaataagaatattcactggtactacaaacaaaagcctggaccacggtccccttggtttttacggttccttttacgtcgagtactttactaacgttccggcccgtcggttcgggaaccttccccgtaggacgtcgtaactttccgtccgtacggtccttcccggtaaccggtaccggggggaaaccgtcggggacccctaaccgttaccgtacgaacccgtacgttaccgacgttaacccggaccggggtaccccggaacgggggacccgtaacggacggttacgggaaccgggttccgttaacggtactttaacgtttaacgttcgggtacccgttaaacggggtaaccggtaaacggtaacccggtaacccttaaaacgttttcggtaaccttaacggtttaacgggttccgggggaacgggtaaccgggtaaaccgttaaagttcccggacccggtttaacccgggtacggtaacccgaacccgtacccgggtaaccggtccgttacccccgggtaaccccgttccggttaccctaccgtttcccgttaccccggttccccctaccccgtttcccgttaccgtttccctacccgttccgtaaccgg

SEQ ID NO: 108324 - DNA, 921 bp, Homo sapiens
  misc_feature: GYAE6OF02G9Q45.49.40.D07.1.454.CMB.1.raw
  modified_base (120)..(120): a, c, t, g, unknown or other
  misc_feature (120)..(120): n is a, c, g, or t
tcagagtcgagagacacgaccggtgctcgatttagtgatagagcgtaacaacagaggggctgggcctcaggaagcagcagtcgggggtgccgcagccatggcctggaccgctctccttcngagcctcttgctcactttacaggttatgtcggcctcctagaagtgattcagcctacgttccgtctacaggtcggccctggggaaccacggaccggcccaaactaactttacccgtggtacggaaccgggcgaaagtaaacctaaagtaccggaaaaataaggaacttaattcgaacgttaggtaataaccgaaaacaaaacgtcctggaccaaggtcccccttaggtttttcggtaccttttaacgtcggtaacgtacctttaacgaacgttcccgggtaccccgtcggttacggggaaccttccccgtaggtacggtacgtacgtttcctaccgtcggtacctccgtaacggtacggggaaacgacgggtaccacgtacgtacgactaacttccgaattaccgggacggggtaccccgaagggggtacccaaacgggtacgtacgggtaacgggaccgttaacgggtaaaccttaacgttttaccggtacggttaaccggtaaaaccgggttaccgggaaaaccggtaaacccggtaaacccgttaaaaccggtttcgtaaaccttaacggtttaaaccggttaaaccggggggtacggggtaaaccgggttaaacccttaaaaacgggtttcccgggaaccccgttttaaccgggcggttaaccccggaaccgtaccccgtaacggggtcccttaacccgggtcccccgtaaccggttacctaaccgtttcccggttacccgttaccccctaacccgttccggtacggtttcgggtaacccgggccgggttaacccggg

SEQ ID NO: 108325 - DNA, 599 bp, Homo sapiens
  misc_feature: GYAE6OF02G57G5.49.40.D07.1.454.CMB.1.raw
  modified_base (295)..(295): a, c, t, g, unknown or other
  misc_feature (295)..(295): n is a, c, g, or t
tcagagtcgagagacacgaccggtgctcgatttagtgatagagcgtaacaacagagggctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaagcctggccaggcccctagtttggtcctttancgagacttcaagtcgccgctgggatcccgtgagcgattctctggctccgacggtcggggaacagggccacgttctacgacctatccagtccgagggtccccaggggtcgacgagtggacgcgtgactatacgtgtacgtacggtcgaaggaccgtaccaaacgttgtactagtacgttcgggacgggtaggacctaaagtcgaccgtcgtcggtacacgacccgaggcctacgtcccccgtaggtcccacgttccgtccgttaccccgtaccccttcccgttacctcccttccgtaccgtaccg

SEQ ID NO: 108326 - DNA, 690 bp, Homo sapiens
  misc_feature: GYAE6OF02IDAGQ.49.40.D07.1.454.CMB.1.raw
  modified_base (121)..(121): a, c, t, g, unknown or other
  misc_feature (121)..(121): n is a, c, g, or t
  modified_base (394)..(394): a, c, t, g, unknown or other
  misc_feature (394)..(394): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgngcctccttgctcactttacaggttatgtggcctctacgaagtgattcagcctacgttccgtctcagtcggcctgggacagacggccacaattacctgtgacggcgagaaacaatacgaaaataaagaattattacacgttggtactacaaaacaaaacgcctggccacggtccccttgttttcgtactttatcgagtaccttacaacgtccggcccgtgtcgggtactcccgtgacgcgtacttctcgtggcctccgaccggtacggggaacncgggcccacgtcgtacgacctatcagtccgacgggcccgagggcgacgagtggacgtctagtacttaacgttctagtcgacggtaaccgaacggacccaaccgttaaacgtttcgtactaacgttacggttaccgggaacgggtaccggaaacctaacggtccgtacccgtccggtacgggaccgaaccggtacccgaacgggtcctaccccggtcccccgttaggtacccctaccgttcccgttaccccgtttccccgcccctttcccgttacctttccgtacccgtccgtaccg

SEQ ID NO: 108327 - DNA, 790 bp, Homo sapiens
  misc_feature: GYAE6OF02GT3I8.49.40.D07.1.454.CMB.1.raw
  modified_base (497)..(497): a, c, t, g, unknown or other
  misc_feature (497)..(497): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagccctccttgctcactttacaggttatgtggcctcctacgaagtgattcacgtcccaccggtttccgtctctaggtcggcccgtgggaccagaccggccaactaacttacctgtcgacggcgaagaactaatacgaaaataacgaattaacttacctacgttaggtaactacaaaacctaaaacggccgtaggacccgaccgggtacccccgtttggtttttaccgggttcctttaacgtcggtaacgtacctttaccgaacgtccgggccccgtcggtcgggtaacttcccctggacgtaccgtatttccgtaccgtcggtccctacgaccgggtaccggggaaacgtcgggacctacgttaccgacgtaaccncgtacctacgttccggacccggggaccgacggacggtaacgtaggtcggacgggtcctaggtacttaagttccgtagtcggacggtaaccgaacgtaccgtaaccgttaacttgtaactagtttacgcggggaacggtacggtaaaccttaacgttccggtaccggtccttacgggcaaccggacccggtacgcccgtaccccggttccccgtaacggttccctacttaaccggtttccccgttacccccgttaccccttccggttaccctttcgttacccgtacgtacccgg

SEQ ID NO: 108328 - DNA, 768 bp, Homo sapiens
  misc_feature: GYAE6OF02F935X.49.40.D07.1.454.CMB.1.raw
  modified_base (111)..(111): a, c, t, g, unknown or other
  misc_feature (111)..(111): n is a, c, g, or t
tcagagtcgagagacacgaccggtgctcgatttagtgatagagcgtaaacaacagaggggctgggcctcaggaagcagcagtcgggggtgccgcagccatggcctggaccnctctccttctgagcctccttgctcactttacaggttatgtcgcctcctaacgaagtgattcagcctaccgttccgtctgaggtcggcccgtagggacacggaccgaccaactaacttccgtggacggacggacgaaagaaacctaaagtaacgaaaaataaagaaattacgttacacgttagtactaacaaaaaccaaacgccgtaggacccgtacggtccccttttggttttcggttaccttagcgactactacgaacgtccggccgcgtaggacttccgagacgtcgtacttctcgtcgacctaccggacgggtacgggaaacgcggtccaacgttcgaacgaactagtaccacgtaccgggaccgggacccggagggaccaagtagtcgggacgtacgtaacgtaactttacgtacggtcgtaacgacgggtaaacgaacgtacccgtaacctaaagtttcgaaccttaagtacgttcggggaacgtaacggaaacttaaggtccggtaacccgtgggtacggtaccacgggaaccccgtaggccccttccccggtaccccgttacgggtacccttacccggtttaccggttacccccggttaccccctcccgttttaaccccgccgtttaaccccttaccgtaccccggttac

SEQ ID NO: 108329 - DNA, 949 bp, Homo sapiens
  misc_feature: GYAE6OF02FR9JS.49.40.D07.1.454.CMB.1.raw
  modified_base (89)..(89): a, c, t, g, unknown or other
  misc_feature (89)..(89): n is a, c, g, or t
  modified_base (120)..(120): a, c, t, g, unknown or other
  misc_feature (120)..(120): n is a, c, g, or t
  modified_base (147)..(147): a, c, t, g, unknown or other
  misc_feature (147)..(147): n is a, c, g, or t
  modified_base (924)..(924): a, c, t, g, unknown or other
  misc_feature (924)..(924): n is a, c, g, or t
tcagagtcgagagacacgaccggtgctcgatttagtgatagagcgtaacaacagaggggctgggcctcaggaagcagcagtcgggggtnccgcagccatggcctggaccgctctccttcngagccttcttgctcactttacaggttntgtgcctctaacgagtgattcagcctacgttccgtctcgaggtcggtcccgtgggacaggaccggcctacaaagtttcctggtcgacggacaaaaggaaaccaaatacgaaaaataaggaattaacgtttccagttcggtaaataccgaaacaaaaggtccctagggacccctaacgggtcccccttgggttttttacgtacccgtttttaagtccggtaacgtaacgttttaccaacggttccccgggtaccccggtccgttaagggggtaccttcccgtagggaaccggtactttacgttaccgttacggcgggttcccctaccggtaccgggttaaccgggggaaacccggtaggggccccttacgttaccgttaccggaaccactttaaccggaccgttaccgggaccgggggtaacccccggaaaggggggacccggtacccggtaaaggttaccgggtacgggtacccggttaacggttaaaccgtttaaccgtttaccggttagttacccggtaagggggttaaccggaaaccggtaaccccgttaaccgttaaaaccgttttcgggtaacctttaaagggttaccggttacgggtaacgggggtaacgtaaccccggtttaaaaggttcccggttaacccggttacccggttacgggttaacccgaccgggttaaccctaacgggtcccgacccgggtttccccccgtaaggttcccccggtaaccgttccctttaccggttacccccctacccgttccccgtttaccncccgttttacccgacgttacccggg

SEQ ID NO: 108330 - DNA, 761 bp, Homo sapiens
  misc_feature: GYAE6OF02JK2BY.49.40.D07.1.454.CMB.1.raw
  modified_base (246)..(246): a, c, t, g, unknown or other
  misc_feature (246)..(246): n is a, c, g, or t
  modified_base (681)..(681): a, c, t, g, unknown or other
  misc_feature (681)..(681): n is a, c, g, or t
tcagagtcgagagacacgaccggtgctcgatttagtgatagagcgtaacaacagaggggctgggcctcaggaagcagcatcgggggtgccgcagccatggcctggaccgctcctccttctgacgccctccttgctctactttacgaggttatgtcggccttccgtaacgaagtgtacttcaagccctacgttccgtctcaggtcggccctgggacaggaccggccacaattcctgtgacggcgaanaaacaatcgaaaataacgattacttcgacttaggtaactacgaaaacaaaacgcctaggcccaacggtccccctttaggtttttcggttccgtttagtaccggacgtacttacgtaacgtccggaccccgtcgtacgggtactcccgtagacgtcgtacttccgtacgttcgtccgtaccgtacgggtaccgggaaacgtccgggaccctacttccgtacgtaccgacgtacctactaccgggtaaccgggacccggtagggtcccgtaacggtacggtcgggaacggttccgtaaacgttaccgttaacgtttaccgacggtttacgtaacgggtacgtaaacggaacccgtaaccttaaccgtttgaccgttagtttaccgggcggtaaccgggaaacggtaaccttaagtcgtaacccgttgtacggtaccncggacctcggtaccgcccgtcccggtagtcccgtaacttccgttccctacccttcccgtaccgtcctcgtaccctcgtcg

SEQ ID NO: 108331 - DNA, 787 bp, Homo sapiens
  misc_feature: GYAE6OF02G9GT6.49.40.D07.1.454.CMB.1.raw
  modified_base (148)..(148): a, c, t, g, unknown or other
  misc_feature (148)..(148): n is a, c, g, or t
tcagagtcgagagacacgaccggtgctcgatttagtgatagagcgtaacaacagaggggctgggcctcaggaagcagcagtcgggggtgccgcagccatggcctggaccgctctccttctgagcctccttgctcactttacaggttangtggcctcctaacgaagtgattcagccacgttccgtctcagtcggccctgggacaggacggccaacaacttacctgtagacggcgaagaacaatcgaaaataacgaatattcatggtatacaacaaaaagtccaggtccaggtccccttggttttacggtcctttaagtacgagtaccttacgaaacgttccggacccgtacgttcgggaactccccgttaggaacgtacggtaatttccgtacgtcggggtacctaccggtaaccggtacggggaaaccgaggggtacccctacgttccgtaacgaccctaatacccgtaagtacggaccgggacccggtaacggggaccgaaacgtagtaggaacggtaccgtagtaccgttaaagttacgtacggtacgtacggttaaccgggaaacgtacccgaacccttaaaaacgttcgtaaactacgtttaacgtccggggtacggtaaacggggaaccttaaaaacgttcggaacccgttaccggtacgggttcgaaaccgccccgtaaagggtcctacccggtcccccttaaccgggtcctaaaccttcccggttcgttaaccccccgtacccgttaccgttcccgttaccttcccgtaccgttaacccg

SEQ ID NO: 108332 - DNA, 826 bp, Homo sapiens
  misc_feature: GYAE6OF02JX8RP.49.40.D07.1.454.CMB.1.raw
  modified_base (212)..(212): a, c, t, g, unknown or other
  misc_feature (212)..(212): n is a, c, g, or t
  modified_base (775)..(775): a, c, t, g, unknown or other
  misc_feature (775)..(775): n is a, c, g, or t
tcagagtcgagagacacgaccggtgctcgatttagtgatagagcgtaacgaacagagggctgggcctcaggaagcagcatcgggggtgccgcagccatcggcctggaccgctctccttctgagcctcttgctcactttacaggttactgtcggcctctacggaagtgatttcgagccacgtttccgtctacaggtcggtcccctggggaccnggaaccggtccaccgtaattccctgtacgacggcgagaaaccaagtacgaaaattaagaattattacacgttaggtactacaaacaaaacgtcctacggaccacggccccgtttaggttttcgttaccgttttaacgcgtaacgtacctttcgaaacttcccgggtacccgtacggttgggtaaccgttccccgtaggtacgaccgtatttacccgtcggtaccggtccttccggaaacgggttcccggggaaacgtacccggggtaccctaccggttaccgttaggaacccccgtttaagtaccccgttaactacccggggaacgggttaccccggacggggtacccgtaaacgggacgtacgggtaaccgggtcttaacggtaaccggttaactttacggttacggttaaccggtacgggttacgaaaaccggtccgtaaaccccgtaaacgtttagttacgtaacgtttacgtaccggggtacgaacggggtaaccttacgtaccggtaccgtccgtacggtcgaaccgtacgacggtcctaccgggtcccgtcgttacnccgtacgtttcccaccggttcccctaccgtcctttcgtcccgacgttcccg

SEQ ID NO: 108333 - DNA, 607 bp, Homo sapiens
  misc_feature: GYAE6OF02HINT7.49.40.D07.1.454.CMB.1.raw
  modified_base (409)..(409): a, c, t, g, unknown or other
  misc_feature (409)..(409): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacaggttatgtggcctcctacgaagtgattcagccacgttccgtctcagtggcctgggacagacggcaacaattacctgtgacggcgaagaacaataccgaaaataaagaatattcactaggtatcaaacaaaaggcctggccacggtccccttgttttcggtcctttaatcgagactttcaactccggacccgcgtcgggtatcccgtagacgcgtattctctgggcctccgacggtacgggaacacggggtccacttcacgacctctacnctacgacgggtcccgacgggcgtaacggatcggaaggcctagacgttacgttactgggtaacacgggtacaaggaccgacctaaacttcgatactacgtcggcggaacggaactaagttcgaccgtcgtacggcacgtaccaggcctccggcccctggtaccacgtcttccgtcccgtccctcctctcttcgacctcg

SEQ ID NO: 108334 - DNA, 787 bp, Homo sapiens
  misc_feature: GYAE6OF02IM8N8.49.40.D07.1.454.CMB.1.raw
  modified_base (89)..(89): a, c, t, g, unknown or other
  misc_feature (89)..(89): n is a, c, g, or t
  modified_base (121)..(121): a, c, t, g, unknown or other
  misc_feature (121)..(121): n is a, c, g, or t
  modified_base (240)..(240): a, c, t, g, unknown or other
  misc_feature (240)..(240): n is a, c, g, or t
  modified_base (387)..(387): a, c, t, g, unknown or other
  misc_feature (387)..(387): n is a, c, g, or t
  modified_base (482)..(482): a, c, t, g, unknown or other
  misc_feature (482)..(482): n is a, c, g, or t
tcagagtcgagagacacgaccggtgctcgatttagtgatagagcgtaacaacagaggggctgggcctcaggaagcagcagtcgggggtnccgcagccatggcctgggaccgctctccttcngacgcctcttgctacactttacgaggttatggtcgccctaccgtaaggaagttcattcgacgcctacgttccgctcaggtcggaccgtagggacaggtaccggaccactaaacttccgnggtcgacgggcgaagaaacaagtaacggaaaataaaggaacttactcgacgtggtaactacaaaacaaacggtcctacggaccacgggtcccctttggtttaccggtcctttaagtacgaacgtactttacgaacgtccggtacccngttacgggacctccgtgacggtcctattccgtcgtcgggtcctaccgacggggtacgggaaaccgtcgggtacccacgttacgtaccgaacgttntaccgacgttccggaaacgggcccgggacgggacggaaacgtggaacgacggggtcctacgtaacgtacgttacgtaggttacgaacggtaccggtaaacggacccttaaccgtaaattcgtaaaccgttagtaccgggttacggacggggtaaccgtaaaccgttaaagttcccggttaccgggtccggaacggttaccgaacgtccccgtaacgggtcccgttaccgggccccgtttaccggtaccgtacccttaccggttcccttaccccgtaccttcccgttctcccgttcggacgttccg

SEQ ID NO: 108335 - DNA, 783 bp, Homo sapiens
  misc_feature: GYAE6OF02J1ZOY.49.40.D07.1.454.CMB.1.raw
  modified_base (242)..(242): a, c, t, g, unknown or other
  misc_feature (242)..(242): n is a, c, g, or t
  modified_base (501)..(501): a, c, t, g, unknown or other
  misc_feature (501)..(501): n is a, c, g, or t
tcagagtcgagagacacgaccggtgctcgatttagtgatagagcgtaacaacagaggggctgggcctcaggaagcagcatcggggggtgccgcagccatggcctgggaccgctctccttctgagcctccttgctcactttacgaggttatgtcggcctcctacgaagtgattcacgcctacgttccgtctcgaggtcggcccgttggggacacgggtaccggacccaactaaactttcccgnggttaggaccgggtacgaaggtaaacaaacgttacgaaaaataagaaattacctttcgaaacttgggttaactaccaaaacgtaaaacgccctacgggacccacgggtcccctttaggttttcggttcctttacgtacgaacgttaccttacgtaacgtccgggtccccgtagtcggggtaacctcccgtgacgtcgtattcgtcgtacggcctccggacggtacgggggaaccacgggtccctacgtacgtacgaacnctacgtacgccggaccgggacccgaacggggccgtaaggtatcgggacggtacgtcggtaaacttcggttacgtacggtccggtaacggttaaccgaaagcccggtaaaccgtacttacggtactaacggttacgtccggggacggaacggtaacttaaaccgggtcgtccgttaccggtcggtaccaccgacccgttagggaccctcccggtaaccccggttcgtactcccttccggtccccgttaccctcccgtaccttccgttacccgtcacccgttcg

SEQ ID NO: 108336 - DNA, 791 bp, Homo sapiens
  misc_feature: GYAE6OF02H1UAM.49.40.D07.1.454.CMB.1.raw
  modified_base (616)..(616): a, c, t, g, unknown or other
  misc_feature (616)..(616): n is a, c, g, or t
  modified_base (686)..(686): a, c, t, g, unknown or other
  misc_feature (686)..(686): n is a, c, g, or t
tcagagtcgagagacacgaccggtgctcgatttagtgatagagcgtaacaacagaggggctgggcctcaggaagcagcagtcgggggtgccgcgagccagtcggcctgggaccgtcctctccttcgtacgcgtcccttcttcggactcctacttttacgaggttatggtcggcccttccgtaacggagtgtacttccgacgaccgtaccgttcccggtctcgacggtccgggtcccgtaggggaaccaacgggaccggtcctaaacctaaacgtttcccggtaggtaccgggaaccggacggaaagaaaacctaaaggtacaaaaaattacggtaattacggttccgtaaagtcgtaactaaaccgaaaacgaaaacgtccgtacgggaccgaccggtccgttttggttttaccggtacccttttaggacgtacgtacttaacgtaacgtccgggacctcggtacggtactccccggtagacgtcgtaactttcgcgtaccggccgtaaccgggacggtacggggacgaccggttaacgtccgttacgacgctacgtacacggtaccgacggccggtaaggcgaacgtgacggtacgactactagttactaacggntaacggtgaacgaacgcgtactaacgtcgtactggttacgacggtacggaaacgaccttaagcgttaccnccgtagcccgacgttcgacgtccgtcccgggtccaccggtccgtacgttccccgtcccggttaccctacccggtcctttaccgtcccgttcgacccggtttaccc

SEQ ID NO: 108337 - DNA, 928 bp, Homo sapiens
  misc_feature: GYAE6OF02IOMIZ.49.40.D07.1.454.CMB.1.raw
tcagagtcgagagacacgaccggtgctcgatttagtgatagagcgtaacaacagagggctggcctcaggaagcagcatcggggtgccgcagccatggcctggaccgctctccttctcgagtcctcttcgctcactttacaggttatgtcggcctctacgaagtgattcagtccaggttccgtctacgagtcggcccgtacgggtacaggtaccggcctaacgtacttaccgttggtacggacggtccgaaggtaaaccaagttacccggaaaaattaacggaacttaacgtttaccaacggttacgggttaactaccgtaaaaccgtaaaaaggtcccgttacggtacccggtaaccgggttcccccgttttgggttttacggtttaccttttaccgtaccggttaaccgttacgtttaccgtaaacggtcccggggtacccctacgggtacggggtacgttaccccggtaggtaccgtcgttaacgtttagttaccccgttacgggcccgttaccccggttaagggacccggggggtaaaccgtccggggacccccgttaagttttacccggtaccggtaaacttaaccgtaccgtacccgttaaacggggacccggtaacccccgggggttaagggaacccggtaacggtacggtaccggaaccgggtaaccggtttacggtacccgtttagttaaccgttcgggtaacgtacgggttaccggtaacgacccgtaaccgtaaacgttccgtacgtaacttcgggtaccggagggtacgaacccgttaagtaccgggtacccgttcggtagggtaacctaccggaccggtaccggtacggtcccgtaacccgggttacgtacccggtccgttaccgtttccggttacccccctacgttacccgttctccccgttaccgtcgtaaccg

SEQ ID NO: 108338 - DNA, 693 bp, Homo sapiens
  misc_feature: GYAE6OF02FOJE1.49.40.D07.1.454.CMB.1.raw
  modified_base (265)..(265): a, c, t, g, unknown or other
  misc_feature (265)..(265): n is a, c, g, or t
tcagagtcgagagacacgaccggtgctcgatttagtgatagagcgtaacaacagaggggctgggcctcaggaagcagcatcgggggtgccgcagccatggcctgggaccgctctccttctgagcccttccttgctcactttacagttatgtggcctcctacgaagtgattcagcctacgttccgtctcagtggcccgtgggacagaccggccaactaattacctgtgacggcgagaacaagtacaaataagaatattcactgtanacaaacaaagctgccacgcccctgttttgtcctttatcgagtacttcaatccggccgcgtgggactcccgtgagcgtattctcgtcgctccggacggtccgggaacgtcgggcctaccgtcgtacgaccaattccatccggacggggccccgaggggcgaacgtagtcgggagccgtagtaacgttacttacgtacggttacgaaggttacggaaacgtacccgaacccttaaacgttcgttacgtaactttaggttccggggacgggtaaccgggtaaacccttaaaggttacccggtaccccgtaccgtttacgggaccgtaaccgacccggtaacggtcccggtaccccggtccccgttacgggtccctaccggtccctttccgggtcccctcccgttccctaccttccgttaccgttctacccg

SEQ ID NO: 108339 - DNA, 809 bp, Homo sapiens
  misc_feature: GYAE6OF02J0MVK.49.40.D07.1.454.CMB.1.raw
  modified_base (75)..(75): a, c, t, g, unknown or other
  misc_feature (75)..(75): n is a, c, g, or t
  modified_base (125)..(125): a, c, t, g, unknown or other
  misc_feature (125)..(125): n is a, c, g, or t
  modified_base (153)..(153): a, c, t, g, unknown or other
  misc_feature (153)..(153): n is a, c, g, or t
  modified_base (240)..(240): a, c, t, g, unknown or other
  misc_feature (240)..(240): n is a, c, g, or t
  modified_base (249)..(249): a, c, t, g, unknown or other
  misc_feature (249)..(249): n is a, c, g, or t
  modified_base (700)..(700): a, c, t, g, unknown or other
  misc_feature (700)..(700): n is a, c, g, or t
tcagagtcgagagacacgaccggtgctcgatttagtgatagagcgtaacgaacgagaggggctgggcctcaggancagcacgtcgggggtgccgcagtccatcggcctcggaccgctctccttcngacgcctccttgctctacttacaggttntgtcgcctactacgagtgtatcagacctccgttcactcacggttggcccgttgggactacggaccgccctaactaaacttcctaggnggaaccggngaaacgaaacctataacgaaataaggattatcaaccggttagtaactacgaaaacgtaaacgccgtacggaccgtcggtaccccgtttacggtttgggttccctttaaggtactacgtccttaacgaaccggttccgggtcccgtacggtacggggccttcccgtaggtaccgaggttacttcgtacgttccggaccttcccggacgggtaccggggtaaacgcccggtaacctacccgagtacctaaccggtacttaccgaaggtcccgggaccgggtaccggaagggacgtacgagtacgggtacgtaccgtaagtaacccttgttaggtccgtaggtaacccgtaggtaaacccgacgtaaaccgttaagttactaacggtaacgttaccggttaacggggacggaacgggttaaacgtacctccggggtacgttacccggtaccggngtacccgacgggacccggttacccggtacccgtccccggtaccgttccggtaacccttccggtcccgtttccccaaccggttcccctggtaccccttaccggtactccg

SEQ ID NO: 108340 - DNA, 629 bp, Homo sapiens
  misc_feature: GYAE6OF02G90HA.49.40.D07.1.454.CMB.1.raw
  modified_base (142)..(142): a, c, t, g, unknown or other
  misc_feature (142)..(142): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
tcagagtcgagagacacgaccggtgctcgatttagtgatagagcgtaacaacagagggggctgggcctcaggaagcagcatcgggggtgccgcagccatggcctggaccgctctccttctgagcctccttgctcactttacnggttatgtggcctctacgaagtgattcagccacgttccgtctcagtggccctgggacagacggccaacaattacctgtagacggacgagaaacaatacgaaaataagaatacttacacttggtatacaaactaaaaaaggcccanatacgntagacatacacntacagactaatccgagtaccgtacaagattacgaccgtacgtaacacgtaggtacagtagagacaacgacgacgacgtacgacgtacgtacgtagacgaacggtaacgtacgtaacgtactatacgacgagtacgacgtagtactacgacgagtacgaacgtacgtacgtaacgaacgtactaccgtaacgtagtaacgtacgtacgtaacgtacgtacgtaacgtaacgtaaccggtaacgtactacgaacgtaacggtaacgaacgtaagtaacggtaacgtaacgaacgtaacgtaataacgtaacgtacggtacgtaacg

SEQ ID NO: 108341 - DNA, 742 bp, Homo sapiens
  misc_feature: GYAE6OF02IEHS0.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcgagtcggcccgtgggaccaggaccgggcccaacgtaactttaccgtgtggaccggcgagaaacatacgaaaatagaatattacagtgtatacaaacaaaagccgtaggccacggtccccttggttttgtcctttatcggatacttacgaacgtccggacccgtgtcgggtactcccgtaggacgcgtacgttcgtcgtcggtcctaccgtacggttacggggaacgccgggcctactacgtcgaacctactcacgtccggacgggccgagggaccgacgtagtacggacggtactacgtaacttacgttacgtcggtacggtaggtaacccgaacggtaaccggtaaccttaaacgtttcgactaacgtttacgggttccgggaacggggtaacggtaaaccgttaacggtccggttaaacccggttccggttacgggtaaccgaaccgggtccccgtaacgggtcccgttaccccggtccccgttacgggtaccctccgtttacccgttcccgttacccctacccgtttcccgttcctaccgtcccgtacggtccg

SEQ ID NO: 108342 - DNA, 836 bp, Homo sapiens
  misc_feature: GYAE6OF02JQICV.49.40.D07.1.454.CMB.1.raw
  modified_base (189)..(189): a, c, t, g, unknown or other
  misc_feature (189)..(189): n is a, c, g, or t
tcagagtcgagagacacgaccggtgctcgatttagtgatagagcgtaacaacagaggggctgggcctcaggaagcagcatcgggggtgccgcagccatcggcctggaccgctctccttctgacgcctcttgctcactttacaggttatgtcggcctccgtacgaagtgattcagcctacgttccgtctnacggtcgccgtgggacaggaccggcctaactaacgttccgtggtaggaccgggtcggaacgaaacctaagttaccggaaaaattaacggaaacttactttaccgaacttagggtacttaacaaaccgaaaacggtccgtacggacccaccgggttacccctttggtttttacgggttaccctttacgtaccggtaacgtaccgtttcaaacggttccggacccggtaacgtcgggaaccttccggtagacgtcggtacttcgtacgtacggtccttaccggacggtaccgggaacgtacggccacgtcgtacgtactgtacctacgtcggaccggcccggaagggtccgaacggtacgtacgggtacgggtaccgtacggtaaactttacgttaccggtacggttacccggaaacgggttaccggtaaaccgtaccggtaaacccgttaacgttagtaaccgtacttaacggggtccgggaacgggtaaccgtaaaccgttaaagttacccggggtaccttccgggttacggtaaccgaccgtaccggacgttccccgttcccggacccccggttagtcccggtaaccttcccggtacccgttccccgtcccttacccggttaccttcccggttactcccgttacgg

SEQ ID NO: 108343 - DNA, 851 bp, Homo sapiens
  misc_feature: GYAE6OF02GD71R.49.40.D07.1.454.CMB.1.raw
tcagagtcgagagacacgaccggtgctcgatttagtgatagagcgtaacaacagaggggctgggcctcaggaagcagcatcgggggtgccgcagccatggcctggaccgctctccttctgagcctcttgctcactttacaggttatgtggcctacctacgaagtgattcagcctacgttccgtctcagtcggccctgggaacacggaccggaccaactaactttcccgtggtcgaaccgggcgaaagaaacaaagttacggaaaaattaaggaattactttccgaacttaggtaactaccaaaacgaaaacgcccgttacggacccgtaaccgggttccccctttaggtttttaccggttaccgttttacgtaccggtaacgtacctttaccgaaacggttccccgggacccgttcggttcggggtaaccttaccccggttaggaaccgtccggtaactttccgtttcgtacgggtcccgtacccggtaaaccgggttaccgggggaaaccgtaaccggggacccttaaccttccggttaccggaacctaacgtaccaacgttaccggaccggggacccgtaacggggcgtaacgtagtcggaagtctacgtacgttaacttacggttcgacggtacgggtacgtaaaccgaaccgtaaccgtaaaccgttcgtacgtacgtttacggtaccgggagggaacggtttaaccaaggttaccgtccggttaccgtacggacgaccgaccgggtacgttcccggaacccggttccccgggtacctaccgttcccgttccgttaccccgtacccccgttccgtccctttccggtacccttacggtcccgttaccg

SEQ ID NO: 108344 - DNA, 948 bp, Homo sapiens
  misc_feature: GYAE6OF02FKS02.49.40.D07.1.454.CMB.1.raw
  modified_base (92)..(92): a, c, t, g, unknown or other
  misc_feature (92)..(92): n is a, c, g, or t
  modified_base (567)..(567): a, c, t, g, unknown or other
  misc_feature (567)..(567): n is a, c, g, or t
tcagagtcgagagacacgaccggtgctcgatttagtgatagagcgtaacaacagaggggctgggcctcaggaagcagcatcgggggtgccgnagccatggcctggaccgctctccttctgagcctcttgctcactttacaggttatggtggcctcctacgaagtgattcagcctacgttccgtactcgaggtcggcccgtagggacacggaccgggtaccaacgtaaactttaccctggttacggaccggggtacaaaggaaaccaaattacggaaaaaataaagtaaattaattccgaagttaggttaaactaccgaaaaaccgaaaaaggtccccgtacgggaccccgtaaccgggtcccccgttttagggtttttggttacccgtttttaagtccggtaacggttaacttaccgtaacggttcccggggacccccggtgttacgggggacctttccccgtagggtacgtaccggttactttccgttcggtaccggtcccgttacccggtacgggttaaccgggggaaacctccggggtaccctaaccgttctaccgaaaccctntacgtacgtaccgggacccgggtacccgacggggtaccggacgtagtacggtaacgggtcgtacggtaacttaacctttcgtacggttaaccgtacgggtaacgaaaaccggtacccgttaaaccgtaaacgtttaccgtattaaccggtttaaggttccggggaaaccgggtaaccggggtaaaacccgtttaaacggtccgggttaaacccgttcccggggttaacggttaaaccggaccggtaacccggtaccgggtacccgttccccggtaacccccgggttccgttaaccccgtacccgttttacccgttaccccggtttcccccttcccccgtttaccccggttacctcccgttacccgttccccggtaacccgg

SEQ ID NO: 108345 - DNA, 965 bp, Homo sapiens
  misc_feature: GYAE6OF02I1SJ3.49.40.D07.1.454.CMB.1.raw
  modified_base (233)..(233): a, c, t, g, unknown or other
  misc_feature (233)..(233): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtcgcctacctacgaagtgaactttcacgtccctacgttccgtctcgacgttcggccctgggacacgccggtccacaatttaccgngtcgaccgggtcgaacgaactaactacggtaaaataacgtaattattaccgaacgttggtaactaccgaaaactaaaacgcccgttacggacccgtaaccggtcccctttggtttttacggttaccctttacgtaccggtaacgttacctttaccgtaacggtacccgggtccccgtcggtacgggtaccgttcccgtacgacggtccggtactttccgttcggttcggtacccgtaccggtaaccgggttagggggaaacccgtaccggggaccccttacgtttaccggtacggttaaccctagttaaccgtacgtacccggaccggggtaccccggaacgggggaccgtacggtaaccggtacgggtaaccgtccgtttaacggtaacctttaacggtttaaccggtcggttaacggttaaccgggttaaccgttaaaccggacccggttaacccgtttaaacgtaccggtttaccgttaaacggttccgggttaaccggggttaacccgggaaccgggtaaaaccgtttaaacgttcccggttaaccccgggttaggtttacccgggtaccgtaaccccgggtacccggaaccggtaccccgttacccggtaccccccgggtttcggtttaaaaccccctccgtttttccccggtaccccgggtttccccccgttacccgtttaccccggtttccctttacccggtttcccggttaacccttccccggg

SEQ ID NO: 108346 - DNA, 717 bp, Homo sapiens
  misc_feature: GYAE6OF02IAKSB.49.40.D07.1.454.CMB.1.raw
tcagagtcgagagacacgaccggtgctcgatttagtgatagagcgtaacaacagaggggctgggcctcaggaagcagcatcgggggtgccgcagccatggcctgaccgctctccttctgagcctcctgctcactttacaggttatgtcgcctcctacgaagtgattcagccctacgttccgtctacaggtcggcccgtggacagacggccacaattacctgtcgacggcgaagaacaagtacgaaaataagaatattcagtagtatacgaaacaaaagcctggaccacggtccccgttgtttttcggtccttttacgtacgtagtacttacaacgttccgggcccgtcggtcggactcccgtgacgcgtacttcgtcgtcggtacctccggaccggtacggggaacaccgggtcctactcgtacgaccactcacgtccgacgggtcccgagggctacggcgtcggacggtatacggtattacgtttgtaccggtagtccggtaagtaaaccggtaccaacccttaagttccgtaactacgtttacgggtaccgggaacgggtaacccgtaaacgtaaaccgtttcccgggaaccggttccggttacgggtaacccgacgtacccgacggtccccgtacccggtccccgtcggtacccttccgtacccgttcccgttcccccgtcccgttcccttacctcccgttaccgtacgtcccg

SEQ ID NO: 108347 - DNA, 750 bp, Homo sapiens
  misc_feature: GYAE6OF02HK02J.49.40.D07.1.454.CMB.1.raw
tcagagtcgagagacacgaccggtgctcgatttagtgatagagcgtaacaacagaggggctgggcctcaggaagcagcatcgggggtgccgcagccagtggcctggaccgctctccttctgagcctccttgctctactttacaggttatggtcggcctcctacgaagtgattcagcccacgttccgtctcagtggccctggggaccaggaccgccaactaattaccgtgtgaccggtcgaagaaccaataccgaaataagaacttattccacttggtatacaacaaaacgcctggaccaggtcccccttggttttcggtacctttagtcgagtaccttacaacttccggccccgcgttcgggacttcccgtgagtcgtacttctcgtggcctccgacggtcggggaacacgggccctacgtacgtcgacctataccgtacgtcgtaccggggaccctaggggtaccgaccggtaaggtcggaagggtacccttgggtaaaccttacgtttacgtcggttaccggtacgggtaacggtaaaccgggtaccgtaacccgttaaacgtttcgtaacctaacgttaccggttccggggaccgggtaagggtaacccgttaaacggttacggtaacccggttaccggtcgggttaccaccgggtaccccgacggtaccgtcccggtaccccgtcggtccctaaccttccggttacccttcccgtaccctccgttccgttcctccgttactacccg

SEQ ID NO: 108348 - DNA, 827 bp, Homo sapiens
  misc_feature: GYAE6OF02JL88Y.49.40.D07.1.454.CMB.1.raw
  modified_base (117)..(117): a, c, t, g, unknown or other
  misc_feature (117)..(117): n is a, c, g, or t
tcagagtcgagagacacgaccggtgctcgatttagtgatagagcgtaacaacagagggctgggcctcaggaagcagcatcgggggtgccgcagccatggcctggaccgctctctttngagcctccttgctcacttttacaggttatgtggcccttctacggaagtgattcagtccacgtttccgtactcgagccggtccctgggaccaagtccggacctaacgtaaatttcccgtggttcgaacgggtccgaagtaaacgaagttacccggaaaagttaagaaacttactccggtaccttggtactacctaaacgaaaacgtcgtaggccgaccggtaccgttcgttttacggttacctttacgtacgacgtaacttccgaacgttcggtaccccgtcttggggaaccttcccggtaagtaccgacgttaccgttcctacgggttacggtcccgttaaccgtccggttacgggaaaccggtaccgggaccgtacttaccggtacgaaccgttacgtaccgtacgtacgggtacccgacggccgggtacgaccgacggtagggaaccgttcgtacgacgttaaacgtacgtttaccgaaccgggtcgttaaccgggaagttccccggtaaaccgttaacgttccgtaaccttagttacctaaccggggtcggtaaacgggtaaccctaaggttacccggttacccgttagggtacccggttacgtaccggtaccgtacgtacgttaccccgggtacccttcggtaacctcctttccggtacccttcccgtacccggttccgtccctttaaccgtcgttacccgtacgg

SEQ ID NO: 108349 - DNA, 759 bp, Homo sapiens
  misc_feature: GYAE6OF02GQ084.49.40.D07.1.454.CMB.1.raw
  modified_base (724)..(724): a, c, t, g, unknown or other
  misc_feature (724)..(724): n is a, c, g, or t
tcagagtcgagagacacgaccggtgctcgatttagtgatagagcgtaacaacagaggggctgggcctcaggaagcagcagtcgggggtgccgcacgccagtggcctggaccgctcctccttctgacgtccttccttgcctacgactttacaggttatgtgcctccgtaacgagtgattcacgcctacgttccgtctacgaggtcggcccgtagggacacggaccggaccaactaacgttacctggtacgacggacgtaagaacgaatacgaaaataacgaattacgttacacgttggtaactaccaaacaaacggtccgtacggaccgtaacggtcccccgtttgttttaccggtaccttttagaccgtagtacctttcgaacgtccggccccgtggtacggtctaccgtacggacgtaccgttacttccgtacgtacgtacctcccggacggtaccggggaacgtccgggacctacgtcctacgtacctacgtcgacgtaccggaccgggccggacgggaccgtaaccgtagtcggtaacgcgtcgtaaacttacgtaccggtgtaccggtacggtaacgaacggacctacttaacgttgtactagttacgtacgggacggtaaccgtaactaacgttccggtaaccgttcgtacggtaccgacgttcccggacgtccgtacccggtcccgtcgtaacccgtcgttacccgtcccttaccccncctttacccgccgtttaccttccgaccgttacccg

SEQ ID NO: 108350 - DNA, 622 bp, Homo sapiens
  misc_feature: GYAE6OF02IK76N.49.40.D07.1.454.CMB.1.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
tcagagtcgagagacacgaccggtgctcgatttagtgatagagcgtaacaacagaggggctgggcctcaggaagcagcatcgggggtgccgcagccatggcctggaccgctctccttctgagcctccttgctcactttacaggttatgtggcctcctacgaagtgattcagccacgttccgtctcagtcgccctggacagacggccaacaattccngtgacggnagaacatcgaaatacgatntcactgtatacaacaagctagcagccctgtttcgtcttatcgactacttacagtccgccgtcgtacggactccgtgacgtcgtattcgcgttcggctaccgacggtacggggaacacgggtacctacgtcgtacgaacctcgttacacgtacggaccgggaccgtagggaccgacgtagtacggacgctacgattacgtacgtctacggacggtaaccgagacccgttaactaacgttcgactaacggttacgttccggggaccggtaacggtaacctaaacgggttccgaaccgttcgtacgggcctagacccggacgtcgtcccgaccgtccgtactcctccgttaccgtccctaccgtcctcttcgaccttcgtac

SEQ ID NO: 108351 - DNA, 701 bp, Homo sapiens
  misc_feature: GYAE6OF02H8RPY.49.40.D07.1.454.CMB.1.raw
  modified_base (370)..(370): a, c, t, g, unknown or other
  misc_feature (370)..(370): n is a, c, g, or t
  modified_base (697)..(697): a, c, t, g, unknown or other
  misc_feature (697)..(697): n is a, c, g, or t
tcagagtcgagagacacgaccggtgctcgatttagtgatagagcgtaacaacagaggggctgggcctcaggaagcagcagtcgggggtgccgcagccatcggcctggaccgctctccttctgagcctctgctcactttacgaggttatggtcggcctccgtaacgaagtgattcgacgccacgttccgtcgtcagtcggcctgggacaggacggccataattaccgtgtacgacggcgaacgaactaatacgaaaataagatatcacgtggtatacaaacaaagctggaccacggtcccctttggttttcggtcctttagtcgaaacgtcctttacaacgtccgggacccgtgttacgggaccttacccngggtaacggtctattccgtactcgggccttaccggacggtaccgggggaactaccggggcctaacgtcgtaccggtaaacctgttaccgaacgttccggacgggggacccgaagggggtaccgaaccggtaggtacgggtacgggtctacggtaactttacgttaccgtagtacgagggttaccgaaacggtaccgtaacgttaaacgttcggtagtacggttcgggaccgggtacgaactaacgttcggcttacggtcgtcgaaccgcgacgctaccgcccgtagtcctactccgttcctccctaccgtcttccaccgtcttccgnttcg

SEQ ID NO: 108352 - DNA, 787 bp, Homo sapiens
  misc_feature: GYAE6OF02G0AFV.49.40.D07.1.454.CMB.1.raw
  modified_base (87)..(87): a, c, t, g, unknown or other
  misc_feature (87)..(87): n is a, c, g, or t
  modified_base (91)..(91): a, c, t, g, unknown or other
  misc_feature (91)..(91): n is a, c, g, or t
  modified_base (140)..(140): a, c, t, g, unknown or other
  misc_feature (140)..(140): n is a, c, g, or t
  modified_base (355)..(355): a, c, t, g, unknown or other
  misc_feature (355)..(355): n is a, c, g, or t
  modified_base (630)..(630): a, c, t, g, unknown or other
  misc_feature (630)..(630): n is a, c, g, or t
  modified_base (755)..(755): a, c, t, g, unknown or other
  misc_feature (755)..(755): n is a, c, g, or t
tcagagtcgagagacacgaccggtgctcgatttagtgatagagcgtaacaacagagggctgggcctcaggaagcagcatcgggggtnccgnagccatggcctggaccgctctccttctgagccctcttgctcactttacnggttatgtcggcctctacgaagtgattcagccacgtttccgtctcgacggtcggccctgggacacggacggcctaacaatttaccggtggtacggaccgggtacaagaaaccaacgttacgaaaaagttaagaattacttcgaaccgttggtaataccaaaacgtaaaaacgcctacggccaacggtcccccttaggtttttcggtccgttttanccggtaagtaccttcgaacgtccggcccgtacggtcgggtacttcccgaggtaccgtcgttacgtttccgtacgttcggacctccggtaacgggtccgggggaacgacggggtacccactttccgacgtaaccccgattccgtaacgtaccgggaaccgggccccggtaagggccgtaaccggtacttacggggaagggtccttaacgggtaactttaacgttacgttaccggtacgtacgggttaccggaaattacccgaaacttaaaccggtnttaacctagttacggttcgggaacgggttaaccggaataaaccgtttcgaaccgtttcggcgaactaacgcccgtaggcccttccggtccccggtactaccgtccgttcgtttacccggtccccnccgtttcctaccgtccttccggaccttaccgg

SEQ ID NO: 108353 - DNA, 613 bp, Homo sapiens
  misc_feature: GYAE6OF01A80YI.33.37.D04.1.454.CMB.1.raw
  modified_base (312)..(312): a, c, t, g, unknown or other
  misc_feature (312)..(312): n is a, c, g, or t
tcagtacacacactcacgaccggtgctcgatttagtagcatactgttggggtttgggggcaagggacgtcaggtccctaacccctgggacaccacgccaatggacatgaggggtccctgctcgacgcgtccctgggggcctccgtgactgccttctggcctcccaggtgccagagtgtgacaagtccagatgacccagtctccatcctccctgtctgcttctggtcggagacagagtcaccatcacttgccaggcgagtgaggacattcggtaaatttttaaattggtttcagcaagaaaccaggggaaacncccctagactcctgattcacggaggcatccaagttacggaaatacggggtacccaggaaggttcaaggtggaggtggagcgtggggacaggacttttacccgcaccatcagcagcctgcagcctagaagattcttgacaactattaattacctgtacaactaagttaataaataactccttacccgtaacttaccgttttcgggacccgtaagggggaccctaaggccgttagggaagtaacgtaccgaaaaacggtaactgggttgggactacggaccaccattccttggttccttaccg

SEQ ID NO: 108354 - DNA, 527 bp, Homo sapiens
  misc_feature: GYAE6OF01CWMCQ.33.37.D04.1.454.CMB.1.raw
  modified_base (278)..(278): a, c, t, g, unknown or other
  misc_feature (278)..(278): n is a, c, g, or t
  modified_base (366)..(366): a, c, t, g, unknown or other
  misc_feature (366)..(366): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctcctgtctgcttctgtcggagacagagtcaccatcacttgccaggcgagtgaggacagttacggtaaattttaattggtttcagcagaaaccagggaancccctagactcctgattcacgaggcatccaattcggaaatcgggccagaagttcagtggaggtggagctgggacagtacttttacccncaaccatcagcagcctgcagcctagaagatcgttgacaactatattactgtacaacagtaataataatcctacccgtatacttttcggaccaggggaccaaggctaggacgaataccgaaaagtacgtgtaggactcgacaactattactgttccttaccg

SEQ ID NO: 108355 - DNA, 551 bp, Homo sapiens
  misc_feature: GYAE6OF01C92NN.33.37.D04.1.454.CMB.1.raw
  modified_base (285)..(285): a, c, t, g, unknown or other
  misc_feature (285)..(285): n is a, c, g, or t
  modified_base (376)..(376): a, c, t, g, unknown or other
  misc_feature (376)..(376): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaaattggtttacagcaagaaaaccagggaaacncccctagactcctgattcacgaggcatccaattcggaaatgggtacccagaaggttcagtggaggtggagcgtgggacagtactttacccncaccatcagcagcctgacagcctagaagatcttgacaactatattactgtacaactagtaataataactcctacccgtactacgttttcggaccgtaggggaccaagtcgtaggagtacgtaacaaacgtaacgtggtacgcgttacgacctaacatttaccgtgttccttaccg

SEQ ID NO: 108356 - DNA, 626 bp, Homo sapiens
  misc_feature: GYAE6OF01CUYJB.33.37.D04.1.454.CMB.1.raw
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcacatcacttgccaggcgagtgaggacattacggtaaatttttaattggtttcagacaagaaaccgaggaacgcccctagactcctgattcacgagcataccaattacggaaagtacggggtacccacgtaaggttcaggtaggaggtgggagcgtagggactagtaacttttacccgtacaaccgtatcagcacgtcctagccagcctagaacgtacttcgttagactaaacgtaattacttaacgtcgttaacaacgtaagttaataaacttaacttacccgttacccgttacttaccgttttacggaccgtacgggggaacctaaggccgtaggtaacgtaacgttaaccgaaaacggtaacgttggtacgggtacctaggtaccctaacctagtttccgtcgtttcttaacccg

SEQ ID NO: 108357 - DNA, 688 bp, Homo sapiens
  misc_feature: GYAE6OF01DBICV.33.37.D04.1.454.CMB.1.raw
  modified_base (201)..(201): a, c, t, g, unknown or other
  misc_feature (201)..(201): n is a, c, g, or t
  modified_base (276)..(276): a, c, t, g, unknown or other
  misc_feature (276)..(276): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcgganacagagtcaccatcacttgccaggcgagtgaggacattacggtaattttaaattgtttcagcagaaacgaggaanccctagactcctgacttcacgacgctaataccaagttacggaaaacgtacggggttacccaacggtaaggtttcgaaggttcgggaagggttagggacggtcgtacggggaactacggttaactttttaacccgacctaaccgtataccgaacggtccaacggtacccgttggaccgacgggtacccttaggaaacggtactacgtttacgaacctaaactaagttacgtttaactaggtacctaaactaagttaaacttaacttaaacttccgttaccccgtttaaacttacgttttacggacccggtaacggggaaccaaggtccgtagggtaacaacgtttaacgaaaaccggttactggtaccgggtacctacggtaccaacccgtaattccgttgttcccgtttacc

SEQ ID NO: 108358 - DNA, 546 bp, Homo sapiens
  misc_feature: GYAE6OF01B9EBQ.33.37.D04.1.454.CMB.1.raw
  modified_base (402)..(402): a, c, t, g, unknown or other
  misc_feature (402)..(402): n is a, c, g, or t
  modified_base (525)..(525): a, c, t, g, unknown or other
  misc_feature (525)..(525): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaaattggtttcagacaagaaaaccgagggaaacgcccctagacctcctagacttcaacgaggcaactaccaaagttacggaaaagttacggggtaccccaacggaaggtttcaaggtggaggtggagcgtagggacagtacttttacccnaccatcagcacgcctgcagcctagaagtatcttgacaaactattaattactgtacaacaagttaataataactcctacccgtatactttgaccgagggacaagtcaggagatacaaagactgngctagacactatctgtcttac

SEQ ID NO: 108359 - DNA, 548 bp, Homo sapiens
  misc_feature: GYAE6OF01BLLLE.33.37.D04.1.454.CMB.1.raw
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcatctgtaggagacagggtcaccatcacttgccgggcaagtcagagcataagcaactatttaaattgtatcaacagaaaccagggaaagcccctaaggtcctgatctatgctgcgtcagtttgcaggagcggggtccatcgaaggtcagtggcagtggatcgtagggacaggtatttacactctcaccatccagcagtctgacaacgtgaagtatttgactaacttactactgtacaacagtacgtacaaccaacccacccctattacctaccgtttacccggaccccgttacgggaaccctacgacggttggtaacttccggtaacctaaaccggtacgtggtacggccgtggacccc

SEQ ID NO: 108360 - DNA, 593 bp, Homo sapiens
  misc_feature: GYAE6OF01C4ZTK.33.37.D04.1.454.CMB.1.raw
  modified_base (194)..(194): a, c, t, g, unknown or other
  misc_feature (194)..(194): n is a, c, g, or t
  modified_base (389)..(389): a, c, t, g, unknown or other
  misc_feature (389)..(389): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttcngtcggagacagagtcaccatcacttgccaggcgagtgaggactagttacggtaaatttttaattggtttcagcaagaaaccagggaacgcccctagacctcctgacttcgacgaggcataccaagttcggaaagtcgggtacccaggtaaggttcaggtgggaggtggagcgtagggacagttacttttacccanacctatcagtccagccctgaccagtcctaagaagtattcgtacgacaactattacttactcgtacaactagttaattaagtacttaccgttacccgttacttaccgttttcggacccgtaggggtaacccagtacgtaggaacgacgtaccgaaacggtacgtggtcgtactacggtaccctacctattccgttgttccttacg

SEQ ID NO: 108361 - DNA, 587 bp, Homo sapiens
  misc_feature: GYAE6OF01BNEIG.33.37.D04.1.454.CMB.1.raw
  modified_base (293)..(293): a, c, t, g, unknown or other
  misc_feature (293)..(293): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggactagtttacggtaaaattttttaaagttggtttacagacaaggaaaccgagggaaacncccctagactcctgattcacgaggcataccaagttcggaaagtacggggtacccaacggtaaggttcaggtggaggtggagcgtagggactagtactttacccgacaccatcagcagcctgacagcctagaagtattcttagacaactattacttactgtacaaactagtaataagttaactccgttacccgtacttaccgttttcggaccgtaagggacccaaggtcgtaggaacgtaactaaccgaaacgtacgtggtacggactacgacctaacattcctgttccttaccg

SEQ ID NO: 108362 - DNA, 588 bp, Homo sapiens
  misc_feature: GYAE6OF01EHRYZ.33.37.D04.1.454.CMB.1.raw
  modified_base (428)..(428): a, c, t, g, unknown or other
  misc_feature (428)..(428): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccgggcaagtcagagcatcgtccgtacttaatttaaattggtatcagacaagaaaccgagggacaacgaccccttaaaactccgtagactactagtcgtctcgccgtacctagtctacgacgtaaacggtcgggtacccagtacgaaggtttcaaggtggactaggtggatcggtagggactagtactttccacttctacaccatcanctagtctgactaacctagaacgttatttacacttaacttcttactagtacaactactagttaacacttcctaccgtacttaccgttacggaccgtaacgggaccaacggcgttaacggaagtacgttaccggaacgggtaccgaacgttggcgggtaccg

SEQ ID NO: 108363 - DNA, 521 bp, Homo sapiens
  misc_feature: GYAE6OF01B2E6Y.33.37.D04.1.454.CMB.1.raw
  modified_base (282)..(282): a, c, t, g, unknown or other
  misc_feature (282)..(282): n is a, c, g, or t
  modified_base (374)..(374): a, c, t, g, unknown or other
  misc_feature (374)..(374): n is a, c, g, or t
  modified_base (403)..(403): a, c, t, g, unknown or other
  misc_feature (403)..(403): n is a, c, g, or t
  modified_base (498)..(498): a, c, t, g, unknown or other
  misc_feature (498)..(498): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggactattcggtaaatttttaattggtttcagcaagaaaccagggaaacncccctagactcctgattcgacgaggcatccaattcggaaatagggtcccagaggttcagtggaggtggagcgtagggacagtactttacccnacctatcagcagcctgcagcctagaagtntcttagactaactatattactgtacaatatataataactctaccgtatactttggaccgtagggaccagtactaggatactacgaaacgacgtgngactcgacacctatctgtcttac

SEQ ID NO: 108364 - DNA, 701 bp, Homo sapiens
  misc_feature: GYAE6OF01AZGFS.33.37.D04.1.454.CMB.1.raw
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
  modified_base (405)..(405): a, c, t, g, unknown or other
  misc_feature (405)..(405): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccattccctccctgtcctgtcttctgtcgganacagacgtcaccatcacttgccaggcgagtgacggactagttacggtaaatttttaaatggtttacagcaagaaaccgaggtaaacncccctagacctcctgacttcgaacgaggcatccgaaagttacggaaagtacggggtccaaggtacggttcaggtggaaggtggacgcgtagggactacgtacgttttaccccncgtaacccgaattcccgaaggtaccctaacgggtacccgttcgggaccgtaacgggtccccgttaaggaaacgttacgttacgtttacggaacccttaaacgtaaactttacgtttaacctacggttaaactaaaccgtaagtttaaacttaaacttaaaccttccgtttaaccccgtaaacgttcccgtttttaggggaaccccgtaacggggtaacccgaagtcccggtaggaacgtacgtaacgaaacgacggttcggacggtctacggacctaccgtaagtctagttcttac

SEQ ID NO: 108365 - DNA, 619 bp, Homo sapiens
  misc_feature: GYAE6OF01B96R7.33.37.D04.1.454.CMB.1.raw
  modified_base (228)..(228): a, c, t, g, unknown or other
  misc_feature (228)..(228): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcatctgtaggagacaggtcaccatcacgttcggccgganaagtcaggagcaataagactaacttaatttaaattggtactacaaacacgaaaaccgaagggaaacgaccccgtaaggtcctagatactatgctcgcgtacctagtttgcaggacggtccggggtaccctaagtacgtaaaggttcgaagtcggacaggtggagtcgtagggacagtacttacacgtctacacctatcagacagtctagactaacgtagtaagttatttacgacttaacctttaacgtaccttagtaacctaacgagtacgtaccaactaacccaccctacttacgtacccgtttacccgggcccgttaccgggaaccctagtaggttacgacgttacggtacccgtaaacccggagttacggacggtcgtccgtaacccg

SEQ ID NO: 108366 - DNA, 579 bp, Homo sapiens
  misc_feature: GYAE6OF01ER7SS.33.37.D04.1.454.CMB.1.raw
  modified_base (201)..(201): a, c, t, g, unknown or other
  misc_feature (201)..(201): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcgganacagatcaccatcacttgccaggcgagtgagacagttacggtaaatttttaatggtatcagacaagaaaccgagggacaacgacccctaaactcctagactctatgctgtcgtcctagtctgacaaagtcgggtacccagtcgaaggttcaggtgcagtgatcgtaggactagtacttacactctaccactatcagctagtctacgctaaccgtgaagttatttcgacttaactttacttctacgtacctaactacgtaacgttaaccaacttccgtacccgttactacggttttcggacccgtaaggggtaccctaaggtccgtaggagtaaccgtacgaacgggtaccgtaacgttgggtcggtcgtgtaaccccg

SEQ ID NO: 108367 - DNA, 604 bp, Homo sapiens
  misc_feature: GYAE6OF01A7N2W.33.37.D04.1.454.CMB.1.raw
  modified_base (295)..(295): a, c, t, g, unknown or other
  misc_feature (295)..(295): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatcgacccagtcctccactccctccctgtctgtcttctgtcggagacagacgtcaccatcacttcgccgaggcgagtgaggactagttacggttaaatttttaagtggttacagacaagaaaccgagggaaacnccccgtagacctccgtagacttaccgacggagcactacaagttacggaaagtcgggtaccagtacggtcaggtaggaggtggagtcgtagggactagtactttacccgacacatcgagcacgtcctgctacgtcctagaactacttcgtacgactaacgtattacgttacagtacaataagttaattaactaacttcccgttaaccgttacgttacgtttacggaccggtacgggaacccaggtcgtagaacgtaacgtaacgtaaacgtagttggtacgtcgtacgacctactagtcttacgtctacg

SEQ ID NO: 108368 - DNA, 592 bp, Homo sapiens
  misc_feature: GYAE6OF01BAE7E.33.37.D04.1.454.CMB.1.raw
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
  modified_base (563)..(563): a, c, t, g, unknown or other
  misc_feature (563)..(563): n is a, c, g, or t
tcagtacacacactcacgaccggtgctcgatttagtagcatactgttggggtttgggggcaggagtcagtcccaacctggacacagcatggacatggagggtccctgctcagctcctggggctcctgctgatctggctcccaggtgccagatgtgacatccagatgacccagtcctccactccctccctgtcctgtcctttcgtggtacggaagacaggacgtccaccatcctacttcgccgaggcgagtgagacagttacggtaaattttaaatgtttnagacaagaaacgagggaacnccctagactctgacttcgagaggactactaccaagttacgggaaacgtacggggtaccccagggtacgttacgaggtgggaagggtgggagtggtagggactagttacttttacccacaccgatacgacgcacgtcctagactacgcctagaactagtcttcgaactaactattaacttctactaacaactataactaataactacctaccttactacgtttcgacgtagggtaccagtcgtagacgtactacgtaacaggtntacggctacgacctacatcttgtcttacc

SEQ ID NO: 108369 - DNA, 718 bp, Homo sapiens
  misc_feature: GYAE6OF01B4IV9.33.37.D04.1.454.CMB.1.raw
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatcgacccagtcctccatccctccctgtctgcttctggtcggagacagagtcaccatcacttgccgaggcgagtggaggactagttacggtaaattttttaaattggtttacagtcgaagaaaaccgagggaaacgcccctaagaaccttcctagtacttaccgaacggaggacctaagtaccctaaagtttacgggaaaacgttacgggggtacccctaaacgggtaacggtttccgaaggttacgggaggggtagggaacggtcgtaggggaacctaggttaaccttttttaccccgacgtaacccgtaactaccgaggtaccacgcccgtaggcacgtacctaggaaacgtctcgttagacctaaacgtatttaacgttaactagtaacctaaacggtaattaaagttaaaccttaacttaccccgttaacccgttaacgttaccgttttacgggaacccggtaacggggaacctaaggtaccgtagggaaacgtacgtaaccggaaaacgtcgtgggtacgtactcggaacctacgtattcgtgtccgttacg

SEQ ID NO: 108370 - DNA, 748 bp, Homo sapiens
  misc_feature: GYAE6OF01D5A52.33.37.D04.1.454.CMB.1.raw
  modified_base (205)..(205): a, c, t, g, unknown or other
  misc_feature (205)..(205): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatcgacccagtcctccactccctcctgtcttcatctagtagganacagacgtcacctatactacgttcggaccggacaaggtgagagactaagttaacgaacctttagtttagtaagtttgttaatacgagacgaaggaacgaaccggaacgggaaacccacccctaaacgtccgtagtacttccgtaccgtcgacccgtactaccgttaccttaaactttaaccgaacgtaacggggttcccgggtaccctaacgttacgggtaaggttaccgtagggtccgggacggtaagggttcgggtaaccgttacggtaacgggaacctttaagttaccgtttcctaaccttaccctacgtaaacctaagttaacgtcgtaacgttaccggttaacggtaaccgttaggtaaacggtttaacgtttaaggaacgtttactttaccttacgtacgtaactaacgtaacgttaacttaacgttaacccttaacccgttaacgttacggtttaccggaaccgtaacgggacctaaggtcgtacggaagtacgaacgtaacggactacggtacggtacgatccaccgtacttacg

SEQ ID NO: 108371 - DNA, 685 bp, Homo sapiens
  misc_feature: GYAE6OF01ASYNK.33.37.D04.1.454.CMB.1.raw
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (215)..(215): a, c, t, g, unknown or other
  misc_feature (215)..(215): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatcgacccagtcctccatccctccctgtctgcttctgtcgganacngagtcacntcactgccaggcgagtgaggactagttaacggtaaatttttaagttggtttacagtacaacgaaaccgagggaaaccgtccccgtaagaccgtcctagtacttccgacgaggtcaacgtaccgtaagttacggaaaggtccgggtacccaaggtaacggttcgaggtacgggaggttaggacgtcgtagggaactagttaaccgttttacccactaccgtagtaccgaacgtacgacgtacccgtagaccgtacgtaccgtaggaaacgttacttaccgttacgaacctaacttaattacgtttaaccgttacgtaactaaacgtaagttaactaaactttaaccctcccgtttaacccgtaagttacccgtttacggacccgggtaacggtaaccgagtcgtaaggacaacgttacgaaacgtacgtggacgtacgtacgtacctaccgtatccttcgttacgttaccc

SEQ ID NO: 108372 - DNA, 844 bp, Homo sapiens
  misc_feature: GYAE6OF01BH301.33.37.D04.1.454.CMB.1.raw
tcagtacacacactcacgaccggtgctcgatttagtagcatactgttgggtttgggggcaggagtcagtcccaacctggacacagcatggacatgacggtccctgctcagctccgtgggctcctgctgctctgctcccgaggtgccagatgtgactactccgagactcgaccctagtcctcctaccttccctcctgtctcgtccttcgtggtacggagtacaggtactaccaccactactaccgttgaccgtaggacgaggtagaggtacttaaggtttaacggtttaaatttttaagttcggttacaacgtacgtaacggaaacgtaacgggaaactaccccgtaagtaccgtacgtagtacgttaaccgacgacggtactacgtaaccgtaacgttaacgggtaaacggtaccggggttaaccgtaacgggttaacggttacggtaagggtacgggggtaaggggtacggtaacggtacgggttaacgggaaacgttaccggttttaaccctttaacccgtacctaaccgtactacgtaaccgtaccgaccggtacgtaccgaccgtacggtacgtaacggtaacgttaccgtacgttaccgaacttaaacgtttacgttaaacgtttacgttaacctaaacgtaaacctttaagtttaaaaacttcgttaaacccttcccggtttaaccgttaaccgtttaccgggttaacccgggaacccgttaagggacccgttaagtcgggttaacgaaacgttaaccggtaaaccgtaaaccgtggttaccggttcgtaaccgtaccgttaccctaacgttacgtttccttaacgttcccttaaccg

SEQ ID NO: 108373 - DNA, 687 bp, Homo sapiens
  misc_feature: GYAE6OF01BMC5I.33.37.D04.1.454.CMB.1.raw
  modified_base (673)..(673): a, c, t, g, unknown or other
  misc_feature (673)..(673): n is a, c, g, or t
tcagtacacacactcacgaccggtgctcgatttagtagcatactgttgggtttgggggcaggagtcagtcccaacctggacacagcatggacatgagggtccctgctcagctcctgggctcctgctgctctggctcccaggtgccagatgtgacatccagatcgacccagtctccatccctcctgtctcgtcttcgtggtcggagacgagacgtccaaccatccacgttcgaccgaggcggaggtagaacggtactaagtttacggttaaaattttttaagttgtttacagaccaagaaaccgagggaaacctccccgtagtaccgtccgtagtactaccgacggcggactacgtacgtaagttaccgggaaagtaccgggtaccaaggtacgtcgaggtggaggtggacgtgtacggactagttacctttacccgcaacctagtaccgaggtacctacgtccgtacgacgtaccggtactacggtaacgtacttcgtacgacgtaactaacgttacgttactacgtaacctaacgtaataacttaactaaccttaccgtaccgttaccgttacgtttaccggaccgtaacgggtaccgtacggtacgtaggtaacgtacgtaaccgtaagtacggttcggtacggtacgtaccgtccgtacgaccccgtttnttccgttcttaccg

SEQ ID NO: 108374 - DNA, 498 bp, Homo sapiens
  misc_feature: GYAE6OF02I73VK.33.37.D04.1.454.CMB.1.raw
  modified_base (437)..(437): a, c, t, g, unknown or other
  misc_feature (437)..(437): n is a, c, g, or t
tcagtacacacactcacgaccggtgctcgatttagtagcatactgttgggtttggggcaggagtcagtcccaacctggacacagcatggacatgagggtccctgctcagctcctgggctcctgctgctctggctcccaggtgccagatgtgacatccagatgacccagtctccatcctccctgtctgcttctgtcggagacagagtcaccatcacttgccaggcgagtgaggacattcggaattttaaattggtttcagcagaaaccagggaaagccccaaactcctgatctctgccgcatccgatttacacaatggggtcccatcgaggttcagtggcagtggatctgggacagatttcactctcaccataagcagtctggaacctgaagattttggaagtatacttctgtacaacagacttatagtaacccgtanacttttggacctagggaccaagctggagatcaagcgaactgtggctgcaccatctgtcttc

SEQ ID NO: 108375 - DNA, 453 bp, Homo sapiens
  misc_feature: GYAE6OF02IPP9S.33.37.D04.1.454.CMB.1.raw
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (347)..(347): a, c, t, g, unknown or other
  misc_feature (347)..(347): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
  modified_base (385)..(386): a, c, t, g, unknown or other
  misc_feature (385)..(386): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (423)..(423): a, c, t, g, unknown or other
  misc_feature (423)..(423): n is a, c, g, or t
  modified_base (437)..(437): a, c, t, g, unknown or other
  misc_feature (437)..(437): n is a, c, g, or t
tcagtacacacactcacgaccggtgctcgatttagtagcatactgttgggtttggggcaggagtcagtcccaacctggacacagcatggacatgagggtccctgctcagctcctggggctcctgctgctctggctcccaggtgccagatgtgacatccagatgacccagtctccatcctcctgtctgcttctgtcggagacagagtcaccatcacttgccaggcagtgaggacagttcggaaattttaatggtttcagcagaaccnggaanccctagctctgattcacgagcatccaattcgaatgggccagagttcagtggagtgagctgggacagtatttacccnaccatcagcagctgcagctagagntctgcaatntactnncantanatatcnctanactttgcaggaccagctaganatcaaacgatgtgntcgcacatctgtcttc

SEQ ID NO: 108376 - DNA, 561 bp, Homo sapiens
  misc_feature: GYAE6OF02G62KL.33.37.D04.1.454.CMB.1.raw
  modified_base (281)..(281): a, c, t, g, unknown or other
  misc_feature (281)..(281): n is a, c, g, or t
  modified_base (373)..(373): a, c, t, g, unknown or other
  misc_feature (373)..(373): n is a, c, g, or t
  modified_base (398)..(398): a, c, t, g, unknown or other
  misc_feature (398)..(398): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggtaaatttttaaattggtttcagcagaaaccagggaaacncccctagactcctgattcacgagcatccaattcggaaatcggggtcccagaaggttcagtggaggtggagcgtgggacagtacttttacccnaccatcagcagcctgcagcctaganatctgacaactatattactgtacaaacagttaataaattaatcctacccgttaactacgttttacggaccgtaacggggaaccaagtcgtaggaagtactaaccgaaaaccgtaacgtggtacggtacttacggaccaacccgtatacctttcgtaccttacc

SEQ ID NO: 108377 - DNA, 591 bp, Homo sapiens
  misc_feature: GYAE6OF02FKJED.33.37.D04.1.454.CMB.1.raw
  modified_base (372)..(372): a, c, t, g, unknown or other
  misc_feature (372)..(372): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggaaatttttaaattggtttcagcagaaaccagggaacgcccctagactcctgattcacgaggcatccaattcggaaataggggtccagaaggttcagtggaggtggagcgtgggacagtacttttacccncaccatcagcagcctgcagcctagaagtattcttagactaacattaactttactgtacaaactagttaattaaataacttccttacccgttaacttaccgtttttcgggacccgtaacggggtaacccaaggtcctagggaacgtaagttaaccggaaaacgtaacgttcggtacggtaccgttacgacccaaccgtattccgttagttaccctttacg

SEQ ID NO: 108378 - DNA, 541 bp, Homo sapiens
  misc_feature: GYAE6OF02F8L43.33.37.D04.1.454.CMB.1.raw
  modified_base (284)..(284): a, c, t, g, unknown or other
  misc_feature (284)..(284): n is a, c, g, or t
  modified_base (376)..(376): a, c, t, g, unknown or other
  misc_feature (376)..(376): n is a, c, g, or t
tcagtacacacactcacgaccggtgctcgatttagtagcatactgttgggtttgggggcaggagtcagtcccaacctggacacagcatggacatgaggatccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaaattggtttcagtcaagaaaccagggaaacncccctagacctcctgattcacgaggcatccaattcggaaatcggggtcccagaggttcagtggaggtggagcgtggacagtacttttacccncaccatcagcagcctgcagcctgaacgtatcgtgacaactatacttactgtacaacagtaataataactctacccgtatacgtttcgaccgtaacggggacctaagcgtaggacgtaataccgaaacgtaactggtacggctacgacctacctacttctgttacc

SEQ ID NO: 108379 - DNA, 560 bp, Homo sapiens
  misc_feature: GYAE6OF02I4DGG.33.37.D04.1.454.CMB.1.raw
tcagtacacacactcacgaccggtgctcgatttagtagcatactgttgggtttgggggcaggagtcagtcccaacctggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaactatttaaattggtatcaacagaaaccagggaaagcccctaaggtcctgatctatgctgcgtccagtttgcagagcggggtcccatcaaggttcagtggcagtggatctgggacagatttcactctcaccatcagcagtctgacaacgtgaagtattttgctaacttactactgtacaacagtacgtacaacaacctaccctaattccctaacgtttccggacccgttacgggaaccctacgtacggttacggacgttacggttaccgaaacccggtaacgttcggtacggtacctacggtacctacccgttaacg

SEQ ID NO: 108380 - DNA, 575 bp, Homo sapiens
  misc_feature: GYAE6OF02IODOC.33.37.D04.1.454.CMB.1.raw
  modified_base (285)..(285): a, c, t, g, unknown or other
  misc_feature (285)..(285): n is a, c, g, or t
  modified_base (351)..(351): a, c, t, g, unknown or other
  misc_feature (351)..(351): n is a, c, g, or t
  modified_base (372)..(372): a, c, t, g, unknown or other
  misc_feature (372)..(372): n is a, c, g, or t
  modified_base (432)..(432): a, c, t, g, unknown or other
  misc_feature (432)..(432): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctccaggtgccagatgtgacatccagatgacccagtctccatcctcctgtctgcttctgtcgagacagagtcaccatcacttgccaggcgagtgaggactagttacggtaaaatttttaagtggtttacagtacaagaaaccgaggaaacnccctaagactctagatcagagcatcaatcgaaatcgggtaccaagtaagttcaggtcggagtggancgtaggacagtactttaccanacatacagaccagtcctggacacgtcctagaactacttctagacaaactagttaattacncgtaacaaactagtaataaacgtaactccgtaccgtaattacgtttagacccgaagggtaaccaagtccgtaggtaacgtaacgtaaccgtaaaacgtacgtgtaccggtactacgaacaccttagtacttcgtacttaaccg

SEQ ID NO: 108381 - DNA, 714 bp, Homo sapiens
  misc_feature: GYAE6OF02ISI3D.33.37.D04.1.454.CMB.1.raw
  modified_base (293)..(293): a, c, t, g, unknown or other
  misc_feature (293)..(293): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatccctcctgtctgcttcgtgtcggagacagactcaccatcacttgccaggcgagtgaagactagttacggttaaatttttaaagttggtttacagtacaagaaaaccgagggaaacnccccgtaagacctcctagtacttacgacgagacactaccgtaagttaacggaaagttacggggtacccaacggtaaggttcgaaggtaggtaagggtggaacgcgtagggaactaaggttaacttttacccacaacctagtacgacgaccaacgtccgtaggactacgtaccgtaagtaaacgtacttcgttacgaactaaactaactttaacttacgtagtaaccaaacgtaagttaaattaaacttaaccgttcccgttaaccccgttaacgttaaccgttttacgggaacccggtaaacgggaacccgtaaagtccggtaaggaacgtaaccgttaaacccggaaaccggttaacgttacggtacggttaccgacgtaacccgtaacgttaacgttccgtttacgttaccttaacccg

SEQ ID NO: 108382 - DNA, 544 bp, Homo sapiens
  misc_feature: GYAE6OF02JFFZF.33.37.D04.1.454.CMB.1.raw
  modified_base (277)..(277): a, c, t, g, unknown or other
  misc_feature (277)..(277): n is a, c, g, or t
tcagtacacacactcacgaccggtgctcgatttagtagcatactgttgggtttgggggcaggagtcagtcccaacctggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaactattaaattggtatcaacagaaaccagggaanccctaaggtcctgatctatgctgcgtcagtttgcagacgcgggtccatcaaggttcagtgacagtgatcgtgggacagtattcactctcaccatcagctagtctcgacgtaacgtagaagttatttacgactaaccttactactagtacaactacgacgtacaaccaacctaccctattctaaccgtttccggacctacggaaccacgtacggtacgtacgtcgtaaccgaaccgtacgttcggtcggtactcgtaccctactaccg

SEQ ID NO: 108383 - DNA, 572 bp, Homo sapiens
  misc_feature: GYAE6OF02IMXWP.33.37.D04.1.454.CMB.1.raw
  modified_base (409)..(409): a, c, t, g, unknown or other
  misc_feature (409)..(409): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtcctccatcctccctgtctgtcttctgtcggagacagagtcaccatcacttgccaggcgagtgaggactattacggtaaatttttaaagttggttttcagtacaagaaaaccaggggaaaacgccccttaagacctcctagtattcgacgaggcaatccaaagttacggaaagttacggggtacccaacggtaaggttcaaggtgggaaggtggagcgtagggacagtacttttacccncaccatcagcaagcctgcagcctagaagtatctagactagtttatactgtacagtcagtcgtagactagtgtacgttggacgtttcggaccgaagggtaccaagggtacgaaatacgaaacgtactggtacggcgtacgactaacctagtctcgtcttactac

SEQ ID NO: 108384 - DNA, 664 bp, Homo sapiens
  misc_feature: GYAE6OF02FS7SZ.33.37.D04.1.454.CMB.1.raw
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
tcagtacacacactcacgaccggtgctcgatttagtagcatactgttgggtttgggggcaggagtcagtccccaacctggacacagcatggacatgagggtccctgctcagctcctggggctcctgctgctctggctcccaggtgccagatgtgacatccagatgaccccagtcctccactccctccctgtctgcttctgtcgganacagactcaccntcacttgccaggcgagtggaggactattacggttaaatttttaaagttggtttacagacaacgaaaccgagggaaaccgcccctagaccttctagacttcgacgacggcactaccaagttacggaaacgtacggggtaccccaacggtaacggttcaggtagggaggtacgggacgcggtaggggacctaagtacttttacccctaccgacctatacgacgacacgcctagcgagcccgtagaagtacttcgtacgactaactacttacttacgtcgtaacaacgtaacgttaataacttaacttacccgttaacccgttaacttaccggttttacggaacccgtaaggggaaccctaacggacgttagggtaactacgtaaccgaaaccgttaacgtggttaccgtacgtacgacctaaccgtagttccttacgttaccttaccg

SEQ ID NO: 108385 - DNA, 660 bp, Homo sapiens
  misc_feature: GYAE6OF02IQHFK.33.37.D04.1.454.CMB.1.raw
  modified_base (209)..(209): a, c, t, g, unknown or other
  misc_feature (209)..(209): n is a, c, g, or t
  modified_base (319)..(319): a, c, t, g, unknown or other
  misc_feature (319)..(319): n is a, c, g, or t
  modified_base (543)..(543): a, c, t, g, unknown or other
  misc_feature (543)..(543): n is a, c, g, or t
  modified_base (627)..(627): a, c, t, g, unknown or other
  misc_feature (627)..(627): n is a, c, g, or t
  modified_base (655)..(655): a, c, t, g, unknown or other
  misc_feature (655)..(655): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggcctcccaggtgccagatgagacatccagatcgacccagtcctccatccctcccgtgtctgtcttcgtgtacgganacagacgtaccacctatcctacttcgaccgaggcgagtggacggtactagttaacggttaaaatttttaagttggtttacagtacgaaacggaaaaccgaaggggtaacncccctaagaccttcgtagtacttacgaacgcgtacactaccgtaaagtaacggtaaacgtacggggtaccccaaggtaacggttcaaggtagggtaggtggaacgtcggtagggaactaaggttaaccgttttacccacctaaaccgtataccaacggctacgtacgtacgccgacgtaccgtagtaaagtcttaccgttgaaacctaactaagttactacgtntaacaataactaataaactactccgtacccgtaattacgttgaaccgacggaaccttaagcgtagatacgtaacgaacttacgngtccgagttacacgtactgtcttacgtntaacg

SEQ ID NO: 108386 - DNA, 602 bp, Homo sapiens
  misc_feature: GYAE6OF02FJBM4.33.37.D04.1.454.CMB.1.raw
  modified_base (282)..(282): a, c, t, g, unknown or other
  misc_feature (282)..(282): n is a, c, g, or t
  modified_base (364)..(364): a, c, t, g, unknown or other
  misc_feature (364)..(364): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaattggtttacagcaagaaaccagggaacncccctagactcctagacttcacgaggcatccaagttacggaaatcggggtacccaaggtaaggttcaggtgggaggtggagngtgggacaggtactttacccgcaccgatcagcagcctgacagcctagaagtacttcgttacgacaactattacttacgtgtaactaaactagttaaataaataacttacctaccgttaacttacgttttacggaccgtaacgggaactaacgtaccgttaggaacgtacgtaacgaaaccgtaacgtacggtacggtacgtacgtacctaacctacgttaccgttacgttaccttacc

SEQ ID NO: 108387 - DNA, 725 bp, Homo sapiens
  misc_feature: GYAE6OF02FKR4Y.33.37.D04.1.454.CMB.1.raw
  modified_base (289)..(289): a, c, t, g, unknown or other
  misc_feature (289)..(289): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagaccagagtcaccatccacgttcgccaggccgagtgaggacattacggaaatttttaaattggtttacagcaaggaaacagggtaaacnccctagactccgtgattcacgagcactccaaattcggaaacgtagggtacccacgtaacgggttcaggttagggagggttggaggtcgtagggacctaggtaactttttaccccacgtaacccagttaccgaacggcgacgtccccgtaggaccctaacggtccctaagggaaacggtacgtttacccgtttagaacccgtaaacctaacttaaacgttttaacccgttagttaacccaaactaacgttaaagttaaaacttaaaccgtttaccctaccccgtttaaacgttaacccgttttttacgggaacccgttaacgggggtaaccctaaacggtccgtacgggtaacgaaccgttaacgaaaacccggtaacgttaggtacggtaccgttacggacctaacccgtaattcccgtcggttacctttaaccgg

SEQ ID NO: 108388 - DNA, 689 bp, Homo sapiens
  misc_feature: GYAE6OF02HEBZW.33.37.D04.1.454.CMB.1.raw
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
  modified_base (328)..(328): a, c, t, g, unknown or other
  misc_feature (328)..(328): n is a, c, g, or t
tcagtacacacactcacgaccggtgctcgatttagtagcatactgttgggtttgggggcaggagtcagtcccaacctggacacagcatggacatgagggtccctgctcagctcctggggctcctgctgctctggcctcccaggtgccagatgtgacatccagatcgacccagtcctccactccctccctgtctgtcttctggtcggagacagagtccaccatcactgccgaggcgagtggaggactacgttacgttaaatttttaagttggtttcagacaagaaccgaggacaacgaccctaaacnctgactcntcgctgctacagtntcgacgtaacggtcgggtaccagtacgaagttcgaggtgcgtaggtgacgtacggtaggacgtagtacttttccgaacttcctactaccctactacgacggtccgtacgtcgtaccgtaacctaaccgttaaggttaaccgtttagtttacctaaccgtttactttacccgtttctaaccgttactaaaccggttacttaacgttaacccttaactttcccccgttaaccgtaaccgttttacccggttaaccgaaccgggtaacccgggtaccttaaacggtccgggttacgtaaaccggtcgttaacgggaaccggttaccgttacggttcggtacgtacgtacccgggtactacccgg

SEQ ID NO: 108389 - DNA, 835 bp, Homo sapiens
  misc_feature: GYAE6OF02FT02N.33.37.D04.1.454.CMB.1.raw
  modified_base (131)..(131): a, c, t, g, unknown or other
  misc_feature (131)..(131): n is a, c, g, or t
tcagtacacacactcacgaccggtgctcgatttagtagcatactgttgggtttgggggcaggagtcagtcccaacctggacacagcatggacatgagggtccctgctcagctccgtgggctcctgctgctntcggcctcccgaggtgccagatgtgacactccagatcgaccctagtctccactcctcctgtctgtcttctgtcggagacgagacgtaccaccactcctacttcgccgaggcgaggtcggaaggtacttagttaacggtttaaatttttaagttcggttacagtacgaaagaaccgaaggtaaccgtacccgtagtaccttaccgttagtacttaccgacgtacggactaactaccgtaaagttacggtaaacggtaccgggtcccgtaacggttaaggttaccggtacggtagggtagggtacgggtacggacgggtacgggtaacgttacggttaacctttacccgtacaccgtacgtccgtaacgacgtaccgtacctcgggacctaacggtaccgtaaggtaacgttacgttcgttaaccgaacccgtaattaaacggttaacttacggttaacgttaacccgtaaacttaacggttaaactttaaaccttacggttaacccctttaccggttaaccgtttaaccggttttaccggggaaccggttaaacccggggtaaacgtaaaccgggttcggttaaccgggtaactttaacccggtaaaaccggttaaacccggttacgggtaacggtttacccggtaacgtccccgttaaccgtaacccttaacggttcccttttaccggtttacctttaacccgg

SEQ ID NO: 108390 - DNA, 785 bp, Homo sapiens
  misc_feature: GYAE6OF02JYS0E.33.37.D04.1.454.CMB.1.raw
  modified_base (202)..(202): a, c, t, g, unknown or other
  misc_feature (202)..(202): n is a, c, g, or t
tcagtacacacactcacgaccggtgctcgatttagtagcatactgttgggtttgggggcaggagtcagtcccaacctggacacagcatggacatgagggtccctgctcagctcgtggggctcctgctgctcgtggcctcccgaggtcgaccagagtgtgactatccgaagtatcgaccctagtcctcactcctccgtgtctntccgttacgtcggtacggacgacgtaagtcgtaccacctagtcctacggttcgaccggtaggtcggaagttgaacggtaactaagtttaacggttaaaagttttttaacgttcggttcaacggtacgaaaccggtaaaccggaacgggtaaccctccctaaggtacctaccgtaagtacgttaccgaaggacggtacacttaaccggtaacgttaacgggaaacggttaccggggacccctaaggttaacggtaccaggtcgacgttagtacggtactaccgggagtaactacgtatttacccgacttccgtaacctacgagtaccgacgtacttacgttacgtaacgtacgtaacggtaagaaacgttttttttacgacgtaacctttaaccgttaccttaacggttacgaaaccgttaacgtaccggttaaccggttaaccaacccttaacccgaacccgttacgtttaaccccgtaccgtttacccgtaccggtaaccgtacgtacgacgtacgtacgtaccgttacgtaaccgtaggtaccgtcggtactaccgaccgttactcgttactcgttaaccg

SEQ ID NO: 108391 - DNA, 206 bp, Homo sapiens
  misc_feature: GYAE6OF01CKGBT.47.14.B03.1.454.CMB.1.raw
  modified_base (163)..(206): a, c, t, g, unknown or other
  misc_feature (163)..(206): n is a, c, g, or t
tcagagctcacgtacacgaccggtgctcgatttagtgtgagtagtttgggtttcggcggagggaccaaactgaccgtcctaggtcagcccaaggctgcccctcggtcactctgttcccaccctcctctacgtgagctctgagcgggctggcaaggcgcatagnnnnnnnnnnnnnnnnnnnnnnnnnnnnnnnnnnnnnnnnnnnn

SEQ ID NO: 108392 - DNA, 441 bp, Homo sapiens
  misc_feature: GYAE6OF01EG2HL.47.14.B03.1.454.CMB.1.raw
  modified_base (427)..(427): a, c, t, g, unknown or other
  misc_feature (427)..(427): n is a, c, g, or t
  modified_base (433)..(441): a, c, t, g, unknown or other
  misc_feature (433)..(441): n is a, c, g, or t
tcagagctcacgtacacgaccggtgctcgatttagtgtgagtagtttgggtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtctaggtcagcccaaggccaaccccactgtcactctgttccccgccctcctctacgtgagctctgagcgggctggcaaggcncatagnnnnnnnnn

SEQ ID NO: 108393 - DNA, 433 bp, Homo sapiens
  misc_feature: GYAE6OF01BKBXN.47.14.B03.1.454.CMB.1.raw
  modified_base (430)..(433): a, c, t, g, unknown or other
  misc_feature (430)..(433): n is a, c, g, or t
tcagagctcacgtacacgaccggtgctcgatttagtgtgagtagtttgggtctgggacccccgggcagagggtcgtcatctcttgctctggaagcagctccaacatcggaaggaatgatgtgtactggttgcagcaactccccggaacggccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgcccctcggtcactctgttcccacctcctctacgtgagctctgagcgggctggcaaggcgcatagnnnn

SEQ ID NO: 108394 - DNA, 435 bp, Homo sapiens
  misc_feature: GYAE6OF01DBF8T.47.14.B03.1.454.CMB.1.raw
  modified_base (429)..(435): a, c, t, g, unknown or other
  misc_feature (429)..(435): n is a, c, g, or t
tcagagctcacgtacacgaccggtgctcgatttagtgtgagtagtttgggtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctcctggccatcagtgggctccggtccgaggatgaggctgattattattgtgcaacatgggatagtagcctgagtagtgtggttttcggcggagggaccaaactgaccgtctaggtcagccaaggctgcccctcggtcactctcgttcccgccctcctctacgtgagctctgagcggctggcaaggcgcatagnnnnnnn

SEQ ID NO: 108395 - DNA, 449 bp, Homo sapiens
  misc_feature: GYAE6OF01DP873.47.14.B03.1.454.CMB.1.raw
  modified_base (440)..(449): a, c, t, g, unknown or other
  misc_feature (440)..(449): n is a, c, g, or t
tcagagctcacgtacacgaccggtgctcgatttagtgtgagtagtttgggtctgggacccccgggcagagggtcgtcatctcttgctctggaagcagctccaacatcggaaggaatgatgtgtactggttgcagcaacctccccggaacggcccccaaactcctcatctatacgaataatcagcggtcctcgaggggtccctgaccgattctctggctccaagtctgacacctcacgcctcctggccatcagtgggctccggtccgaggatgaggctgattattattgtgcaacatgggatagtagcctgagtagtgttggttttcggcggagggaccaaacgtgaccgtctaggtcagcccaaggctcgcccctggtcactctcgttcccgccctcctctacgtgacgctctggagcgggctcggcaaggcgcatacgnnnnnnnnnn

SEQ ID NO: 108396 - DNA, 689 bp, Homo sapiens
  misc_feature: GYAE6OF01AT4GT.47.14.B03.1.454.CMB.1.raw
  modified_base (68)..(68): a, c, t, g, unknown or other
  misc_feature (68)..(68): n is a, c, g, or t
  modified_base (108)..(108): a, c, t, g, unknown or other
  misc_feature (108)..(108): n is a, c, g, or t
  modified_base (665)..(665): a, c, t, g, unknown or other
  misc_feature (665)..(665): n is a, c, g, or t
  modified_base (668)..(689): a, c, t, g, unknown or other
  misc_feature (668)..(689): n is a, c, g, or t
tcagagctcacgtacacgaccggtgctcgatttagtgtgagtagtttgggtctcggggacccccgggnagagggtcgtcatctcttgctctggaagcagctcccaaanatcggaaggaatgatgtgtactggtgcagccaaccgtccccggaaccgacccccaaatcctcatctaataacgaaataactcgacggtccggtcctcggacggggtcccctaggacccgtattccgtcgtcggcctaccgaagttccacgacctaccctccgaccgtccccttcccgaggccctaagtccggtaggggttccggggaccttcccggggtacggaggtacgtggaacggtcttaggttaattttaacgttagttggtacgaccgaaacgtaggtacgggtaagtaggtacgcgttaggtaggtttgggttcgggtttacgggttccgggaacgggtaaccggtaaccctaaaccgtcggtaccccgttaccggtacggacccgaaccgaccccggaacgggttccccctacccggttcccccgtcggttaccctccgttcccgttccccggttcccccctccccttaccgtacgtacgggtccgtaccgtccgttcgggacgggccgggtcccgggtcgaaccgggacggtaaccggccgtaagtagngcnnnnnnnnnnnnnnnnnnnnnn

SEQ ID NO: 108397 - DNA, 467 bp, Homo sapiens
  misc_feature: GYAE6OF01BHVPA.47.14.B03.1.454.CMB.1.raw
  modified_base (378)..(378): a, c, t, g, unknown or other
  misc_feature (378)..(378): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
  modified_base (443)..(467): a, c, t, g, unknown or other
  misc_feature (443)..(467): n is a, c, g, or t
tcagagctcacgtacacgaccggtgctcgatttagtgtgagtagtttgggtctgggacccccggggcagagggtcgtcatctcttgctctggaagcagctccaaacatcggaaggaatgatgtgtactggttgcagcaactccccggaacggcccccaaactcctcatctataacaatgatcagcggccctcgaggggtccctggccgattctctcggctccaagtctggcgcctcagccacctggccatcagtggctccggcccgaggatgaggctgattatactgtgtaggttggatcggcgagcctgactgtcttacgtcttggagcgtgggaccaaggtcaccgtcctaggtacagacccaaggcccaaacccnctcgtcactcgtcgtccccgccctcctactacgngacnctcngacgcggctggcaggcncgatgnnnnnnnnnnnnnnnnnnnnnnnnn

SEQ ID NO: 108398 - DNA, 505 bp, Homo sapiens
  misc_feature: GYAE6OF01AHSFO.47.14.B03.1.454.CMB.1.raw
  modified_base (448)..(448): a, c, t, g, unknown or other
  misc_feature (448)..(448): n is a, c, g, or t
  modified_base (482)..(486): a, c, t, g, unknown or other
  misc_feature (482)..(486): n is a, c, g, or t
  modified_base (488)..(505): a, c, t, g, unknown or other
  misc_feature (488)..(505): n is a, c, g, or t
tcagagctcacgtacacgaccggtgctcgatttagtgtgagtagtttgggtctgggacccccgggcagagggtcgtcatctcttgctctggaagcagctccaacatcggaaggaatgatgtgtactggttgcagcaactccccggaacggcccccaaactcctcatctataacaatgatcagcggccctcaggggtccctggccgattctctggctccaagtctggcgcctcagcccaccctggccatcaggtcggggcctcccggcccgaggatggaggctgattattactgtgtaggttgggatcgcgacgcctgactgcttacgtcttcggagcgtgggaccaggtccaccgtccgtaggtcacgcccgaaggcccaaccccgtcgtcgtcctaccgtcgttccgttccccgccccttccctcttaaccggtcgacgtccttcgngacggtcgggctgggccaagggtcgcctagtagnnnnngnnnnnnnnnnnnnnnnnn

SEQ ID NO: 108399 - DNA, 556 bp, Homo sapiens
  misc_feature: GYAE6OF01CIWMB.47.14.B03.1.454.CMB.1.raw
  modified_base (521)..(522): a, c, t, g, unknown or other
  misc_feature (521)..(522): n is a, c, g, or t
  modified_base (527)..(528): a, c, t, g, unknown or other
  misc_feature (527)..(528): n is a, c, g, or t
  modified_base (531)..(556): a, c, t, g, unknown or other
  misc_feature (531)..(556): n is a, c, g, or t
tcagagctcacgtacacgaccggtgctcgatttagtgtgagtagtttgggtctgggacccccgggcagagggtcgtcatctcttgttctggaagcagctccaatatcggaaatgataatgtatactggtaccagcaagtcccacgaaccggcccccaaactcctcatctataacatgactcagccggccctgacggggtccctggccgattcctctggcctccgaagtctggccgacctcacgccaccctggccctatcgaggtcgggcctacccgggaccgaggtacgtgacggtctagtactttatacgtgtggtacggttggactcgcgagtctgactgcttacgtcttcggagtcgtacggggaccaacgggtccacggtccgtaggtccacggacccctaaggaccccaacccgtactcgtaccactacgtcccgtaccccaacctcctacttacgacgtctacccgttcgtaggaccggccggtcctagggacaacgggtcgctaagtccgcagnngtacnnctnnnnnnnnnnnnnnnnnnnnnnnnnn

SEQ ID NO: 108400 - DNA, 533 bp, Homo sapiens
  misc_feature: GYAE6OF01B09TG.47.14.B03.1.454.CMB.1.raw
  modified_base (233)..(233): a, c, t, g, unknown or other
  misc_feature (233)..(233): n is a, c, g, or t
  modified_base (404)..(404): a, c, t, g, unknown or other
  misc_feature (404)..(404): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (508)..(533): a, c, t, g, unknown or other
  misc_feature (508)..(533): n is a, c, g, or t
tcagagctcacgtacacgaccggtgctcgatttagtgtgagtagtttgggtctgggacccccgggcagagggtcgtcatctcttgctctggaagcagctccaacatcggaaatgataatgtatactggtaccagcaagtcccacgaacggcccccaaactcctcatctataacaatgatcagcggccctcacgggggtccctggccgattcctctggcctccaagtctggccncctcacgcccaccctggccatcgaggtcgggcctcccgggcccgaggatggacggctgtatttatactggttgtaggttggactcgcagcctgactgtcttacggtcttcgggagtcgtcgggacctaaggtccaccggtcgtaggtcacggacccgaagccccaaccctntcgtccactctccgttccccacccttcctacgtacgtcgactcctcgtaggcggtccgggtcgtgggaccgaacgggtccgagtacgtaggntacgnangcatnnnnnnnnnnnnnnnnnnnnnnnnnn

SEQ ID NO: 108401 - DNA, 691 bp, Homo sapiens
  misc_feature: GYAE6OF01B0P8S.47.14.B03.1.454.CMB.1.raw
  modified_base (653)..(653): a, c, t, g, unknown or other
  misc_feature (653)..(653): n is a, c, g, or t
  modified_base (657)..(659): a, c, t, g, unknown or other
  misc_feature (657)..(659): n is a, c, g, or t
  modified_base (661)..(663): a, c, t, g, unknown or other
  misc_feature (661)..(663): n is a, c, g, or t
  modified_base (665)..(667): a, c, t, g, unknown or other
  misc_feature (665)..(667): n is a, c, g, or t
  modified_base (669)..(669): a, c, t, g, unknown or other
  misc_feature (669)..(669): n is a, c, g, or t
  modified_base (671)..(674): a, c, t, g, unknown or other
  misc_feature (671)..(674): n is a, c, g, or t
  modified_base (677)..(687): a, c, t, g, unknown or other
  misc_feature (677)..(687): n is a, c, g, or t
  modified_base (689)..(689): a, c, t, g, unknown or other
  misc_feature (689)..(689): n is a, c, g, or t
  modified_base (691)..(691): a, c, t, g, unknown or other
  misc_feature (691)..(691): n is a, c, g, or t
tcagagctcacgtacacgaccggtgctcgatttagtgtgagtagtttgggtcgtgggacccccgggcagagggtcgtcatctcttgctctggaagcagctccaacagtcgggaaggaatgatgtgtacgtggttcgcagcaaccgtcccccggaaccggacccccaaactcctcatctaataacgaaataactcgagtccggtcctacggaccggggtcccctagaccgtattcctcgtcggcctaccaaggtctacgaccacctcaccggccctcccgtacggaccagtcgtacgggtcgggtcctacccgggtgaacggtagtcggacggtctagtaattttaattagtttggaaccgacgtaaaacgtaggttagggtaatttaacggtacgtaccggtagggttaaggtttggtttccgggttttacggggtttaccggggaacgggaacggtaacccttaaacggtcgtacccggtttacgacggtacgacccgacccgtaacggtcccgtcccggtcccccgtggttcccttacggtccctttaccccggttcccccaacccgtttccgtacgtacgtcgacggtccctgggtcggacggtcccggtagaccgggtacacggtccaacgtacgtgacctgatgacgngtcnnngnnngnnngngnnnngcnnnnnnnnnnngngn

SEQ ID NO: 108402 - DNA, 440 bp, Homo sapiens
  misc_feature: GYAE6OF02HLMNG.47.14.B03.1.454.CMB.1.raw
  modified_base (432)..(440): a, c, t, g, unknown or other
  misc_feature (432)..(440): n is a, c, g, or t
tcagagctcacgtacacgaccggtgctcgatttagtgtgagtagtttgggtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctggtcactctgttcccaccctcctctacgtgagctctgagcgggctggcaaggcgcatagnnnnnnnnn

SEQ ID NO: 108403 - DNA, 441 bp, Homo sapiens
  misc_feature: GYAE6OF02HIO84.47.14.B03.1.454.CMB.1.raw
  modified_base (428)..(428): a, c, t, g, unknown or other
  misc_feature (428)..(428): n is a, c, g, or t
  modified_base (433)..(441): a, c, t, g, unknown or other
  misc_feature (433)..(441): n is a, c, g, or t
tcagagctcacgtacacgaccggtgctcgatttagtgtgagtagtttgggtctgggacccccgggcagagggtcgtcatctcttgctctggaagcagctccaacatcggaaggaatgatgtgtactggttgcagcaactccccggaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaggtcaccgtcctaggtcagcccaaggcccaacccatcgtcactctcgttccccacctcctctacgtgacgctctgagcgggctggcaaggcncatgnnnnnnnnn

SEQ ID NO: 108404 - DNA, 455 bp, Homo sapiens
  misc_feature: GYAE6OF02H6UQV.47.14.B03.1.454.CMB.1.raw
  modified_base (228)..(228): a, c, t, g, unknown or other
  misc_feature (228)..(228): n is a, c, g, or t
  modified_base (420)..(420): a, c, t, g, unknown or other
  misc_feature (420)..(420): n is a, c, g, or t
  modified_base (439)..(439): a, c, t, g, unknown or other
  misc_feature (439)..(439): n is a, c, g, or t
  modified_base (445)..(455): a, c, t, g, unknown or other
  misc_feature (445)..(455): n is a, c, g, or t
tcagagctcacgtacacgaccggtgctcgatttagtgtgagtagtttgggtctgggacccccgggcagagggtcgtcatctcttgctctggaagcagctccaacatcggaaggaatgatgtgtactggttgcagcaactccccggaacggcccccaaactcctcatctataacaatgatcagcggccctcaggggtccctggccgattctctggctccaagtctggcncctcagccaccctggccatcagtgggctccggcccgaggatgaggctgattattactgtgtaggttgggatcgcagcctgactgcttacgtcgttcggagcgtgggaccaaggtcaccgtcctaggtcacgcccaaggcccaacccactcgtcacttcctcgttcccacccctctactacgtgacgctctgngcggggctgggcaacggcncatagnnnnnnnnnnn

SEQ ID NO: 108405 - DNA, 435 bp, Homo sapiens
  misc_feature: GYAE6OF02G7USQ.47.14.B03.1.454.CMB.1.raw
  modified_base (433)..(435): a, c, t, g, unknown or other
  misc_feature (433)..(435): n is a, c, g, or t
tcagagctcacgtacacgaccggtgctcgatttagtgtgagtagtttgggtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtctaggtcagcccaaggctgccccctcggtcactctgttcccaccctcctctacgtgacgctctgagcgggctggcaaggcgcatagnnn

SEQ ID NO: 108406 - DNA, 456 bp, Homo sapiens
  misc_feature: GYAE6OF02FLK8X.47.14.B03.1.454.CMB.1.raw
  modified_base (395)..(395): a, c, t, g, unknown or other
  misc_feature (395)..(395): n is a, c, g, or t
  modified_base (417)..(417): a, c, t, g, unknown or other
  misc_feature (417)..(417): n is a, c, g, or t
  modified_base (434)..(434): a, c, t, g, unknown or other
  misc_feature (434)..(434): n is a, c, g, or t
  modified_base (441)..(456): a, c, t, g, unknown or other
  misc_feature (441)..(456): n is a, c, g, or t
tcagagctcacgtacacgaccggtgctcgatttagtgtgagtagtttgggtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcaggtcgggctccggtccgaggatgaggctgatttattattgtgcaacatgggatagtagcctgagtagtgtggttttcggcggagggaccaacgtcgaccgtcctaggtcacgcccaaggctcgccccctcggtcactctcttcccnccctcctctacgtgagctctgngcggctcggcaacggcncgatagnnnnnnnnnnnnnnnn

SEQ ID NO: 108407 - DNA, 445 bp, Homo sapiens
  misc_feature: GYAE6OF02HU91E.47.14.B03.1.454.CMB.1.raw
  modified_base (276)..(276): a, c, t, g, unknown or other
  misc_feature (276)..(276): n is a, c, g, or t
  modified_base (428)..(428): a, c, t, g, unknown or other
  misc_feature (428)..(428): n is a, c, g, or t
  modified_base (435)..(445): a, c, t, g, unknown or other
  misc_feature (435)..(445): n is a, c, g, or t
tcagagctcacgtacacgaccggtgctcgatttagtgtgagtagtttgggtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggcctccggtccgaggatgaggcngatattatgtgcaacatgggatagtagcctgagtagtgtggttttcggcggagggacaacgtgaccgtcctaggtcagcccaaggctgcccctggtcactctcgttcccaccctcctcttacgtgacgctctgacgcgggctgggcaaggcncgatagnnnnnnnnnnn

SEQ ID NO: 108408 - DNA, 562 bp, Homo sapiens
  misc_feature: GYAE6OF02FOCWZ.47.14.B03.1.454.CMB.1.raw
  modified_base (210)..(210): a, c, t, g, unknown or other
  misc_feature (210)..(210): n is a, c, g, or t
  modified_base (327)..(327): a, c, t, g, unknown or other
  misc_feature (327)..(327): n is a, c, g, or t
  modified_base (374)..(374): a, c, t, g, unknown or other
  misc_feature (374)..(374): n is a, c, g, or t
  modified_base (484)..(484): a, c, t, g, unknown or other
  misc_feature (484)..(484): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (517)..(517): a, c, t, g, unknown or other
  misc_feature (517)..(517): n is a, c, g, or t
tcagagctcacgtacacgaccggtgctcgatttagtgtgagtagtttgggtctgggacccccgggcagagggtcgtcatctcttgctctggaagcagctccaacatcggaaggaatgatgtgtactggttgcagcaactccccggaacggcccccaaactcctacatctataacaatgatcagcggcctcaggggtccctggccgattcnctggctccaagtctggcgcctcagccacctggccatcagtggctccggccgaggatggacggtctagtattatacgtgtcgtagggttggatcgcagcctgactgcttagtctcggngctgggacctaaggtcaccgtctaggtcagcccaaggtcccaacccnttgacctacgtcctacgttccccgcccttaccgtacgttgacgtcctcgtggacggccggaccttgggacctaacgggccggtaacattacgggcagtcactggattganccgagtgagtaccnacncgtagtacgcacggtntaccgtctagtccgttagcacgtacgtacgtacgtacgtacgtcg

SEQ ID NO: 108409 - DNA, 664 bp, Homo sapiens
  misc_feature: GYAE6OF02H61FL.47.14.B03.1.454.CMB.1.raw
  modified_base (205)..(205): a, c, t, g, unknown or other
  misc_feature (205)..(205): n is a, c, g, or t
  modified_base (625)..(625): a, c, t, g, unknown or other
  misc_feature (625)..(625): n is a, c, g, or t
  modified_base (628)..(628): a, c, t, g, unknown or other
  misc_feature (628)..(628): n is a, c, g, or t
  modified_base (630)..(631): a, c, t, g, unknown or other
  misc_feature (630)..(631): n is a, c, g, or t
  modified_base (633)..(634): a, c, t, g, unknown or other
  misc_feature (633)..(634): n is a, c, g, or t
  modified_base (636)..(637): a, c, t, g, unknown or other
  misc_feature (636)..(637): n is a, c, g, or t
  modified_base (640)..(641): a, c, t, g, unknown or other
  misc_feature (640)..(641): n is a, c, g, or t
  modified_base (645)..(645): a, c, t, g, unknown or other
  misc_feature (645)..(645): n is a, c, g, or t
  modified_base (647)..(663): a, c, t, g, unknown or other
  misc_feature (647)..(663): n is a, c, g, or t
tcagagctcacgtacacgaccggtgctcgatttagtgtgagtagtttgggtctgggacccccgggcagagggtcgtcatctcttgctctggaagcagctccaacatcggaaggaatgatgtgtactggttgcagcaaacctccccggaaccgccccccaaactcctcatctatacgaataatcagcggtcctcgacggggtcccngaccgattctctggctaccaagtctcgacctacctcacgtccctcccgtggaccctaatcgacggtcggtcccgtcccggttaccggagtacgtaggcggtcgttagtatttactttagttgtacgacctaactagttgggaagttaggtaccgcgtaggtaaggttggttcggtttcgggttttaccggggacgggtaacggtaacccgtaaaaccgttcggaacccgttaccggttaccgggtcaacccggtacccgtaggtccgccccgggttcccccctacgggtcctaccgttacccgttcccggtttacccccctccccgttccgtttaacccgtttacgtcgggtacccgtcgtttccggtaagggccgggtccgggtcggtacggacggtacggcgtacgtaatggacgtcntangnngnngnngcnngtangnnnnnnnnnnnnnnnnnc

SEQ ID NO: 108410 - DNA, 623 bp, Homo sapiens
  misc_feature: GYAE6OF02F8C6S.47.14.B03.1.454.CMB.1.raw
  modified_base (188)..(188): a, c, t, g, unknown or other
  misc_feature (188)..(188): n is a, c, g, or t
  modified_base (232)..(232): a, c, t, g, unknown or other
  misc_feature (232)..(232): n is a, c, g, or t
  modified_base (530)..(530): a, c, t, g, unknown or other
  misc_feature (530)..(530): n is a, c, g, or t
  modified_base (565)..(565): a, c, t, g, unknown or other
  misc_feature (565)..(565): n is a, c, g, or t
  modified_base (588)..(588): a, c, t, g, unknown or other
  misc_feature (588)..(588): n is a, c, g, or t
  modified_base (592)..(592): a, c, t, g, unknown or other
  misc_feature (592)..(592): n is a, c, g, or t
  modified_base (595)..(595): a, c, t, g, unknown or other
  misc_feature (595)..(595): n is a, c, g, or t
  modified_base (597)..(601): a, c, t, g, unknown or other
  misc_feature (597)..(601): n is a, c, g, or t
  modified_base (603)..(616): a, c, t, g, unknown or other
  misc_feature (603)..(616): n is a, c, g, or t
  modified_base (618)..(623): a, c, t, g, unknown or other
  misc_feature (618)..(623): n is a, c, g, or t
tcagagctcacgtacacgaccggtgctcgatttagtgtgagtagtttgggtctgggacccccgggcagagggtcgtcatctcttgctctggaagcagctccaacatcggaaggaatgatgtgtactggttgcagcaactccccggaacggcccccaaactcctcatcatacgaataatcagcggtccngaggggtccctgacgattcctcgtggctccaatctgaccacctnacgtccctcccgtgccaatccaggtcggggcctccggtaccgagggtatggacgggtctacggtattttacgttacgtggttagggttaggttgggattccggctaggcccgttagacttggtaccctttacggtttcgtttcggggacgtcggttaaccggggacctaaggtacccgtacccgttccggtaaggttcccgaaacggccccggaaacgtcccccgaaacccccgttctaggtaccctaaccgttcccttcccgggttaaccccctccccgtttctaaccgtcggtacncgtacccttcgacggtcgaccgggtctaccggganaccgggtcacggtaaatcgtgangtcncangnnnnncnnnnnnnnnnnnnncnnnnnn

SEQ ID NO: 108411 - DNA, 636 bp, Homo sapiens
  misc_feature: GYAE6OF02ICYA8.47.14.B03.1.454.CMB.1.raw
  modified_base (345)..(345): a, c, t, g, unknown or other
  misc_feature (345)..(345): n is a, c, g, or t
  modified_base (601)..(601): a, c, t, g, unknown or other
  misc_feature (601)..(601): n is a, c, g, or t
  modified_base (604)..(604): a, c, t, g, unknown or other
  misc_feature (604)..(604): n is a, c, g, or t
  modified_base (607)..(609): a, c, t, g, unknown or other
  misc_feature (607)..(609): n is a, c, g, or t
  modified_base (611)..(627): a, c, t, g, unknown or other
  misc_feature (611)..(627): n is a, c, g, or t
  modified_base (629)..(629): a, c, t, g, unknown or other
  misc_feature (629)..(629): n is a, c, g, or t
  modified_base (631)..(636): a, c, t, g, unknown or other
  misc_feature (631)..(636): n is a, c, g, or t
tcagagctcacgtacacgaccggtgctcgatttagtgtgagtagtttgggtctgggaccccccgggcagagggtctcatctcttgctctggaagcagctccaacatcgggaaggaatgatgtgtactgggttgcagccaacctccccggaaccggcccccaaactcctcatctatacgaataatcaggcggtcctcgacggggtccctggaccgattcctctggcctaccaagtctacgacaccctcacggccccctcccgtggccctatccgtaggtcggggtccgtaccccgggtcggaggatggagggcttagtactttatttagttcggtagaccgtaaanaggttagggaattaaggtaccggccttagggaaggtttggttggtttcggggttttcgggacgggtaacgggacctaaacgttcggaccgttaccgtagccggacgacccgaaggcctcccgtcccccgtcggtacctaccgttcgtcccgttccccccgtccccgtttccctccgttaacggtcggtacccgtcttccggtcgaaccgggtcggggccgtagggccggaagggcccacgttacgaggacaggtcnagnacnnngnnnnnnnnnnnnnnnnncncnnnnnn

SEQ ID NO: 108412 - DNA, 707 bp, Homo sapiens
  misc_feature: GYAE6OF02FK32D.47.14.B03.1.454.CMB.1.raw
  modified_base (242)..(242): a, c, t, g, unknown or other
  misc_feature (242)..(242): n is a, c, g, or t
  modified_base (646)..(646): a, c, t, g, unknown or other
  misc_feature (646)..(646): n is a, c, g, or t
  modified_base (655)..(655): a, c, t, g, unknown or other
  misc_feature (655)..(655): n is a, c, g, or t
  modified_base (658)..(659): a, c, t, g, unknown or other
  misc_feature (658)..(659): n is a, c, g, or t
  modified_base (663)..(663): a, c, t, g, unknown or other
  misc_feature (663)..(663): n is a, c, g, or t
  modified_base (670)..(670): a, c, t, g, unknown or other
  misc_feature (670)..(670): n is a, c, g, or t
  modified_base (678)..(678): a, c, t, g, unknown or other
  misc_feature (678)..(678): n is a, c, g, or t
  modified_base (685)..(685): a, c, t, g, unknown or other
  misc_feature (685)..(685): n is a, c, g, or t
  modified_base (688)..(688): a, c, t, g, unknown or other
  misc_feature (688)..(688): n is a, c, g, or t
  modified_base (692)..(692): a, c, t, g, unknown or other
  misc_feature (692)..(692): n is a, c, g, or t
  modified_base (699)..(699): a, c, t, g, unknown or other
  misc_feature (699)..(699): n is a, c, g, or t
  modified_base (703)..(703): a, c, t, g, unknown or other
  misc_feature (703)..(703): n is a, c, g, or t
tcagagctcacgtacacgaccggtgctcgatttagtgtgagtagtttgggtctggggacccccgggcagagggtcgtcatctcttgctctggaagcagctccaacatcggaaggaatgatgtgtactggttgcagcaactcccctgaacggccccaaactcctcatctatacgaataactcagccgtcctcgacggggttccctgaccgtattctcgtcggcctaccaagtccgtcgggccncccttacgacgtccccacccgtggcccattccgacgggtcggggtcctaccccgggggaccccggaagggtatcgggacggtcgtacgtaatttaacgttttactggtggtaacgggtttggggacttcggccaggccctgtacttcggtccgttttaaccgtccgttagggcgtaccggtcggggtaacccaacggttccgaccgggttaccctttagggggacccaaccggaccccggtaaacgggtaccccctaaaaccccgtcgttaccgtaccctaccttccggtttcccgttaacccccctaccccgttcccttacgttaccggtacgccgttaccgtccgtcggtaacgggccggggtccgtcgggaccggaaacgggttccgacacggtagacgtnacgcagtcngcnncgcncgcgacnctcgtacncgacgcncgnctcnacacagntctngtcg

SEQ ID NO: 108413 - DNA, 527 bp, Homo sapiens
  misc_feature: GYAE6OF02FMIT0.47.14.B03.1.454.CMB.1.raw
  modified_base (279)..(279): a, c, t, g, unknown or other
  misc_feature (279)..(279): n is a, c, g, or t
  modified_base (359)..(359): a, c, t, g, unknown or other
  misc_feature (359)..(359): n is a, c, g, or t
  modified_base (490)..(490): a, c, t, g, unknown or other
  misc_feature (490)..(490): n is a, c, g, or t
  modified_base (494)..(500): a, c, t, g, unknown or other
  misc_feature (494)..(500): n is a, c, g, or t
  modified_base (502)..(524): a, c, t, g, unknown or other
  misc_feature (502)..(524): n is a, c, g, or t
  modified_base (526)..(527): a, c, t, g, unknown or other
  misc_feature (526)..(527): n is a, c, g, or t
tcagagctcacgtacacgaccggtgctcgatttagtgtgagtagtttgggtctgggacccccgggcagagggtcgtcatctcttgctctggaagcagctcaacatcggaaggaatgatgtgtactggttgcagcaactccccggaacggcccccaaactcctcatctatacgaataatcagcggtcctcgacggggtccctgaccgtattctctggcctccaatttcgtagggaaccacggccaccctgacccatcagccgcggtcgaacgccggaagntgaggccgactattactgtcgaggtgtgggacagtaatagagtatcccggagctaggttttcggcgggtcgggaccagcngaccgtctagctagacccgaagcctcgcccctcggtcactcgtccgttcccctacccctcccgttctaaccgtgacgttccctctcggagccgggggtctgggccgtaacgggcgaccgtaagttaacggngcannnnnnnannnnnnnnnnnnnnnnnnnnnnncnn

SEQ ID NO: 108414 - DNA, 684 bp, Homo sapiens
  misc_feature: GYAE6OF02I35M5.47.14.B03.1.454.CMB.1.raw
  modified_base (190)..(190): a, c, t, g, unknown or other
  misc_feature (190)..(190): n is a, c, g, or t
  modified_base (644)..(644): a, c, t, g, unknown or other
  misc_feature (644)..(644): n is a, c, g, or t
  modified_base (650)..(650): a, c, t, g, unknown or other
  misc_feature (650)..(650): n is a, c, g, or t
  modified_base (653)..(653): a, c, t, g, unknown or other
  misc_feature (653)..(653): n is a, c, g, or t
  modified_base (656)..(657): a, c, t, g, unknown or other
  misc_feature (656)..(657): n is a, c, g, or t
  modified_base (660)..(662): a, c, t, g, unknown or other
  misc_feature (660)..(662): n is a, c, g, or t
  modified_base (664)..(664): a, c, t, g, unknown or other
  misc_feature (664)..(664): n is a, c, g, or t
  modified_base (666)..(684): a, c, t, g, unknown or other
  misc_feature (666)..(684): n is a, c, g, or t
tcagagctcacgtacacgaccggtgctcgatttagtgtgagtagtttgggtctgggacccccgggcagagggtcgtcatctcttgctctggaagcagctccaatatcggaaatgataatgtatactggtaccagcaagtcccagaaccggccccaaactctcatctaataacaatgatacagccggtccncgacggggtccctggccgtattctcgtggcctaccgaagtcgtacggccgtcctacgacgtccctacccgtcggaccatccgacggtcggccgttcccgggccggaaggtacgtcggacggtacgttacgtaatttaacgtttaccgtggttacggttacggggtttacggtacgtccggacgacgtccgtacgtccgttcggtacctttaccggttcgtacggtaccgtacgggttaccgggaacgtacgggtaccgtaacccgttcggtaacggtaccgaaaccggcccggaaaccggaccccccgtaaaccgtacgttaccggttccaaccgtttcccgttaccggttacccccctaacccgttccgttaccgttaacggtacggcccgtttacgtccgttaacgggaccgggtccggacggttaccggaacggtacgcgtacgatcgctnaccgtncgnacnngtnnnancnnnnnnnnnnnnnnnnnnn

SEQ ID NO: 108415 - DNA, 509 bp, Homo sapiens
  misc_feature: GYAE6OF01BPSK7.42.23.C01.1.454.CMB.1.raw
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagagggccaccctcaactgcaagtccagccagagtcttacctacgacttcgacaataagtcctacttagcttggtatcagcagaaacccggacagcctcctaagctgctcatttactggtcttctacccgggaatccggggtccctgaccgattcactggcagcgggtctgggacagacttcactctcaccatcagcagcgttcagactgaagatgtggccgtctatttctgtcagcaatattactctagtttttttcctcggtccctgggtaccaaagtcaatatcaaacgactgtgctgcacatctgtctc

SEQ ID NO: 108416 - DNA, 504 bp, Homo sapiens
  misc_feature: GYAE6OF01DIBGR.42.23.C01.1.454.CMB.1.raw
  modified_base (369)..(369): a, c, t, g, unknown or other
  misc_feature (369)..(369): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagagggccaccctcaactgcaagtccagccagagtcttaccacgacttcgacaataagtcctacttagcttggtatcagcagaaacccggacagcctcctaagctgctcatttactggtcttctacccgggaatccggggtccctgaccgattcactggcagcggtctggacngactcactctcaccatcagcagcgttcagactgaagatgtggccgtctatttctgtcagctaatattactctagtttttctccttcggcctggaccaaagtcaatatacaaacgactgtgctgacaccatctgtc

SEQ ID NO: 108417 - DNA, 520 bp, Homo sapiens
  misc_feature: GYAE6OF01CRGHR.42.23.C01.1.454.CMB.1.raw
  modified_base (364)..(364): a, c, t, g, unknown or other
  misc_feature (364)..(364): n is a, c, g, or t
  modified_base (419)..(419): a, c, t, g, unknown or other
  misc_feature (419)..(419): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagagggccaccctcaactgcaagtccagccagagtcttaccacgacttcgacaataagtcctacttagcttggtatcagcagaaacccggacagcctcctaagctgctcatttactggtcttctacccgggaatccggggtccctgaccgattcactggcagcggtcngggacagacttcactctcaccatcagcagcgttacagactgaagatgttgccgtnttatttctgtcagcaatattactcttagttttttctccttcggtccctggacctaaagtcaaatactacaaacgtactagtgtctgacacctatctgttcc

SEQ ID NO: 108418 - DNA, 619 bp, Homo sapiens
  misc_feature: GYAE6OF01CSPDS.42.23.C01.1.454.CMB.1.raw
  modified_base (211)..(211): a, c, t, g, unknown or other
  misc_feature (211)..(211): n is a, c, g, or t
  modified_base (284)..(284): a, c, t, g, unknown or other
  misc_feature (284)..(284): n is a, c, g, or t
  modified_base (366)..(366): a, c, t, g, unknown or other
  misc_feature (366)..(366): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacagtcgtgatgaccctagtctccagactcctggctgtgtctggtgggcgagagggccacctnaacgtgcaagtccagccagagtcttaccacgcttcgacaatagtcctactagcttggtatcagcagaacccgnagcctcctagctgctcatttactggtcttcgtaccgggatccggggtcctgaccgattcacgtggcaggtcggtctgggacngacttcactcacacatcacgcagtcgttacagactagaacgtacgtcggttcggtacccgttctttacgtttcgtagttccgaacgtctaaacgttacgtttaaccttcgtttacggttttttttaccgttcccgtttccgggtaccccttacggggtaaccctaaacggttacctaaacgttacgtaccgtaaaacggtaacgttacgggtacggtacgttacgaccttaacgtaccttcgttcggttaccc

SEQ ID NO: 108419 - DNA, 577 bp, Homo sapiens
  misc_feature: GYAE6OF01DKJ4Q.42.23.C01.1.454.CMB.1.raw
  modified_base (314)..(314): a, c, t, g, unknown or other
  misc_feature (314)..(314): n is a, c, g, or t
  modified_base (385)..(385): a, c, t, g, unknown or other
  misc_feature (385)..(385): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagagggccacctcaactgcaagtccagccagagtcttacctacgacttcgacaataagtcctacttagcttggtatcagcacgaaacccggacagcctcctaagctgctctatttacnggtcttcgtaccgggaatccggggtcctgaccgattcactggcaggcggtctgggacagtaccttcactcncaccatcagcagtcgttacagtactagaagagtggtcggtccgttcttatttctgtcagtactaattacttacctttctttacgtttttttcctccgtttccggtacccgttacggtaacctaaacgtactaaacgttactaacaaacgtacgttcggtacgtcctacgaccacctacttccgttcgttacc

SEQ ID NO: 108420 - DNA, 512 bp, Homo sapiens
  misc_feature: GYAE6OF01CY4CT.42.23.C01.1.454.CMB.1.raw
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
tcagtgacgtatgtcacgaccggtgctcgatttagtacacgtgattagggagttggggagctacaacaggctaggcaggggcagcaagagtgtgttgcagacccaggtcttcatttctctgttgctctggatctctggtgcccgtccgggacatcgtgatgacccagtctccagacctccctggctgtgtctgtgggcgagacgggccaccctcaactgcaagtccagccagagtctacctacgacttcgacaataagtcctactagcttggtatcagcagaaaccggacacgcctcctaagctgctcatttactgtcttctacccggaatccgggtccctgaccgattcactgcagcggtctggacagcttcactctcacatcagcagcgttcagactgaagatgtgcccgtntattctntcagacaatattactcttacgttttttctccttcgccctggacctaaagtcaatactacaaactacgtgtggctgccaaccatctgttacc

SEQ ID NO: 108421 - DNA, 610 bp, Homo sapiens
  misc_feature: GYAE6OF01CRT57.42.23.C01.1.454.CMB.1.raw
  modified_base (302)..(302): a, c, t, g, unknown or other
  misc_feature (302)..(302): n is a, c, g, or t
  modified_base (329)..(329): a, c, t, g, unknown or other
  misc_feature (329)..(329): n is a, c, g, or t
  modified_base (380)..(380): a, c, t, g, unknown or other
  misc_feature (380)..(380): n is a, c, g, or t
  modified_base (406)..(406): a, c, t, g, unknown or other
  misc_feature (406)..(406): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatcgacccagtcctccagacctccctggctgtgtctggtcggggcgaggacgggcccaccctcaactgacaagtccagccagagtcttaccacgacttcgaacaataagtcctacttagcttaggtatcagcaacgaaacccgganacgccctactaagctgctctatttacngtctacgaccgggaatccgggtcctagaccgattcacgtggacagcggtcnggacagcttcactctacaccatacancgacgtcgttacagactagaagagtcggtcgaccgttcttattctgtacaagtacctaattacttacgttactttacgtttttcctccgttaccggacccgttagggaaccctaaaagttacctaaacgttaactaaacccgtaaaacgtacgttacggtacgtacgttaccgaccgaacccttacttaccgttcgttaacccc

SEQ ID NO: 108422 - DNA, 583 bp, Homo sapiens
  misc_feature: GYAE6OF01DODYC.42.23.C01.1.454.CMB.1.raw
  modified_base (443)..(443): a, c, t, g, unknown or other
  misc_feature (443)..(443): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactcctggctgtgtctgtgggcgagagggccaccctcaactgcaagtccagccagacgtccttacctacgacttcgaacaataacgtcctacttagcttggtatcagcaagaaacccggcagcctacctaagctgctacatttactggttcttccgtaacccgggaacttcccggggtcctgaccgtattcacgtggcaggtcgggtctgggacagtacttcactctcaccatcagcgagtcgttcagacgtagaagagtggtcggccgtnttactttctagtcgagtactaattacttacttactttacgttttttctcccgtttccggtcccgttacgggtaacctaaacgttacaacgtactaactaaacgtaactacggtgaccgtagacctacacttcttgttacc

SEQ ID NO: 108423 - DNA, 527 bp, Homo sapiens
  misc_feature: GYAE6OF01BK5KD.42.23.C01.1.454.CMB.1.raw
  modified_base (516)..(516): a, c, t, g, unknown or other
  misc_feature (516)..(516): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagagggccaccctcaactgcaagtccagccagagtcttacctacgacttcgacaataagtcctacttagcttggtatcagcagaaacccggacagcctcctaagctgctcatttactggtcttctacccgggatccggggtccctgaccgattcactggcagcgggtctgggacagacttcactctcaccatcagcagcgttcagactgaagatgtggccgttctatttctgtcagcctaattattactcttagttttttctccttccggtccctgggtacctaaagtctaaatactacaaacgtactgtgctgacaccnttctgtttacc

SEQ ID NO: 108424 - DNA, 600 bp, Homo sapiens
  misc_feature: GYAE6OF01A9ZC8.42.23.C01.1.454.CMB.1.raw
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctggtgggcgagagggcccacccgtcaactgcaagtccagccagacgtcttacctacgacttcgacaataagtcctacttagcttggtatcagcacgaaacccgacagcctccaagctgctcatttactgtcttacgtacccgggtaatcccggggtccctcgaccgtacttcgactggcagtcgggtctggacagacttcactctacacctatcacgcagtcgttcacgtacgtagaacgagtgtcggtccttctactttcgtgtcgagtctaattacgttacgttactttacgttttttccgtcccgttccggtacccgttacgggtaacctaaacggtactaaacgtacgtaactaaaccggtacgttacgtacggtacttacgtacctaacgtcttcgttcgttacccg

SEQ ID NO: 108425 - DNA, 605 bp, Homo sapiens
  misc_feature: GYAE6OF01DVAGH.42.23.C01.1.454.CMB.1.raw
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagacgggccaccctcaactgcaagtccagccagacgtcttacctacgacttcgacaataagtcctacttagcttggtatcagcaacgaaacccggacacgcctacctaagctcgctctatttactgtcttccgtacccgggatcccggggtccctgaccgtattcactggcacggcgggtctggacagtacttcactctacacatcagcacgtcgttacagtactagaagtagtgtcgtccgttcttactttcgtgtcacgtctaattattaccttctttacgtttttttccgtcccgtttccggtcccgttacgggtaaccctaaagttacctaaagttaaccttaaccgtaaaacgttacttacggtacggtaccgtcgtaccctaacctacttccgttcgttaccc

SEQ ID NO: 108426 - DNA, 757 bp, Homo sapiens
  misc_feature: GYAE6OF01AR71U.42.23.C01.1.454.CMB.1.raw
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatcgacccagtctccagacctccctggctgtgtcgtggtgggcgaggacgggcccaccctcaactgacaacgtccacgccagacgtccttacctacgacttcgaacaataacgtcctacttagtcttggtactcagaccacgaaacccggacacgcctacctaagctcgtcctctactttacgtcggttccttaccgtaccccgggaacgtccccggggtccctacggaccgtacttccgacgtcggacgtacgggtccgggtcgtacggggaacctacggtaccctttacgaaccttcctacccaaccgtactccgtacggaccgtacggttccgttaaccgaacgtaaccgtaggaaacgtcgttacgggtacgggtccccgtttactttacgtttccgtcggtacacgtaaccttaaatttacttttaaccgtttaccttttacggtttttttaccctcccgtttacccggttaccccggttaacgggtaaacccttaaaacgttaccgtaaacgttaacgtaacccgtaaaccggtaaccgtttgggtacggtaccgttaccggaccttaacccgtacgttccttacggttaccccg

SEQ ID NO: 108427 - DNA, 655 bp, Homo sapiens
  misc_feature: GYAE6OF01CSO76.42.23.C01.1.454.CMB.1.raw
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactcctggctgtgtctgtgggcgagagggcccaccctcaactgcaagtccagccagacgtcttacctacgacttcgaacaataacgtcctacttagtcttggtatcacgcaacgaaacccggacacgtcctacctaacgcctagcctctacttttactcggttccttaccgtacccgggtaacgttccccggggtccctacggaccgtacttccgaacgttcgggcctacgggccgggttcgtagggaacacgtacttccacctcctaccacctactcgacgcctacgtccgttacaacgtacgtagaagtagtcggtcggtccgttacttacgtttcgtcgtcacgtactaacttactttacttcgtttacgttttttctcccgtttccggtacccgttacgggtaacctaaacgttacctaaacgttaactacgtaaaaccgtacgttcgtacggtctacgactactacttcgtcgttacc

SEQ ID NO: 108428 - DNA, 608 bp, Homo sapiens
  misc_feature: GYAE6OF01BAXZZ.42.23.C01.1.454.CMB.1.raw
  modified_base (209)..(209): a, c, t, g, unknown or other
  misc_feature (209)..(209): n is a, c, g, or t
  modified_base (316)..(316): a, c, t, g, unknown or other
  misc_feature (316)..(316): n is a, c, g, or t
  modified_base (343)..(343): a, c, t, g, unknown or other
  misc_feature (343)..(343): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcagagggccaccctnaactgccaagtccaagccagacgtcttaacctacgacttcgaacaatagtcctacttagcttggtatcagtacagaaaccggcagcctcctaagctgctcatttacnggtcttcgtacccggatccggggtccncgtaccgattcgacgtggacaggtcgggtctggggactagacttcgactctacgaacctatacgacgcaacgtcgttacagtaactacgaagtatcggtggtcccgtcttactttctgtaccgagtaccaattacgttacttacgttagttttttcctacctttccgggtacccttgggtaacctaaacggttactaaacgtactaccgtaaaacgtaacgttacgtacggtacctacgactaaccctagttacttcggttaccc

SEQ ID NO: 108429 - DNA, 594 bp, Homo sapiens
  misc_feature: GYAE6OF01AGNTI.42.23.C01.1.454.CMB.1.raw
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagagggccaccctcaactgcaagtccagccagagtcttacctacgacttcgacaataagtcctacttagcttggtatcagcagaaacccgacagcctccaagctgctcatttactgtcttctacccgggaatccggggtcctgaccgtattccactggcgagcgggtctgggacagacttcactctcaccatccagcacgtcgtcagactagaagagtggtcggccgttcttatttctgtacacgctaattacttacttactttacgtttttttccttacccgtttcccgggtccccgttagggtaccctaaaacgttaccaaacgtttaactaaccgaaaacggttaacgttaggttacggtacgttacggacctaacctacttcgttcgtttaccc

SEQ ID NO: 108430 - DNA, 703 bp, Homo sapiens
  misc_feature: GYAE6OF01BRM8B.42.23.C01.1.454.CMB.1.raw
  modified_base (214)..(214): a, c, t, g, unknown or other
  misc_feature (214)..(214): n is a, c, g, or t
  modified_base (313)..(313): a, c, t, g, unknown or other
  misc_feature (313)..(313): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgccgtccggggacatcgtgatgacccagtctccagactccctggctgtgtctggtgggcgaggacggcccaccctnaactgcaagtccagccagacgtccttaccacgacttcgaactaataacgtcctacttagcttggtatcagcaacggaaaccccgacacgcctaccgaanctgctcatttactggtccttaccgtaccgggaacgttcccggggtccctagaccgtacttccgacgttcgggaccgtaggtcccggggttcgtacggggaacctacggtaacctttccgaccttcccttaccgaaccctacttaccgacggtacgtaccggttaccgttaccgaaaggtacctaacggtaaaggtagttcgggtccgggttaccccgtttctttacgttttaccgtagtccgaagtacttaaacgtttaccttttacgttccgtttttaacgtttttttcccgtaccccgtttcccggtacccgtacgggtaacctaaacgtactaagttaccacgtaaacgtacgtcggtgtaccgtcacctacctacttctcgttacc

SEQ ID NO: 108431 - DNA, 615 bp, Homo sapiens
  misc_feature: GYAE6OF01DSORC.42.23.C01.1.454.CMB.1.raw
  modified_base (439)..(439): a, c, t, g, unknown or other
  misc_feature (439)..(439): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagacgggccaccctcaactgcaagtccagccagacgtcttacctacgacttcgaacaataagtcctacttagcttggtatcagcaagaaacccggcagcctcctaagctgctcatttactgtcttctacccgggaatccggggtccctgaccgtattcacgtgcaggtcggtctggacagacttcactctacacatcagcagcgttcagactagaagtatggtcggcccgttcttacttttcngttcacggtactaagttactttaacgttctttaagtttttttcctcccgtttccgggtcccgttacggggtaacctaaacggttacctaaattaacgtaaccctaaaacggttaaaccgttagggttaccggtaccttacggtaaccctacccgttacttccgtttcggtttaccc

SEQ ID NO: 108432 - DNA, 723 bp, Homo sapiens
  misc_feature: GYAE6OF01C96BA.42.23.C01.1.454.CMB.1.raw
  modified_base (493)..(493): a, c, t, g, unknown or other
  misc_feature (493)..(493): n is a, c, g, or t
  modified_base (706)..(706): a, c, t, g, unknown or other
  misc_feature (706)..(706): n is a, c, g, or t
tcagtgacgtatgtcacgaccggtgctcgatttagtacacgtgattagggattgggggagctacaacagggcaggcaggggcagcaagatggtgttgcagacccaggtcttcatttctctgttcgctctggatctcgtggtcgccgtcgggacacgtcgtgatcgacctagtcctccacgtcctccgtggtcttggttgtcgtggtcgggcggaggacggcccacctacaacgtgactaacgtccacgaccaggtacttaccttaccgtacgtaccttacgaactaaagtacgttaccttaacgttagtcctttagggtaactacaacggacgaaaccggtaacccgacgtacgtacccttacctacggtctacgacttacttacgttttacgtcgttaccgtttaccggaaccgggtacggttccccggtactacgacctctacgacgtcgacgtacggcggtacgacgactacgtactcctctcacacctncacgtcgcgtactagacgtaataggactacgtcggtaccgtcttatttcttcgactaccgtataaccttatttaacctttcgtttacgtttttccgttttccgttacccggttccggttaaccgtaaccgggtaaactttaaacggtccttaaaacgttccgtaaacgtaaacggttcgggttaccgtaggtacgtacccttacgtacccgtnttttccgttccgttaac

SEQ ID NO: 108433 - DNA, 821 bp, Homo sapiens
  misc_feature: GYAE6OF01A8NUK.42.23.C01.1.454.CMB.1.raw
tcagtgacgtatgtcacgaccggtgctcgatttagtacacgtgattagggagttgggggagctacaacaggcaggcaggggcagcaagatggtgttgcagacccaggtcttcatttctctgttgctctggatctctggtgccgtccggggacatcgtgatcgacccagtctccagacctcccgtggctgtgtcgtggtgggcgaggacgggcccaccctacaactgccaagtccaagccagtacgttccttaccgtacgtaccttacgaactaagttaaccgtcccttaacttaggtcttgggtaactaccgaagtaccaaacgggtaaaccccggacaccgtcctacctaacggcctcggtaccttctaacgttttaccgtgggttccttacccggtaaccccggggtacgttccccggggttaccctacggacccggtatttcccgacgttgggaccgtacgggtcccggggttcgtacgggggtaacctaaacgggttccctttacccgaacccgtttacctacccgtaaaccctacgttccgtaacggtacccgtaacgggttcccgttaacggaaaccgtaaccgggtaacggtaaacgggtacgttaccgggttccggttacccggtttacctttaacgttttccgtaccggtactacgtaacttaaagttcctttaaccgtttaccgttttaccgttttttacccgtcccgtttccgggtacccgttaaccgggtaacctaaaggtcctaaagtacctaaccgaaacggttacgtcggtacggtctacgacctactaacttccggtcttacccg

SEQ ID NO: 108434 - DNA, 805 bp, Homo sapiens
  misc_feature: GYAE6OF01B1RNH.42.23.C01.1.454.CMB.1.raw
  modified_base (135)..(135): a, c, t, g, unknown or other
  misc_feature (135)..(135): n is a, c, g, or t
  modified_base (183)..(183): a, c, t, g, unknown or other
  misc_feature (183)..(183): n is a, c, g, or t
tcagtgacgtatgtcacgaccggtgctcgatttagtacacgtgattagggattgggggagctacaacaggcaggcaggggcagcaagatggtacgttgcagacccaggtcttcatttctctgttgctctggatcnctggtcgccgtccgggacagtcgtagatcgaccagtctcagacctccnggctgtcgtctggtgggcaggccggccacccttagaactgacgaacgtcacgcagtactacgttaccagtactacgaataacgtaacggtacccttaagtacgtcgttaggtaactacgaacgacgtaaccgaaaacccggtaccaaacggtacccttaaccgtaaacgtcgtacggtacccttacgtttaacgttttaacgccggttacctaaccgggtacccgggtaaacgttcccggggtttaccacggtaaccgacgtttacgaccggtttaggacgttaacggccggttaacgacggtacgtaacggtactctaaaccgttccaataacccgacgttaacgaacgagtaacccggttagtacgttaaacgaacggttaaacggaacgtaacggttccgtacggtaccccgtttaacgttaacggttttccgcggtttaaacctacggtaactaacgtttaacgtttacctttaaaccgtttccgttttacccgttaaccgtttaccggtacccgtaagggttaaacctaaccggtaaactaaacggtaaccttaaccgaaacgttacggaaccgttacgacgttacctacccgtaatacccgttactggtttaaccc

SEQ ID NO: 108435 - DNA, 785 bp, Homo sapiens
  misc_feature: GYAE6OF01BY3KM.42.23.C01.1.454.CMB.1.raw
  modified_base (174)..(174): a, c, t, g, unknown or other
  misc_feature (174)..(174): n is a, c, g, or t
  modified_base (325)..(325): a, c, t, g, unknown or other
  misc_feature (325)..(325): n is a, c, g, or t
tcagtgacgtatgtcacgaccggtgctcgatttagtacacgtgattaggggattggggggagctacaacaggcaggcagggggcagcaagatggtgttgcagacccaggtcttcatttctctgttgctctggatctctggtcgccgtccggggacatcgtgatcgacccagtcnccacgctcccgtggtctggttcgtcgtggtgggcgacggacgggacccacccgtacaactcgacgaacgtccacgaccgagtacttaccttaaccgtacgtacttacgaacaaattacgtacccttaacttacggtcttaggtactcgtanacgaaaccggaacccgacacgtaccctaccgtaagcctcgacttcgtactttcgtcgttaccgttccggttaacccgggtacggttccccgggtacctacgtaccgtctcgacgtcggcgacggtcggtacgggtacggacgtacgtactcctaccgtactaccgacctagtaccgacgcgtaacgttcgtacgtaacgtacgtaggaagttacgtcgggtccggtacgttaccgtttacgtttcgttcgtaacgtacgtaacttaacgtttactttaccggtttttacttttaccgttttttcccgttacccgtttacccgggtaccgtaaccggttaaacccgttaaacggttaaccttaaaccgttaacgttaaacccgttaaacggtaacggtttacggtacggttaaccgttcccgtaacccttaccttccgtttaacgttccgttttaaacccg

SEQ ID NO: 108436 - DNA, 791 bp, Homo sapiens
  misc_feature: GYAE6OF01DMP0E.42.23.C01.1.454.CMB.1.raw
  modified_base (144)..(144): a, c, t, g, unknown or other
  misc_feature (144)..(144): n is a, c, g, or t
tcagtgacgtatgtcacgaccggtgctcgatttagtacacgtgattagggagttgggggagctacaacaggcaggcaggggcagcaagatggtgttgcagacccaggtcttcatttctcgtgttcgctctggatctcgtggtcnccgtacgggactatcgtgatcgaccctagtcctccacgacctccgtggcttggtgtcgtgggtcgggacgacggacgggtcccctacctacgacgtcggacctaacggtcccgagtacccgtaaggtcgttaccgttaccgtaaccgttaccgtttacgaaactaaacgttaccgttccttaacgtacggtctttagggtaacttccgaaggtaaccgaaaccggaaaacccggcctaacgtcccgtacctagtccgtacgtccgtaacttactttacggtcgttaaccgtccggtaaaccccggtggtaccccgggtcctacggtacctcgttacgaccggtcggtcgtaccgggtcggttacggacggtactcgttaaccttccaactcctacggaacctatccgaagtcgtaacgttcgtacgtacgtaagacggattagtcggtacgttccttacgtttaacgttcgtacgtataccgtaagtttaaccttcggtttactttacgtttttaccttttcccgttaccccgggtacggttaccgtaacgggtaaccgtaaaccgttataaccgtttaccaaacgggttacctacggttccgggtccttaccggtcacccgttaactccgttacgtttcgtaaccc

SEQ ID NO: 108437 - DNA, 504 bp, Homo sapiens
  misc_feature: GYAE6OF02HATOU.42.23.C01.1.454.CMB.1.raw
  modified_base (452)..(452): a, c, t, g, unknown or other
  misc_feature (452)..(452): n is a, c, g, or t
  modified_base (477)..(477): a, c, t, g, unknown or other
  misc_feature (477)..(477): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagagggccaccctcaactgcaagtccagccagagtcttacctacgacttcgacaataagtcctacttagcttggtatcagcagaaacccggacagcctcctaagctgctcatttactggtcttctacccgggaatccggggtccctgaccgattcactggcagcggtctgggacagacttcactctcaccatcagcagcgttcagactgaagatgtgccgtctatttctgtcagcaatattactctagttttttcnctttcgccctgggacctagtcaatntcaaacgactgtgctgcaccatctgtc

SEQ ID NO: 108438 - DNA, 512 bp, Homo sapiens
  misc_feature: GYAE6OF02FH70E.42.23.C01.1.454.CMB.1.raw
  modified_base (457)..(457): a, c, t, g, unknown or other
  misc_feature (457)..(457): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagagggccaccctcaactgcaagtccagccagagtcttacctacgacttcgacaataagtcctacttagcttggtatcagcagaaaccccggacagcctcctaagctgctcatttactggtcttctacccgggaatccgggggtccctgaccgattcactggcagcgggtctgggacagacttcactctcaccatcagcagcgttcagactgaagatgtggccgtctatttctgtcagcaatattactctagtttttttcnccttcggccctgggaccaagtcaatatcaaacgaactgtggctgcaccatctgtc

SEQ ID NO: 108439 - DNA, 533 bp, Homo sapiens
  misc_feature: GYAE6OF02IJC82.42.23.C01.1.454.CMB.1.raw
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagagggccaccctcaactgcaagtccagccagagtcttaccacgacttcgacaataagtcctacttagcttggtatcagcagaaacccggacagcctccaagctgctcatttactggtcttctaccgggaatccggggtccctgaccgattcactggcagcggtctgggacagacttcactctcaccatcagcagcgttcagactgaagatgtggccgttctatttctttcagtcaattattacttcttagtttttttcctacctttcggtcccttagggtacctaaagttctaatactctaaacgactgtcggtctgacacctatcttgtcttacc

SEQ ID NO: 108440 - DNA, 555 bp, Homo sapiens
  misc_feature: GYAE6OF02H0CML.42.23.C01.1.454.CMB.1.raw
  modified_base (199)..(199): a, c, t, g, unknown or other
  misc_feature (199)..(199): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagngggccaccctcaactgcaagtccagccagagtcttacctacgacttcgacaataagtcctacttagcttggtatcagcagaaacccggacagcctctaagctgctcatttactggtcttctacccgggatccggggtccctgaccgattcactggcagcgggtctgggacagacttcactctcaccatcagcagcgttcagactgaagatgtggccgtcttatttctgtcagctaattacttactcttagttttttcctccgtttcggcccttagggtaaccctaaggttccaaagttaactacctaaaacgtaacttcgtacggtctacggtacccaacctacttcctacgttcc

SEQ ID NO: 108441 - DNA, 523 bp, Homo sapiens
  misc_feature: GYAE6OF02F72OD.42.23.C01.1.454.CMB.1.raw
  modified_base (371)..(371): a, c, t, g, unknown or other
  misc_feature (371)..(371): n is a, c, g, or t
  modified_base (409)..(409): a, c, t, g, unknown or other
  misc_feature (409)..(409): n is a, c, g, or t
  modified_base (459)..(459): a, c, t, g, unknown or other
  misc_feature (459)..(459): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagagggccaccctcaactgcaagtccagccagagtcttacctacgacttcgacaataagtcctacttagcttggtatcagcagaaacccggacagcctcctaagctgctcatttactggtcttctacccgggaatccggggtccctgaccgattcactggcagcggtctgggacngacttcactctcaccatcagcagcgttcagactgaagntggtgccgtcttatttctgtcagcaatactttactcttagtttttttccncctttcggtcccttgggacctaagtcaatactacaaacgtactgtgctgcctacattctgttcc

SEQ ID NO: 108442 - DNA, 514 bp, Homo sapiens
  misc_feature: GYAE6OF02FKZKE.42.23.C01.1.454.CMB.1.raw
  modified_base (454)..(454): a, c, t, g, unknown or other
  misc_feature (454)..(454): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagagggccaccctcaactgcaagtccagccagagtcttacctacgacttcgacaataagtcctacttagcttggtatcagcagaaacccggacagcctcctaagctgctcatttactggtcttctacccgggaatccgggggtcctgaccgattcactggcagcgggtctgggacagacttcactctcaccatcagcagcgttcagactgaagatgtggccgtctatttctgtcagcaatattactctagttttttcnccttcgccctgggacctaagtcaatatacaaacgtaactgtagctgccaccatctgttcc

SEQ ID NO: 108443 - DNA, 503 bp, Homo sapiens
  misc_feature: GYAE6OF02INGMK.42.23.C01.1.454.CMB.1.raw
  modified_base (475)..(475): a, c, t, g, unknown or other
  misc_feature (475)..(475): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagagggccaccctcaactgcaagtccagccagagtcttacctacgacttcgacaataagtcctacttagcttggtatcagcagaaacccggacagcctcctaagctgctcatttactggtcttctaccgggaatccggggtccctgaccgattcactggcagcggtctgggacagacttcactctcaccatcagcagcgttcagactgaagatgtggccgtctatttctgtcagcaatattactcttagtttttctcttcgcctggacctaagtcaatntacaacgtactgtgctgcaccatctgtc

SEQ ID NO: 108444 - DNA, 516 bp, Homo sapiens
  misc_feature: GYAE6OF02G9KYX.42.23.C01.1.454.CMB.1.raw
  modified_base (317)..(317): a, c, t, g, unknown or other
  misc_feature (317)..(317): n is a, c, g, or t
  modified_base (384)..(384): a, c, t, g, unknown or other
  misc_feature (384)..(384): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagacctccctggctgtgtctgtgggcgagagggccaccctcaactgcaagtccagccagacgtccttaccgtacgacttcgaacaataacgtcctacttagcttgtatcagcagaaacccgacagcctcctaagctgctcatttacnggtcttctaccgggatccggggtcctgaccgattcactggcaggcggtctgggacagacttcactcncaccatcacgcgagcgtacagtactagaagagtgtgccgttcttacttctcgtcagtactaacttacttacttcttacgtttttccgttccgttccggtcccgttacggtaccgtaacgtactaacgttaac

SEQ ID NO: 108445 - DNA, 773 bp, Homo sapiens
  misc_feature: GYAE6OF02J26JM.42.23.C01.1.454.CMB.1.raw
  modified_base (733)..(733): a, c, t, g, unknown or other
  misc_feature (733)..(733): n is a, c, g, or t
  modified_base (748)..(748): a, c, t, g, unknown or other
  misc_feature (748)..(748): n is a, c, g, or t
tcagtgacgtatgtcacgaccggtgctcgatttagtacacgtgattagggattgggggagctacaacaggcaggcaggggcagcaagatggtgtgcagacccaggtcttcatttctctgttcgctctggactcgtcgtggtcgccgtccgggatagtcgtagactccgacctgtcctccgacgtcctcccgtggcttggtgttcgtgggtcgggcgacggaccggaccctacctacgaactcggaccaacggtccacgaccgtagtaccgttacctaccgtaaccgtacttacgaactaacgttaccgtactaacttcgtctaggtacacgaacgtaccgaaccgaaccgctaccgtacctacgtaacgtcttacgtaccttacgttaccgtttacggtccgggtttaccgtaacccgggtaaccccgggtacggtttccccgggtacctaaggtaacccgttaacgtccggtaaccggtcggaccggttaacgggtccggggttactaacgggtacccttacggtacccttacgtaccgaccttacgaccgtacgtacgacgtaccggtacgtaacgttacgaacgttacggtaaacgtacgttacggtcgttccgtacgtttacgttacgttcgtacggtactaacgtactttaacgtttcctaccgtttactttccgttttacccgaccgtcgtaccgtaagaccttagacttacgaacgtaacacggtntcgtccgtagtaccnccgttactacggttctacgttaccc

SEQ ID NO: 108446 - DNA, 554 bp, Homo sapiens
  misc_feature: GYAE6OF02HXZZP.42.23.C01.1.454.CMB.1.raw
  modified_base (550)..(550): a, c, t, g, unknown or other
  misc_feature (550)..(550): n is a, c, g, or t
tcagtgacgtatgtcacgaccggtgctcgatttagtacacgtgattagggattgggggagctacaacaggcaggcaggggcagcaagatggtgttgcagacccaggtcttcattttctctgttgctctggatctctggtgcctccggggacatcgtgatgacccagtctccagactccctggctgtgtctgtgggcgagagggccaccctcaactgcaagtccagccagacgtcttacctacgacttcgacaataagtcctacttagcttgtatcagcaagaaacccggacacgccctacctaagctgctcatttacctggtccttcgtacccgggaatcccggggtccctgaccgtattcactgcagcggtctggacagcttcactctcaccatcagcacgcgttcagtacagaagatgtggccgttctatttctgttacagtactaattacgtttacttctttacgttttttcttccgtttccggtacctcgggtaacctaagttactaactactaaccaaacgtactgtagctacgaccactctctnttcc

SEQ ID NO: 108447 - DNA, 634 bp, Homo sapiens
  misc_feature: GYAE6OF02HMZZ3.42.23.C01.1.454.CMB.1.raw
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactcctggctgtgtctgtgggcgagaggccacctcaactgcaagtccagccagacgtctacctacgacttcgacaataagtcctacttagcttggtatcagcacgaaaccgacacgcctaccgtaagctgactctatttactcggttccttacgtaacccgggaacgttcccgggggtccctcggtaacccgtacttccgacgtcgggaccagggtccgggttacgtacggggactacggtactttccgacctcctaccacctactccgagacacgtcgttacaagactaggaagtagtggtcggtccgttcttatttctcgtacacgtctaacttactttactctttagtttttttccgcccgttttcggcccgttacgggtaccctaagttactaaacgttactaaccgtaaacgtacttacggttcgacgttcgacctaactacgttacctgtttaacc

SEQ ID NO: 108448 - DNA, 635 bp, Homo sapiens
  misc_feature: GYAE6OF02FT8C9.42.23.C01.1.454.CMB.1.raw
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagagggccaccctcaactgcaagtccagccagagtccttacctacgacttcgacaataagtcctacttagcttggtatcagcagaaacccggacagccctcctaagctgctcatttactggtcttccgtacccgggatcccggggtccctgaccgtattcactggcaggcgggtctgggacagacttcactctcacctatcagcagtcgttacagtactagaagagtggtcggtaccgttctttaactttccgttcgtctacggtactaagttacttttaccttacgttttacgtttttttttcctacccgttttacccgggtccccgttagggtaacccttaacggttacctaaacgtttaactaacccgtaaaaccgtaaccgttcggttacggtaccgttacggacctaacccgtactttacccgtagtttacccg

SEQ ID NO: 108449 - DNA, 579 bp, Homo sapiens
  misc_feature: GYAE6OF02JCLDY.42.23.C01.1.454.CMB.1.raw
  modified_base (298)..(298): a, c, t, g, unknown or other
  misc_feature (298)..(298): n is a, c, g, or t
  modified_base (333)..(333): a, c, t, g, unknown or other
  misc_feature (333)..(333): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (437)..(437): a, c, t, g, unknown or other
  misc_feature (437)..(437): n is a, c, g, or t
  modified_base (475)..(475): a, c, t, g, unknown or other
  misc_feature (475)..(475): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccgggacatcgtgatgacccagtctccagacctccctggctgtgtctgtgggcgagagggccacctcaactgcaagtccagccagagtccttacctacgacttcgacaataagtcctactagcttggtatcagcagaaccagacagcctctaagcngctcattactggtcttcaccggaatccggggtccngaccgtattcactcgcagcggtacngggacncggtacgttccacgtcctacacccgatccgagcgagtccgtcagcctagagatgacggtccgtctagtttccngtcagacctaagtacttacgtactttacgttttttacncccgtttcggtacccgttaggtacctaaacgtctaaacgttaaccgtactaaaccgtacttacggtccgtaccgttcgacccgtaacccttacgttccgttacg

SEQ ID NO: 108450 - DNA, 584 bp, Homo sapiens
  misc_feature: GYAE6OF02GEKF0.42.23.C01.1.454.CMB.1.raw
  modified_base (389)..(389): a, c, t, g, unknown or other
  misc_feature (389)..(389): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagacgggccaccctcaactgcaagtccagccagagtcttaccacgacttcgacaatacgtcctacttagcttggtactcagcaacgaaacccggacacgcctcctaagctcgctactatttactcggtcttccgtaacccgggaattcccggggtcctgaccgtacttcgacgtggcaggcgggtctgggacngtacttcactctacacatacacgcacgtcgttcagactagaagagttcggtcgtccgttacttacgttctgtacagtactaacttacttacttcgtttacgttttttcctcccgttccggtccgtacggtaacctaacgtactaagtactaactaaaccgtacgtacggtgctacgacctactcttcgtcttacc

SEQ ID NO: 108451 - DNA, 582 bp, Homo sapiens
  misc_feature: GYAE6OF02FXY9C.42.23.C01.1.454.CMB.1.raw
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctggtgggcgagagggccaccctcaactgcaagtccagccagagtccttacctacgacttcgacaataagtcctacttagcttggtatcagcagaacccggacagcctacctaagctgctcatttctgtcttcaccgggatccggggtcctgaccgtatcactggcaggcgggtctgggacagcttcacttcctcacctatacagccagtcgtcagtactaggaagtgtggtcggtccgttacttactttcgtcgtcacgtactaaattactttaccttctttacgtttttttcctccgtttccggtaccgtacgggtaacctaacgtactaacgtaactaaccgtaacgtaacgttggttacgacgttcgaccgtactacttcgttcgttaccc

SEQ ID NO: 108452 - DNA, 587 bp, Homo sapiens
  misc_feature: GYAE6OF02FQV34.42.23.C01.1.454.CMB.1.raw
  modified_base (230)..(230): a, c, t, g, unknown or other
  misc_feature (230)..(230): n is a, c, g, or t
  modified_base (377)..(377): a, c, t, g, unknown or other
  misc_feature (377)..(377): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagactccctggctgtgtctgtgggcgagacgggccaccctcaactgcaagtccagccagngtcttacctacgacttcgacaataagtcctacttagcttggtatcagcagaaaccccggacagcctcctaagctgctcatttactggtcttcgtacccgggaatcccggggtccctgaccgtattcactggcaggcggtctgggacngacttcactctcaccatcagcagcgttcagactagaagatggtcggccgttcttatttcgtcgtcagtacaagttacttacttacttacgtttttttcctccgtttccggtcccgttacgggtaacccttaacgtacctaaacgttaactaccgtaaaaccgtaacgttcgttacgggtctcgaccgtacctacgttccttggtttaccc

SEQ ID NO: 108453 - DNA, 574 bp, Homo sapiens
  misc_feature: GYAE6OF02GLUVU.42.23.C01.1.454.CMB.1.raw
  modified_base (300)..(300): a, c, t, g, unknown or other
  misc_feature (300)..(300): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (571)..(571): a, c, t, g, unknown or other
  misc_feature (571)..(571): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccggggacatcgtgatgacccagtctccagacctccctggctgtgtctggtgggcgagacgggccaccctcaactgccaagtccagccagacgtccttacctacgacttcgaacaataacgtcctacttagcttggtatcagcaacgaaaccccgganacgccctccaagctgctctattctgtcttcgtacccgggatcccggggtcctgaccgattcgacgtggcctaggcggtcgcgggacacgtcttcactctcacancgacnctacgtccgttcacgtacgtagaagtagtggtcgtccgttcttacgttcgtcgtcagtactaattactacttctttacgttttttcctccctttcggcccgtacggtaacctagtactaagtaactactaaacgtactgtacgtctacgaccactactcttntac

SEQ ID NO: 108454 - DNA, 144 bp, Homo sapiens
  misc_feature: GYAE6OF02HBE7I.42.23.C01.1.454.CMB.1.raw
  modified_base (109)..(112): a, c, t, g, unknown or other
  misc_feature (109)..(112): n is a, c, g, or t
  modified_base (114)..(144): a, c, t, g, unknown or other
  misc_feature (114)..(144): n is a, c, g, or t
tcagtgacgtatgtcacgaccggtgctcgatttagtacacgtgattagggattgggtgggagtacgggtacgcgactcgtactgaggcgggctggcaaggcgcatagcnnnncnnnnnnnnnnnnnnnnnnnnnnnnnnnnnnn

SEQ ID NO: 108455 - DNA, 744 bp, Homo sapiens
  misc_feature: GYAE6OF02HJQ5D.42.23.C01.1.454.CMB.1.raw
  modified_base (211)..(211): a, c, t, g, unknown or other
  misc_feature (211)..(211): n is a, c, g, or t
  modified_base (264)..(264): a, c, t, g, unknown or other
  misc_feature (264)..(264): n is a, c, g, or t
  modified_base (290)..(290): a, c, t, g, unknown or other
  misc_feature (290)..(290): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggtatctctggtgccgtccggggacatcgtgatgacccagtctaccagactccctggctgtgtctgtggcgagaggccaccctnaactgacaagtccagccagcgtctacctagacttcgacaataacgtctactancttagtatcagacacgaaacccgganacgacctccgtaagctacgactaccattttaccgtggttcttaccgtaacccgggtaacgttcccggggtccctagtaacccggtcttcgaccgtgggcctagggtccggtcgttacgggactagtaccgttacaccttcctacgaaccctacgtaccgacgtacgtacggtccgtttacgaacgtacgttacggaaacgtacgttacgggtaccggtccgtttacgttacgttttacttcgggttacctaacggtaccgttaaacgttttaactttaacccgttttacgtttttaaacgttttttttcccgtttaccccggttttacccgggtttaccccgttaaccggggttaaaccctaaacgggtttaccttaaacggtttaacctaacgttaaaaccgtaacgttacgggtcgtactacgtacctaacccgttattccgttagtttacc

SEQ ID NO: 108456 - DNA, 606 bp, Homo sapiens
  misc_feature: GYAE6OF02I4WI1.42.23.C01.1.454.CMB.1.raw
  modified_base (287)..(287): a, c, t, g, unknown or other
  misc_feature (287)..(287): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctcggggacatcgtgatgacccagtctccagactccctggctgtgtctgtgggcgagcgggccacccgtcaactgcaagtccagccagacgtccttaccacgacttcgaacaatagtcctattgcttggatcagacacgaaacccgnacgcctaccaagctgcctctatttactcggtacttaccgacccgggattcccggggtccctagaccgtattccgactcggctacggcgggtcacgggacaggtacctcactcgtcacatcgancagtctnagactagaagtacgtcggttacgtcgttacgttactttccgtgtaccagtactaattatttaccttacgttttacgtttttttcctccgtttccggttaccgtaacgtacctaagttactaacgttaactaaccgtaaacgtaacgttcggtacgtcgttaccgtaccgtaactacttcgtacttaccg

SEQ ID NO: 108457 - DNA, 759 bp, Homo sapiens
  misc_feature: GYAE6OF02GLC19.42.23.C01.1.454.CMB.1.raw
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgccctcggggacatcgtgatgacccagtctccagactccctggctgtgtctgtggcgagaggccaccctcaactgcaagtccagccagacgtcttacctacgacttcgaactaataacgtcctacttagtcttggtactcagacaacgaaacccgacacgccctaccgtaagctgcctactactttactcggtctttaccgtaccccgggtaagttccccgggggttccctacggacccgtacgttacctacggttcggcgacgggtcccggggttcgttacggggaaccgtaacggacctttaccgtaaccctttcctacccgtaacccgtaaccttaccaaccggtaccgtaacggtaccgtttaccgaaacggtaaccgttaggaaacggttagttcgggttaccggtccgttttacctttatttccgttaggtaccgtagtaacctaactttaacgtttacctttacgtttttacgtttttttacccttacccggttttaccggtacccggtttaacggaacccgttaagttacctaaacgttaaacgtaaccgtaaaaccgttaacgttcggttacgtcctaacggtacctaacctacgtttccgtacgtttaccc

SEQ ID NO: 108458 - DNA, 825 bp, Homo sapiens
  misc_feature: GYAE6OF02JIEY7.42.23.C01.1.454.CMB.1.raw
  modified_base (779)..(779): a, c, t, g, unknown or other
  misc_feature (779)..(779): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgttgctctggatctctggtcgccgtcgggactagtcgtgatcgaccctagtctaccgacgtacctcccgtggtcctggtcgttcgtggtcgggcgtaaggaccggcccaccgtcaacgtcgactaacggtccacgaccaagtacgtaccttaacccgtacgtacttaccggaactaactacgttacctaccgttagcgttaggtaactacgtagaaccgaacggaacccgagtaccgtacctaccgtaacgctacgtactaccgttagtttaccgtcggttaccttacccgtaacccgggtaaccgttcccggggtacctacggccgttaactccgcgtacggcgtaacggtcggttcggacggtactaacgttactaccgtacgttcctaaccgtacctaacgttcggtacgtaccgtaccggttacgttaaccgaaacggtttacgaacggtaacgtacggttccggttaacggtcccgtttacgtttactttaccgggttacaccggtttaactaaccgtttaaccttttaccgttttacgttttttacggttttcccgtaccggtttcccggtaaccgttaaccggttaaccgtaaccgtttacttaaaccgtaccggttaaaccgttaaaacgttccggttaggacccggtttanaacccccggttataccgtttacccgtagtttaacccttcttaaccc

SEQ ID NO: 108459 - DNA, 880 bp, Homo sapiens
  misc_feature: GYAE6OF02FTZCH.42.23.C01.1.454.CMB.1.raw
tcagtgacgtatgtcacgaccggtgctcgatttagtacacgtgattagggattgggggagctacaacaggcaggcaggggcagcaagatggtgttgcagacccaggtcttcatttctctgttgctctggatctcgtggtcgccctaccgggggacagtcggtgatcgaccctagtcctccagcctcccgtggctggtgtcgtggtgggcgaggacgggccaccctcaacgtcgacaacgtccacgccaaggtacttccttacctacgacttacgaacaaataactacctacttacgtcgttaggtatcacgcgaaacggaaaccccggtacacgtccccgtaccgtaacggtccttcggaccttactaatttttaccggtcggttacctttacccggtaaccccggggtaacgttcccccggggggttcccttaccggaacccgtacttaccgtaccggtacgggtaccgtaccggggtccgggttaccggtacgggtaaccgtaaggtaccctttacggtaccttacccgtccctaacccgactaccgtaacgaccggtacgtacccggttaccgaacgtaaccggttaggtaaacggtcggtttacgggaccgggttacccgtttacttaaccggtttttcgtaccggttacccgtaagtaccttaaaagtttaccgttttaaccgtttaacgtttttttaacccgtttttttcccgttacccgttttacccgggttcccggttaaaccggggtaaacccctttaaggttaaccaaccgttttaaccgtaaacccgtaaaacgttaaccggtttaccgggtacggtacccggtttcaaacccggtttaacccgtcttacccgtttacggttttaaccc

SEQ ID NO: 108460 - DNA, 810 bp, Homo sapiens
  misc_feature: GYAE6OF02GGRB6.42.23.C01.1.454.CMB.1.raw
tcagtgacgtatgtcacgaccggtgctcgatttagtacacgtgattagggattgggggagctacaacaggcaggcaggggcagcaagatggtgttgcagacccaggtcttcatttctctgttgctctggatctctggtgcctccgggacatcgtgatcgacccagtcctccgagactcccgtggctgtgtcgtggtgggcgtaggacgggccctacccgtcgtaaccgtgaccgtaaacgtccgacgaccaacggtacgttaccttaacccgttaaccgtacgtttacccggaaacttaaacgttaaaccggttccccttaaacgtttaacggtccgttttagggttaactaccgtacggacgtaaaacccggaaaacccccgggtaactacggtaccccgttaaccgtaaaggtccttacggacccttacgttaacttttaccgttacggtttaccctttacccggtaaaccccggggttaacgttcccccgggggttaccccttacggaacccggttacttaccgtaacggtcgggtaccgagggtccgggtaccgttaggggaacctacggttaccttacgaccttactacccgactacgtcacgacgtacgtcgtacgacgtacgtagaacgtggttacgtacgggtccttacgttacttcgtctacgagaccttaattacgttactttacgtttacgttttactcccgttacggtccgtacggtacctacgtactaacgtaactaaccgtaaacgtacgttggtacgtacgtaccggtacctaccgtacgttccgtagttacccg

SEQ ID NO: 108461 - DNA, 776 bp, Homo sapiens
  misc_feature: GYAE6OF02JI8L5.42.23.C01.1.454.CMB.1.raw
  modified_base (459)..(459): a, c, t, g, unknown or other
  misc_feature (459)..(459): n is a, c, g, or t
tcagtgacgtatgtcacgaccggtgctcgatttagtacacgtgattagggattgggggagctacaacaggcaggcaggggcagcaagatggtgttgcagacccaggtcttcatttctctgtgctctggatctcgtggtcgcctccggggacatcgtgatgacccagtctccagtacctcccgtgctgtgtcgtgtcgggagacggcggccctaccgtcaactgacaacgtccacgaccgagacgttccttaaccgtacgtccttacgaactaagttaacgtcctacgttacgtcttaggtactcgaacgaccgtaaaccggaaccccggtactaccgtaccccgttaaccgtacgtaccgtcgtaccttaccttacgtttaaccggttcggttccccgtttaacccgggtaacccgggtaaccggttcccccgggttacctaccggtaccgtaccgttntaaccggtcggtccgtaacggggttccggtacggtaaaccgggtacgtaaccgttacccttaccggtacctcccgtaaacgtaccctagtaaccgaccggtagtaccgtacgttacgaacgtacgtaaggtaacgtacggttcggtacggttccgttacgtttaccttcgtacgtcgtagtacctagtttacttaccgttgttttacgttttcctcgttccggaccgttaccgtacctaagtacgtaaaccttctaaacctaacggtacgttacggtacttaccggtactccgaaccttcgttaccgttcgttaacc

SEQ ID NO: 108462 - DNA, 868 bp, Homo sapiens
  misc_feature: GYAE6OF01CRL7O.13.19.B08.1.454.CMB.1.raw
tcagtcacgtactacacgaccggtgctcgatttagtgagtcagtaagggggtaggctcaggaggcagagctctgaatgtctcaccatggcctggatccctctcctgcctccccctcctcattctctgcacagtctctgtcgacctctatgaactgacacagccactcctcagtgtcagtcgtccgtccggacacggacggccaggactccacctgcctacgaaggtaaattacttactaagaaaactaaaaaaatgtacggaccgttcgggttacgttaccgagaccaagaacgccgaacggaccgaccggaccccgtaggttaccgtggttagttaaacttttaaacgtaaaacgtactaaggtttcggaaccggtcccggtacccgtacggaacgggtaccttacccggtagaaccgtcgtaccttccggtccggtacttaccgttaagtaccgaacgggtaccctacgtaaccggttacctaccgttacgacccgtacgtacccggacccgggtaccctaggttacggttacggaaacggttctacggggaacgttacgttaacgggttaaattttaacggttttacgtttaccgttaccggttccggttacggcccggttttaacgaacccgttaaacccgttaaccgtttacgggttttacccggggtttaccgggggttttacccggggggaacggggtaacccttaacggggtttcccgggtacccgggtttacgggtccggggtaactaccccgggtacccgtaccggttcccggtacccccgtccccgggtttccgacccgttacccgttcccggttacccgttccccggacccttttcggtacgttaccggttccggg

SEQ ID NO: 108463 - DNA, 646 bp, Homo sapiens
  misc_feature: GYAE6OF01CYXYI.13.19.B08.1.454.CMB.1.raw
  modified_base (238)..(238): a, c, t, g, unknown or other
  misc_feature (238)..(238): n is a, c, g, or t
  modified_base (296)..(296): a, c, t, g, unknown or other
  misc_feature (296)..(296): n is a, c, g, or t
  modified_base (485)..(485): a, c, t, g, unknown or other
  misc_feature (485)..(485): n is a, c, g, or t
tcagtcacgtactacacgaccggtgctcgatttagtgagtcagtaagggggtaggctcaggaggcagagctctgaatgtctcaccatggcctggatccctctcctgctccccctcctcattctctgcacagtctctgtgacctcctatgaactgacacagccatcctcagtgtcagtgtctccgggacaggacggccaggatcacctgctcgaggaaatattctagaacaaaaaaatntgctcggtggttaccagcagaagccaggccagtcccctggtcggtggttcattttacncgaaagactaccgaaaaccggcccgtacagggactccctagacgcgtacttctacttcggttacccgaactcgtagggaataccgagcctaactctacgaaccataccgaacgggcctacgaagggtctaagtcggagtggaaggacttggaacctttagtttactggttacgagggttggtcgggaanacggtaacaaacctaacctagttgggttacggtaacgttcggggacgggtaacgggaaccgtaacggctaacgggtacccgtaccgtacgggtacacggaccccaagggtccctacccgcccccggttacgcccgtaccttccggttccgttaccccccgg

SEQ ID NO: 108464 - DNA, 547 bp, Homo sapiens
  misc_feature: GYAE6OF02IDKJH.13.19.B08.1.454.CMB.1.raw
  modified_base (234)..(234): a, c, t, g, unknown or other
  misc_feature (234)..(234): n is a, c, g, or t
  modified_base (288)..(288): a, c, t, g, unknown or other
  misc_feature (288)..(288): n is a, c, g, or t
  modified_base (353)..(353): a, c, t, g, unknown or other
  misc_feature (353)..(353): n is a, c, g, or t
tcagtcacgtactacacgaccggtgctcgatttagtgagtcagtaagggggtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgaacaaaaaatntgctcggtggttccagtccagaagccaggccaggccccagtactggtgatttanaaagacattggagcggccctcgagggactccctgagcgattcgtccggctctaatcagggaccanacgtcaccttgaccatccgaccgggcccagtattagaggatggaggctagtactattattgttactcgtgcgtctcgacacatcgtgggttttcggcgggggtacctagttcgaccggtcgtgggtcgacgtccgtaaggctccgccccgtcggtcctacgtcgtcgttccccacccttccttacctagtaccg

SEQ ID NO: 108465 - DNA, 667 bp, Homo sapiens
  misc_feature: GYAE6OF02G47JX.13.19.B08.1.454.CMB.1.raw
  modified_base (139)..(139): a, c, t, g, unknown or other
  misc_feature (139)..(139): n is a, c, g, or t
  modified_base (190)..(190): a, c, t, g, unknown or other
  misc_feature (190)..(190): n is a, c, g, or t
  modified_base (248)..(248): a, c, t, g, unknown or other
  misc_feature (248)..(248): n is a, c, g, or t
  modified_base (493)..(493): a, c, t, g, unknown or other
  misc_feature (493)..(493): n is a, c, g, or t
tcagtcacgtactacacgaccggtgctcgatttagtgagtcagtaagggggtaggctcaggaggcagagctctgaatgtctcaccatggcctggatccctctcctgctccccctcctcattctctgcacagtctctgtnacctcctatgaactgacacagccatcctcagtgtcagtgtccgtccggganagaccggccaggatccaccttgctacgaaggtaaatattcagtaaaccaaaaaaattntgacgttcggttacgttttccgaacgcgaacgaacgaccgacggaccgaaccggccccctaaggttaccgtgggttagtaagttttaaagtaaaacgtactaagtttaggacggccggtaccccgttcgaagggtactacccgtgacggtcgaacgtttccgccggtctaccttaacgttccgaacgggtaccacgtacgtacctaccttcgacctacgttccgacccgggccagacgttgagtnggacgtctagtacttattagtttcgttactcgtagtccgtactacgacaactcttcggttcgggttacgggcgggtactacggtcggtacgtgtcggactacgaccgtacggtccgtaccgcccgttacgccgttacgtcgttcccgttcccgtacctccgttcgtacgtccgg

SEQ ID NO: 108466 - DNA, 818 bp, Homo sapiens
  misc_feature: GYAE6OF02G6K21.13.19.B08.1.454.CMB.1.raw
tcagtcacgtactacacgaccggtgctcgatttagtgagtcagtaagggggtaggctcaggaggcagagctctgaatgtctcaccatggcctggatccctctcctgctccccctcctcattctctgcacagtctctgtcgacctcctatgaactgacacagccatcctcagtgtcagtgtcctcgggacagaccggccaggactcacctgctacgaaggtaaacttattacgtaacgaaaactaaaaaaaatatcgaccggttaccggtacggttacccaaggtacaaaggaaacgtcccgaacggtaccgaaccggacccccgaaggttaaccgtagggttagtaaacgttttaaacgaaaaacggtacctaagttacggaacgggcccggtaccccgttaggaaaccgggtaaccttcccgtaggtacggtccgtaacgttacccgtcccggtcttaaccgtttaaacgttaccggaacgggaacccctaacgtacggttaccctaacccgttcgaaaccacgttacccggaacccggggaccctagggtaacgttacggaacggtaacggtaggaaccggtacgtacgtaacgtttaagtttaacgttcgttaacgtcgtacggccgtacctacgaaccaacgttgttaccggtttcgggtttacggggacccgggtaacgttacgggttacggtaccggtcggttaaccgggcctaccggacccgtaacggtcccgttccccgtacccggtccgttaccctaacgttcccgtacccgttccccttaaccccgtccgtttacgtcccgttaacgg

SEQ ID NO: 108467 - DNA, 848 bp, Homo sapiens
  misc_feature: GYAE6OF02FULCO.13.19.B08.1.454.CMB.1.raw
tcagtcacgtactacacgaccggtgctcgatttagtgagtcagtaagggggtaggctcaggaggcagagctctgaatgtctcaccatggcctggatccctctcctgctccccctcctcattctctgcacagtctctgtgacctcctatgaactgacacagccatcctcagtgtcagtgtccgtccgggacaggaccggccaggatccacctgctacgaacggtaaattacttacgtagaaaacctaaaaaaattacgtcggaccgttacggggttcggttaccacggacgtaacggaacggacccgaacggaccccgaacggaccccccgtaagggttaccgtaggggttacgtaacttttaaagtaaaacgtaccttaagtttggaaccggtacccgggtcccctacggacggggtaccttccccggtaggacgaccgtactttccggccggtactacttaacgtaccggacgggacccaacgtacgtacctacccgttacgacctacgtacccggacccggggtacctaggtaacttgggacggtagtacgggagtccgtagtaactttagtttaacgttcggtttaaccgtcgttacgggtccgaccgttaacgaacccgttaaaccgttcggttcgggttttaccgggggttttccggggggaacccgggggttacttaaccgggtttaccggtacccgggtttacggggtcggtaacccggtaccggtaaccccggtacgggttcccctccccggtacccccgttcggggttaccctaccgttccgtttaccccggttaccccctaaccccttttcccggttaccggttaccggttaacccgg

SEQ ID NO: 108468 - DNA, 740 bp, Homo sapiens
  misc_feature: GYAE6OF02G4B6M.13.19.B08.1.454.CMB.1.raw
  modified_base (247)..(247): a, c, t, g, unknown or other
  misc_feature (247)..(247): n is a, c, g, or t
  modified_base (367)..(367): a, c, t, g, unknown or other
  misc_feature (367)..(367): n is a, c, g, or t
tcagtcacgtactacacgaccggtgctcgatttagtgagtcagtaagggggtaggctcaggaggcagagctctgaatgtctcaccatggcctggatccctctcctgctcccccctcctcattctctgcacagtctctgtgacctcctatgaactgacacagccatcctcagtgtcagtgtccgtccgggacagacggccaggactcacctgcctcgaaggtaaatattctagaaaactaaaaaaatntgacgttcggtcggttaccagacaagaacgccgaggcccacggcccccaagttacgtacggtagtaactttaagtaaaagactaagttaggacggccggaccctacgagggtactcccgngacgcgtacttccgtccggtactacgtaattacgaacgggacccacgtacgtacctaccgttacgaccctacgttacccggaacccggggccctaaggtaacgtttacggaacgggtagtagggtaccggtcgtacggtaactttaagttacttttacggtttaccgttacgttcggaccgttacgtaccgtaacctaacccgtacgttaccggtttcgggtttaccggggtaaccgggggtaccgttaacgggttaccgggttaccggttcgggttacgggttaccgaccggaccgtaacggtcccgtcccggtaccccgtccgtacctaccgttcgttcccgtacccgttccctccgttactacgttaccg

SEQ ID NO: 108469 - DNA, 856 bp, Homo sapiens
  misc_feature: GYAE6OF02F97WZ.13.19.B08.1.454.CMB.1.raw
  modified_base (195)..(195): a, c, t, g, unknown or other
  misc_feature (195)..(195): n is a, c, g, or t
  modified_base (256)..(256): a, c, t, g, unknown or other
  misc_feature (256)..(256): n is a, c, g, or t
tcagtcacgtactacacgaccggtgctcgatttagtgagtcagtaagggggtaggctcaggaggcagagctctgaatgtctcaccatggcctggatccctctcctgctccccctcctcattctctgcacagtctctgtcgacctcctatgaactgacacacgccatccctcagttgtcagtcgtcgtcccggganaggaccggcaaggactcaccgtgctacgaaggtaaatacgttctagaaaactaaaaaaatntagccgtcggttacgttccgacgcaagaaacgcccgaacggccgaacggaccccctaagtaccgttaggtagtaactttaaagtaaaaggtacctagttacggacggtaccggtaccccgtacggaacggggtaccttccccgtaggaaccgtacggtaacgtttcccgtacccggtacttaccttaaagttcccggaaacgggtacccaaaccgttacggtacctaacccgtttacgaacccgtacgtacccggaacccgggggacccgtaacggtaacgtttacgggaacggtaacggttaacggacgggtacgtacgtaacgtttaaacgtttacggtttaacgtttaacgttcgtaccgtaccggtacttacgtaaccaaccgtagttacggtttacggggttttccggggaccgggggtaaccgttaacggtttacccggaccgggttagggttaccggggtcctaacgggtaacccccggtaacggtcccggtaccccggtacccccggttacgggttaccccgtaaccgtttacccggttcccgtttacccccggacccctttcccgttaaccggttacccggttaacccggg

SEQ ID NO: 108470 - DNA, 818 bp, Homo sapiens
  misc_feature: GYAE6OF02FVM3X.13.19.B08.1.454.CMB.1.raw
  modified_base (233)..(233): a, c, t, g, unknown or other
  misc_feature (233)..(233): n is a, c, g, or t
tcagtcacgtactacacgaccggtgctcgatttagtgagtcagtaagggggtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaatatctagaacaaaaaatntgctcggtggttccagcagaacgccgaggccacggcccccaagtacgtggtagtaattttaagtaaacgactagtttggacggccgggtccctcgaacggggacttccccgtaggacggtccgtaatttcccgtccggtaccttaccgttaaatttcccggaacggggtaccccaaacggtaccgttaaccctaaccccgtttacggaaaccccgtaacgttccccggaaaccccggggggtcccctaaggttaaccgtttacgggaacgggttaacgtacgggaccgggtccgttacggtaaccgtttaagtttacgttttacgtttaacgtccggttacggaccgggtccgttacgaacccgtaaaccgttacgtttaccggtttcggggtttttaccggggaaccggggggtacccgttaacggggtttccggtaacccggttcgggttcgggttacccgtacgggtaccccggtaagggttccccgttacccggtccccccgttaccggttacccgtaacccgtttcccgtaccggtttccccccgtcccgtttacccggttaccgttacccggttaccgg

SEQ ID NO: 108471 - DNA, 735 bp, Homo sapiens
  misc_feature: GYAE6OF01DSB3E.14.71.G05.1.454.CMB.1.raw
  modified_base (171)..(171): a, c, t, g, unknown or other
  misc_feature (171)..(171): n is a, c, g, or t
tcagcgtctagtaccacgaccggtgctcgatttagtgtcgtcgcaagagagaggggcccagccctgggattttcaggtgttttcattcggtgatcaggactgaacagagagaactcaccatggagtttgggctgagcggcgtggttctaaggtcggctaattttaaaaggngtgcagtgtgaggtgcagctgttggagtctggggagggtcgttggtacgacgcggtcggggtccgtgagacgtctccgtgtgcgacgcctcgtggtacgttcgttcgtttacgtcgagtctagtcgtcctagtgagcgtcggtcgtccgccgacggccgtacggacggggaggggcggtggtaggtgggtcgtcgtgtcgttacgttcgtcggtcgtagtggtagtagtagtacgtaactaacgtacgaccgacgtacgtaccggtacggtaacgggtacccggttacgttacgttacgttaccgtaacgtaacgtaacgtaaacgtaaccgtaaacgtaaactaactacgttacgtacgttaccgtcgtacgaacgtaacgtacgtaccgacgaccgtacgaacgacggaccggaacggaaccgtaccggtacgtaacgttaacgttacgtacggtacggtaaccggtaaaccggtaaccgtaaacggtttaacgtttaagggttaggtttacggtttaacgtttaacgtttaccgttttacgttaccggttacggttacggg

SEQ ID NO: 108472 - DNA, 558 bp, Homo sapiens
  misc_feature: GYAE6OF01EHW4Q.14.71.G05.1.454.CMB.1.raw
tcagcgtctagtaccacgaccggtgctcgatttagtgtcgtcgcaagagagaggagcccagccctgggattttcaggtgttttcattcggtgatcaggactgaacagagagaactcaccatggagtttgggctgagcgtggcttttctagtggctattttaaaaggtgtgcagtgtgaggtgcagctgttggagtcgtgggggaggcttggtacagcctgggggtccctgagactctcctgtgcagcctctggattcgtctttagcagctatgccatgagctgggctcgccaggctccgagggagggctggagtgggtctctgctattcctggcagtggtgatatcgaatactacgcagactccggtagaacgggtccggttcacgttgtttccagagactaattaccaaagaacacactgtatctgcagatgaccagcctagagacgccgaggacacggtccgtaatacgttacgtgtacgaccgaaacgcctaaaggttagtttttagggaacgtttaggtttaatttaacttaccgttttggacgtttaccgggg

SEQ ID NO: 108473 - DNA, 528 bp, Homo sapiens
  misc_feature: GYAE6OF01D5E9U.14.71.G05.1.454.CMB.1.raw
  modified_base (345)..(345): a, c, t, g, unknown or other
  misc_feature (345)..(345): n is a, c, g, or t
tcagcgtctagtaccacgaccggtgctcgatttagtgtcgtcgcaagagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccgaggggaaggggctgggagtgggtctctgctattcctggcagtggtnatatcgaatactacgcagactccggtgaacgggccgttcactcgtttcagagaacaattaccaagaacacactgtatctgcagatgaccagcctagagacgaccgaggacgacggccgtatacttactgtcgacgaaacgcctaagtagttttggagttggttaattattacctttgcttcgg

SEQ ID NO: 108474 - DNA, 266 bp, Homo sapiens
  misc_feature: GYAE6OF01EUYW8.14.71.G05.1.454.CMB.1.raw
  modified_base (264)..(266): a, c, t, g, unknown or other
  misc_feature (264)..(266): n is a, c, g, or t
tcagcgtctagtaccacgaccggtgctcgatttagtgtcgtcgcaagagagagggggtcaggcactgatttcacactgaaaatcagcagggtggaggctgaggatgttggggtttattactgcatgcaagggacacactggcctccgggggacgttcggccaagggaccaaggtggaaatcaaacgaactgtggctgcaccatctgtcttcatcttcccgccatctgagtactagacgctgagcgggctggcaaggcgcatagnnn

SEQ ID NO: 108475 - DNA, 266 bp, Homo sapiens; identical to SEQ ID NO: 108474
  misc_feature: GYAE6OF01EXX1S.14.71.G05.1.454.CMB.1.raw
  modified_base (264)..(266): a, c, t, g, unknown or other
  misc_feature (264)..(266): n is a, c, g, or t

SEQ ID NO: 108476 - DNA, 539 bp, Homo sapiens
  misc_feature: GYAE6OF01BJZIH.14.71.G05.1.454.CMB.1.raw
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
tcagcgtctagtaccacgaccggtgctcgatttagtgtcgtcgcaagagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtcgtgggggaggcttggtacagccgtgggggtccctgagactctcctgtgcagcctctggattcgtctttagcagctatgccatgagctgggctcgccaggctccgaggggaggggctgggagtgggtctctgtctattccgtggcagtgtgatatcgaatactacgcagactcggtagaacgggtccgttnactgttccaganactaatcaagaacacactgtatctgctagatcgacagcctgagacgccgaggacacggctatattactggtacgacgaacgtccaaggtttacgttttgggaacgttgggttaatttacttaacccgtttgaccttcgggg

SEQ ID NO: 108477 - DNA, 721 bp, Homo sapiens
  misc_feature: GYAE6OF01DYB4S.14.71.G05.1.454.CMB.1.raw
  modified_base (344)..(344): a, c, t, g, unknown or other
  misc_feature (344)..(344): n is a, c, g, or t
tcagcgtctagtaccacgaccggtgctcgatttagtgtcgtcgcaagagagaggggcccagccctgggattttcaggtgttttcattcggtgatcaggactgaacagagagaactcaccatggagtttgggctgagctggctttttcttgtggctattttaaaaggtgtgcagtgtgaggtgcagctgttggagtcgtgggggagcttggtacagccgtgggggtccctgagactctcctgtgcacgcctcgtggtattcgtctttagcagctatgccatgagcgtgggctcgccgaggctccggagggagggctgggaggtcggtctcgtcgctacgttccgnggtcaggttggtagtaagtaagtacggtaaactaccgtaaccgcgaacgtaccgttccgggtaggaacggggtcccgttctacgttcgtttacccgaagacgtaactaacgttaaccaaacgtaaccactaacgttacgttacttccgtagtacaagtacgttacggaccctagacccgtaggaacggaaccggaccgggtaacgggacccgtaaccgggtaccgttaagttaacgttaccgtgggttaaccggaaccggtaaaaccggtaccgttaaacgggtttagttttttacggggtaacgttttacggggttttaaactttaccggtttaaaccgtttttacggtaaccggtttccgggttaacccgggggg

SEQ ID NO: 108478 - DNA, 261 bp, Homo sapiens
  misc_feature: GYAE6OF01BZF54.14.71.G05.1.454.CMB.1.raw
  modified_base (260)..(261): a, c, t, g, unknown or other
  misc_feature (260)..(261): n is a, c, g, or t
tcagcgtctagtaccacgaccggtgctcgatttagtgtcgtcgcaagagagaggggtcaggcactgatttcacactgaaaatcagcagggtggaggctgaggatgttgggtttattactgcatgcaagggacacactggcctccgggggacttcggccaagggaccaaggtggaaatcaaacgactgtggctgcaccatctgtcttcatcttcccgcatctgagtactagacgctgagcgggctggcaaggcgcataggnn

SEQ ID NO: 108479 - DNA, 707 bp, Homo sapiens
  misc_feature: GYAE6OF01CTBYS.14.71.G05.1.454.CMB.1.raw
  modified_base (296)..(296): a, c, t, g, unknown or other
  misc_feature (296)..(296): n is a, c, g, or t
  modified_base (485)..(485): a, c, t, g, unknown or other
  misc_feature (485)..(485): n is a, c, g, or t
tcagcgtctagtaccacgaccggtgctcgatttagtgtcgtcgcaagagagaggggcccagccctgggattttcaggtgttttcattcggtgatcaggactgaacagagagaactcaccatggagtttgggctgagctggtctttttcttgtggctattttaaaaggtgtgcagtgtgaggtgcagctggttggaggtccgggggaggcgttggtacgaggccggggggtccctgacactctcctgtgcagcctcaggacttctattttagcgtaatatgccatgagcgtggtccncgaggctaccgaggggaacgggctgggagtcgggtctgagtcaatcgtaggtggttcgtaggtaggaaagtacagttccgaacgcccgtcgtacccgtaggaacgggtccggttctacccgtatccgtaccgaagaacgtaacctaaccgttaccgaaacgtaacctaccttattacttttaaccgtanaaaacgttggaacctaggtaccctaaaggaaaacgaccgaaaaggtaccggtaacgggtcggtttaagttaacgtttttagggtaggtaaacgtaaaaggtcctaaacggtaattaacccgtatacggaccttaaacccgtaagggtttcggggaacgggtttcccttagtacggttcggtacggtcggggaacctaaggggcccttcgggtggttaccccg

SEQ ID NO: 108480 - DNA, 540 bp, Homo sapiens
  misc_feature: GYAE6OF01AJ9JQ.14.71.G05.1.454.CMB.1.raw
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (512)..(540): a, c, t, g, unknown or other
  misc_feature (512)..(540): n is a, c, g, or t
tcagcgtctagtaccacgaccggtgctcgatttagtgtcgtcgcaagagagaggggctggagtgggtctctgctattcctggcagtggtgatatcgaatactacgcagactccgtggaagggccggttcacttgtttccagagacaattccaagaacacactgtatctgcagatgaccagcctgagagccgaggacacggccgtatattactgtgacgaacgccaagttagttttggagttggttattatactttgacttcgttggggccgacgggaaccctggtccaccgtcctcctcacgccctacccaccgaacgggcccctacgtcccggtccctttcccccgtcggccctaccccgtccctacccgaagacgcctacccgtcggtcgggggcacgacggccgcccgtgggcctcgccgtggtacgaaggtaccttaccgttcccgtaactacggccgtcgtggacgggccgggtcgtcggaccgaacgggcgtaccagtagcngnannnnnnnnnnnnnnnnnnnnnnnnnnnnn

SEQ ID NO: 108481 - DNA, 551 bp, Homo sapiens
  misc_feature: GYAE6OF01BTZHL.14.71.G05.1.454.CMB.1.raw
tcagcgtctagtaccacgaccggtgctcgatttagtgtcgtcgcaagagagaggggcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccgagggagggctggagtgggtctctgctattcctggcaggtggtgatagtacgaatactacgcagactcgtagaacgggtccgttacacgtgtttaccagtacgactaattaccaagaacacactgtaatctgacagatgaccagctagagacgaccgaggaccgacggaccgtatacttacgtgtacgacgaaacgacctaaggtacgttttggagttggttaattacttacgtttcgtcgttggttaccggg

SEQ ID NO: 108482 - DNA, 282 bp, Homo sapiens
  misc_feature: GYAE6OF01DIZJX.14.71.G05.1.454.CMB.1.raw
  modified_base (260)..(260): a, c, t, g, unknown or other
  misc_feature (260)..(260): n is a, c, g, or t
  modified_base (276)..(282): a, c, t, g, unknown or other
  misc_feature (276)..(282): n is a, c, g, or t
tcagcgtctagtaccacgaccggtgctcgatttagtgtcgtcgcaagagagagggggtcaggcactgatttcacactgaaaatcagcagggtggaggctgaggatggttggggtttattactgcatgcaagggacacacgtggccgtccgggggacgttcggaccgaaagggaccgaaggtggaaaatacaaaacgaactggtggctgacaccatctgtctcatccttcccgctatctgagtactagcgtctgagcggcnggcaaggcgcataagnnnnnnn

SEQ ID NO: 108483 - DNA, 536 bp, Homo sapiens
  misc_feature: GYAE6OF01BH1LP.14.71.G05.1.454.CMB.1.raw
  modified_base (142)..(142): a, c, t, g, unknown or other
  misc_feature (142)..(142): n is a, c, g, or t
  modified_base (152)..(152): a, c, t, g, unknown or other
  misc_feature (152)..(152): n is a, c, g, or t
  modified_base (164)..(164): a, c, t, g, unknown or other
  misc_feature (164)..(164): n is a, c, g, or t
  modified_base (166)..(166): a, c, t, g, unknown or other
  misc_feature (166)..(166): n is a, c, g, or t
  modified_base (177)..(177): a, c, t, g, unknown or other
  misc_feature (177)..(177): n is a, c, g, or t
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (341)..(341): a, c, t, g, unknown or other
  misc_feature (341)..(341): n is a, c, g, or t
tcagcgtctagtaccacgaccggtgctcgatttagtgtcgtcgcaagagagaggagcccagccctgggattttcaggtgttttcattcggtgatcaggactgaacagagagaactcaccatggagtttgggctgagcggtgngtttctaggngctatttaaagntncagtgtgagtncagctgttgatctgggagctgtacngcctggggtccctgagctctcctgtgcagcctgtagattcgtnttagcagctatcgaccatgaacgctggcacgcaggcctcgagggagggtctggagtggctgtgctagtcctgcaagtgtcgatagcaacttaacgngcaagcttccggagaaacgggccgtttacacgttgtacgagtactactaactacaacaacacactatatactacgacagtactacgacacgcgtagagtacgacgacgacgacgtacgtaacgtacttacgtacgtacgtacgaacgaacgtaacgttagttgttacgttagttattagttacgttcgtacgtcg

SEQ ID NO: 108484 - DNA, 839 bp, Homo sapiens
  misc_feature: GYAE6OF01DRUHG.14.71.G05.1.454.CMB.1.raw
tcagcgtctagtaccacgaccggtgctcgatttagtgtcgtcgcaagagagaggggtccctgagactctcctgtgcagcctctggattcgtctttagcagctatgccatgagcgtgggctcgcgaggctccgaggggagggctgggaggtgggtctcgtgcttattccgtggactaggtggtagatacgtacgaattacgtacgcagtaccgtccggtagggaacggggtcccgtttacaaccgttttcgttacccgaaggaacgtaactaacttaaccgaaagaaccactacgttagtactcgacggactaacggagtaccgaaccgacggtccgtaggaacggtacggaccccgggtaaggacccggtaaccggttaccgttaatttaccgtcgttaacggaccggaaaaccggtaaccgtacgttaaaggtttttcgttttagggagttttacggtttaattaccgttacgtttacgtccggttcggggttaacggggaccgtaaccgggtacccgttcggttacccgaccggtttcctcccgttaacgaccgtaccccgtacccgaaacgggtacccggtccccgttaacggtttcccccggtaccccctttcccccgggtacgtacccctaccccgttaccgtaaccgaacgccggtcccgttacccggttcggggacgggacccaacgggtcccgcccggggtcccgtagggtccctacgggttaccgtacggtaccgttaacggtacccctttacggttacctacggtaccgtacggttaccggcgggaccgggtcgggccgtgggaacggcggacttcgaagtcggatgcg

SEQ ID NO: 108485 - DNA, 822 bp, Homo sapiens
  misc_feature: GYAE6OF01DJIUP.14.71.G05.1.454.CMB.1.raw
tcagcgtctagtaccacgaccggtgctcgatttagtgtcgtcgcaagagagaggggtccctgagactctcctgtgcagcctctggattcgtctttagcagctatgccatgagctgggctcgccaggctccgagggaagggctggagtgggtctctgctattcctggcagtggtgatatcgaatactacgcagactccgtagaacgggccgttcacttgttccagagacaattaccaagaacacactgtatctgcagatcgacacgcctagagacgccgaggtaccgaccggtaccgttaagtactttacgtaggttacggaaccggtaaaccgacccgttaaaggttagttttttagggaaggtttagggttttaacttttaacgttaccgtttttacggaaccgtttcggtttaccggggggacccgtaaccggggtaaaccccgttcgggtacccgttaacccggttccttacccgtaccgaccgtacccttaccccgaaacccgtaaccggggtcccccgtaacgttacccgggtttacccccgtttccccccgtaccgggtacccctaacccccgttcccgtaaccccggaaagcccggtacccgtacccgtccgggttacgggggtacccgacgtaccgggtcccgggtccccgtcgggggtacccgtccggttacggtaccggttaacggaaccggttaccgttaaccccggttccgttaaaccgtaccggtacggtaccggttcgggtacgggcccggggttcgtaccggggaacccgtaaacgggggcccaaccggtaaagttcggatccgagg

SEQ ID NO: 108486 - DNA, 639 bp, Homo sapiens
  misc_feature: GYAE6OF01ALRXQ.14.71.G05.1.454.CMB.1.raw
  modified_base (243)..(243): a, c, t, g, unknown or other
  misc_feature (243)..(243): n is a, c, g, or t
  modified_base (245)..(245): a, c, t, g, unknown or other
  misc_feature (245)..(245): n is a, c, g, or t
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
tcagcgtctagtaccacgaccggtgctcgatttagtgtcgtcgcaagagagaggagcccagccctgggattttcaggtgttttcattcggtgatcaggactgaacagagagaactcaccatggagtttgggctgagcgtggcttttcttgtggctattttaaaaggtgtgcagtgtgaggtgcagctgttggagtcgtgggggaggcgttggtacagccgtgggggtccctgagctctctgtncngcctcgtggtattcgttctttagcagtctatcgccagtgagcgtgggctccgccgacggccncgaggggaggggcgtgggaggtgggtctcgtgtacttacttccgtggctaggtggtanatatcgaatactacgcacgtacgtccgtaggaacgggtccgttcacgttgtaccgaagacgtactaaacttaccaaagtaaccactacgttacgtaactcgtacgacaggtatcgaccagaccgtaggacgacggacggaacggaacggaccggtacgttaactagtttaccgtaggtacgaacccggtaacgtaccgttaaggtttcggtttttaacgggacggtttacgggttttaactaaccggtttacctttggtacccggtttccgggg

SEQ ID NO: 108487 - DNA, 602 bp, Homo sapiens
  misc_feature: GYAE6OF01BTBVR.14.71.G05.1.454.CMB.1.raw
  modified_base (251)..(251): a, c, t, g, unknown or other
  misc_feature (251)..(251): n is a, c, g, or t
tcagcgtctagtaccacgaccggtgctcgatttagtgtcgtcgcaagagagaggggcccagccctgggattttcaggtgttttcattcggtgatcaggactgaacagagagaactcaccatggagtttgggctgagctggctttttctgtggctattttaaaaggtgtgcagtgtgaggtgcagctgtggagtcgtgggggaggcttggtacaggccgtggggggtccctgagactctcctgtgcagcctntggattcgtctttagcagcttatgccatgagctgggctcgccaggctccgagggagggctggaggttcgggtctgtcgtcttacttccgtaggcgaggttcggtgattagtcgtaaataccgtacgacagtaccgtccggtaggaacgggtccgtttacacgttgttaccgagacgactactaccgaagacactatacgtactcgtgcaagtatcgaccagccgtagacgacgaccggtagaccgacgggtaccgtattacgtacgtacgtacggaccgaaccgtaccgtaagttacgttttagggagttttagttacttacgttacctttacggtcgttcggtaccgggg

SEQ ID NO: 108488 - DNA, 818 bp, Homo sapiens
  misc_feature: GYAE6OF01EB808.14.71.G05.1.454.CMB.1.raw
  modified_base (228)..(228): a, c, t, g, unknown or other
  misc_feature (228)..(228): n is a, c, g, or t
  modified_base (282)..(282): a, c, t, g, unknown or other
  misc_feature (282)..(282): n is a, c, g, or t
  modified_base (422)..(422): a, c, t, g, unknown or other
  misc_feature (422)..(422): n is a, c, g, or t
tcagcgtctagtaccacgaccggtgctcgatttagtgtcgtcgcaagagagaggggcccagccctgggattttcaggtgttttcattcggtgatcaggactgaacagagagaactcaccatggagtttgggctgagcgtgtcgtttctaggtggactattttaaaggtgtgcagtgtgaggtgacagtcgttggttggtaggtcggtgggggaggtcgttcgggtacncggccggtcggggggtccctgacgaccttctccgtgcgacacgtcctagtggtnttcgttctttagcagtactacgtacgacctagtagacggtccggtacgggtacctccggaccgacggtccgttacgggaacggggggtaggggtccggtagggacggttcggtacgttcggtcgttacgttacgttcggnggacgtagggtcggtagtagtccgtaacggtaacttacgtaacgccgtaacgtaccggtaccggtaggtaaccgggttccgttaactacgggttcttaacggacgtaacgtaaccttaacgtaaccgaacctaaaccgtactacgtttaacgtacgtacgaccgttaacggcttaaacgccgaacccgtcggaccgtacgggaacggcccgggttaacgaacgggttccgtaaaccggttcggtttaacttaccgtttaggacggggtaaccgtaaacccgggaaaccgtttcgttaaagggtttttcgggttttaaccggggagtttttaaacgtttacccggttttaacgttacccgggtttacgtttacggggtccggggttaaacccggggg

SEQ ID NO: 108489 - DNA, 866 bp, Homo sapiens
  misc_feature: GYAE6OF01BZAII.14.71.G05.1.454.CMB.1.raw
  modified_base (861)..(861): a, c, t, g, unknown or other
  misc_feature (861)..(861): n is a, c, g, or t
  modified_base (863)..(863): a, c, t, g, unknown or other
  misc_feature (863)..(863): n is a, c, g, or t
tcagcgtctagtaccacgaccggtgctcgatttagtgtcgtcgcaagagagaggggtccctgagactctcctgtgcagcctctggattcgtctttagcagctatgccatgagcgtgggctcgccaggctccgagggaagggctggagtgggtctctgctattccgtggcaggtggtgatatcgaatactacgcagactccggtgaacgggtccgttcacttgtttccgagacgactaattaccaagaacacactgtatcgtgacagtacgtcgaaccacgtccgtaggaacgacggaccggaacggaccgaccggtaccgttaagtactttacgtcggtacgaaccggtaaaccgaccgttaaaggtttaggtttttagggtaaggttttacggttttaaacttttaacgtttaaccgttttacggtaaccgtttccgggttacgggggacccgttaaccggggttaaccccgttcgggttacccacccggttccttaccccgtacgacccgtaccccgttaccccgaaccggtaaacccggcccccgttacggttccccggttaccccctttccccccggtacggtacccctacccccgttaaccccgtacccgtaaaccggtaccgtaccccgtacccgtttacccgggtaccgggggtaccctaacccggtcccgggtaccccgggtccccgggtacgggtcccggttacccgggttacccggttacgggtaacccggtaaccgggttaacccctttaccggtttacccggttaaccgttaccgggtaccggtaccggttcggaaccggggttcccgggtcggtacggtaacccggacgggtacctacgtagtacggngngcg

SEQ ID NO: 108490 - DNA, 722 bp, Homo sapiens
  misc_feature: GYAE6OF01C0FN0.14.71.G05.1.454.CMB.1.raw
  modified_base (215)..(215): a, c, t, g, unknown or other
  misc_feature (215)..(215): n is a, c, g, or t
  modified_base (246)..(246): a, c, t, g, unknown or other
  misc_feature (246)..(246): n is a, c, g, or t
  modified_base (551)..(551): a, c, t, g, unknown or other
  misc_feature (551)..(551): n is a, c, g, or t
tcagcgtctagtaccacgaccggtgctcgatttagtgtcgtcgcaagagagaggggcccagccctgggattttcaggtgttttcattcggtgatcaggactgaacagagagaactcaccatggagtttgggctgagcgtgtcgttttcttagtggcttaattttaaaaggtgtgcagtgtgagtgcagctgttggagtcgtggggagcttgtacngccgtgggggtccctgagactctcctgtgcncgcctctggtattcgtatttttagcgaatatcgccatgacgtcgtcgggtccacggacggtcgtaccggagggggaacggggtcgtggggtaggttggtaccgtcgacgtactaaagtccgaaggttcggtttacgtaggtaaggaacgttactacgttacgccgtacccgtcgtccggtacggaacgggtcccgttctaccgtatacccgtacgagtacgaacctaaccgttaccaaacgtacctaacctttcgttaactttctaataaacgtcgaaccacgtactaacggaaacgaaccgaanaccgggtcggttacgttagtttagttttaggtacgtaagaacggtactaacgtaaacgtctaaagtacgtaaccgtaaccggttaggtttacggggtaaccggttcccttttacggtacgttccggtttacggaccgggggttaaccgtaacggggtcccggttaacccgg

SEQ ID NO: 108491 - DNA, 731 bp, Homo sapiens
  misc_feature: GYAE6OF01ARW5O.14.71.G05.1.454.CMB.1.raw
  modified_base (250)..(250): a, c, t, g, unknown or other
  misc_feature (250)..(250): n is a, c, g, or t
tcagcgtctagtaccacgaccggtgctcgatttagtgtcgtcgcaagagagagggagcccagccctgggattttcaggtgttttcattcggtgatcaggactgaacagagagaactcaccatggagttgggctgagctggcttttcttgtggctattttaaaggtgtgcagtgtgaggtgcagctggttgggagtccggggggagcttgggtacgagggccgggggggtccctggaccactcctcctgtncacgcctcaggattctatttttagcgaatatcgccatgagctggggtccgccgaggctccgaaggggacggggctggagtcgggtctacgaggacagtcaggttcggttacttaggaggaagtacacgttccgaccgccgttcgtaccggtggtaacggggtcccggttctacccgacgttccaccgagtaacgactaactaccgaacgaactaacctcgttaactttaccttactaaacgttcggaactacgaccgtaaacggaaacggaccggaaacgtaccgaacgggtacggttaggtttaacgtttttaggttacggttaagtaaaccggtaagttaaacggtaacggttaccttaagtacggtaaaccttaaccggttacggggtttacgggggggttacctttaccgggtacggtttacgttaccgggtacgggtacccggtaaggggtccggttaccgggtcggtaccccggg

SEQ ID NO: 108492 - DNA, 673 bp, Homo sapiens
  misc_feature: GYAE6OF01AVHJQ.14.71.G05.1.454.CMB.1.raw
  modified_base (531)..(531): a, c, t, g, unknown or other
  misc_feature (531)..(531): n is a, c, g, or t
  modified_base (534)..(534): a, c, t, g, unknown or other
  misc_feature (534)..(534): n is a, c, g, or t
  modified_base (593)..(593): a, c, t, g, unknown or other
  misc_feature (593)..(593): n is a, c, g, or t
tcagcgtctagtaccacgaccggtgctcgatttagtgtcgtcgcaagagagaggggcccagccctgggattttcaggtgttttcattcggtgatcaggactgaacagagagaactcaccatggagtttgggctgagctggtctttttctgtggcttattttaaaaggtgtgcagtgtgaggtgcagctgttggagtcgtgggggagcttggtacaggccgtggggggtccctgagtactctcctgtcgcacgcctcgtggtacttcgttcctttagctacgctatcgacctatcggagcgtcgggcctcggccgacggtccgaccggaagggggaacggggtcgtgggagggttcggttcgtacgtcgtaccttacgttccgtggaccgtggttcggtagattaacgacgtaactaacgtacgacgacgtacccgtaccggtaggtaaccgggtcccgttacgtaccgtttaccgttaccgaagtaacgtaactaaccgtaacccaaacgaactacgtactagtctcgacnganacgtacaccgtcgtacgagacggaccgtaccggagtaaccggtacgtactaattcgtangtaccgaacgtaaccgacttaggttaggtttaggtacgtttacgtaagtttacgttaccgttgtcgttgggtacccgggg

SEQ ID NO: 108493 - DNA, 274 bp, Homo sapiens
  misc_feature: GYAE6OF02JMY6M.14.71.G05.1.454.CMB.1.raw
  modified_base (266)..(274): a, c, t, g, unknown or other
  misc_feature (266)..(274): n is a, c, g, or t
tcagcgtctagtaccacgaccggtgctcgatttagtgtcgtcgcaagagagaggggtcgaggcactgattcacactgaaatcagcaggtggaggctgaggatgttgggttattactgcatgcaagggacacactggcctccggggacgttcggccaagggaccaaggtggaaatcaaacgaactgtaggctgcaccatctgtcttcatcttcccgccatctgagtactagacgctgagcgggctggcaaggcgcctataagcgatnnnnnnnnn

SEQ ID NO: 108494 - DNA, 267 bp, Homo sapiens
  misc_feature: GYAE6OF02IBMW2.14.71.G05.1.454.CMB.1.raw
  modified_base (264)..(267): a, c, t, g, unknown or other
  misc_feature (264)..(267): n is a, c, g, or t
tcagcgtctagtaccacgaccggtgctcgatttagtgtcgtcgcaagagagagggggtcaggcactgatttcacactgaaaatcagcagggtggaggctgaggatgttggggtttattactgcatgcaagggacacactggcctccgggggacgttcggccaagggaccaaggtggaaatcaaacgaactgtggctgcaccatctgtcttcatcttcccgccatctgagtactagacgctgagcgggctggcaaggcgcatagnnnn

SEQ ID NO: 108495 - DNA, 537 bp, Homo sapiens
  misc_feature: GYAE6OF02GALAK.14.71.G05.1.454.CMB.1.raw
  modified_base (141)..(141): a, c, t, g, unknown or other
  misc_feature (141)..(141): n is a, c, g, or t
  modified_base (143)..(143): a, c, t, g, unknown or other
  misc_feature (143)..(143): n is a, c, g, or t
  modified_base (167)..(167): a, c, t, g, unknown or other
  misc_feature (167)..(167): n is a, c, g, or t
  modified_base (292)..(292): a, c, t, g, unknown or other
  misc_feature (292)..(292): n is a, c, g, or t
  modified_base (324)..(324): a, c, t, g, unknown or other
  misc_feature (324)..(324): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
tcagcgtctagtaccacgaccggtgctcgatttagtgtcgtcgcaagagagaggagcccagccctgggatttttcaggtgttttcattcggtgatcaggactgaacagagagaactcaccatggagtttgggctgagcggngngtttctaggtggctatttaaaggntgcagtgtgagtgcagctgttggagtctggggaggcttggtacagcctgggggtccctgagactctcctgtgcagcctctggattcgtctttagcagctatgccatgagctgggctcgccaggcnccagggaacgggctggagtgggtctcgtgctnttccctggcagtgtgatatcgaatactacgcagacgtccgtcgaacgggcggttcgtactcgtttccagacgacaattaccaacgaacacactagttatactcgnaganacgacacgacgngagacgacgacgacgacgacgtactatacgtcgtacgacgaacgacgtaacgttagtttagtagttagttattacttacgttacgtacgtcg

SEQ ID NO: 108496 - DNA, 262 bp, Homo sapiens
  misc_feature: GYAE6OF02I6RTP.14.71.G05.1.454.CMB.1.raw
  modified_base (255)..(255): a, c, t, g, unknown or other
  misc_feature (255)..(255): n is a, c, g, or t
  modified_base (261)..(262): a, c, t, g, unknown or other
  misc_feature (261)..(262): n is a, c, g, or t
tcagcgtctagtaccacgaccggtgctcgatttagtgtcgtcgcaagagagagggggtcaggcactgatttcacactgaaaatcagcagggtggaggctgaggatgttgggtttattactgcatgcaagggacacactggcctccggggacgttcggccaagggaccaaggtggaaatcaaacgaactgtggctgcaccatctgtcttcatcttcccgcatctgagtactagacgctgagcgggctggcaaggcncatagnn

SEQ ID NO: 108497 - DNA, 690 bp, Homo sapiens
  misc_feature: GYAE6OF02JEMVK.14.71.G05.1.454.CMB.1.raw
  modified_base (242)..(242): a, c, t, g, unknown or other
  misc_feature (242)..(242): n is a, c, g, or t
tcagcgtctagtaccacgaccggtgctcgatttagtgtcgtcgcaagagagaggggcccagccctgggattttcaggtgttttcattcggtgatcaggactgaacagagagaactcaccatggagtttgggctgagcgtgtgtttctaggtggctatttaaaggtgtgcagtgtgaggtgcagctgttggagtctggggagcttggtacagcctgggggtccctgagctctcctgtgaaacngcctgtgattcgtcttagcagtctatcgactagtgacgcgtggctcgaccgacggtcctacggaggggtacgggcgtagggtaggttcggtctcgtcgtacttacgttccgtggtctaaggtaggtacggtacgtagttacgtaacgtaacgtacgtacgtacggtaccgtaccggtacggtaacgggtaccggttaccgtacgttacgttaccgtacgtacgtaacgtaacgtaccgtaacgaaccaaccgtacgtacgtactcgtacgacgtacgacgtacgaccgtacgacgtacgacgacgaccggaccggaccgaccggtacgtaacgttaacgttacgtacgtacgtaaccggtaaccggtaaccgtaacggttaacggtttacggttaacggttacggtttacgtttacgtttaccgtttacgttaccgttacggtacggg

SEQ ID NO: 108498 - DNA, 580 bp, Homo sapiens
  misc_feature: GYAE6OF02FMI0M.14.71.G05.1.454.CMB.1.raw
tcagcgtctagtaccacgaccggtgctcgatttagtgtcgtcgcaagagagaggggcccagccctgggattttcaggtgttttcattcggtgatcaggactgaacagagagaactcaccatggagtttgggctgagcgtggcttttcttgtggctattttaaaaggtgtgcagtgtgaggtgcagctgttggagtctgggggaggcttggtacagcctggggggtcccctgagactctcctgtgcagcctctggattcgtctttagcagctatgccatgagcgtgggctcgccaggctccgagggagggctggagtgggtctcgtgcttattccgtggcaggtggtgatatcgaatacctacgcaagtactccggtaggaacgggtccggtttcacgttcgtttccgaagagaactaacttaccaaagaacacactgtactcgtgacagatcgaccagcctagagacgaccggaggaccgacggtaccgtatacgttacgtgtcgacgaaacgacctaagttacgtttttagggagtttaggttaacttacgtttaccgtttcgtacttcggttaccggg

SEQ ID NO: 108499 - DNA, 666 bp, Homo sapiens
  misc_feature: GYAE6OF02I5GTH.14.71.G05.1.454.CMB.1.raw
  modified_base (462)..(462): a, c, t, g, unknown or other
  misc_feature (462)..(462): n is a, c, g, or t
tcagcgtctagtaccacgaccggtgctcgatttagtgtcgtcgcaagagagaggggcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacaggccgtggggggtccctgagactctcctgtgcagcctctggattcgtctttagcagctatgccatgagctgggctcgccaggcctccgagggagggctggagtggtctcgtgcttattccgtggctaggtggtagatactcgaatactacgcaagcctccggtaggaacgggtcccggttacacgttcgtttaccgaggtagaacctaagttacccaaagaacccactactgtaacttctgacgtaanactcgaacccacggcccttaggaacggaaccggccggaacgggaacccgtaaccgggtacccgttaaaattaccgtttaccgtggttacggaaaccggtaaaccgtacccgttaaaaggtttacgtttttaggggtaacggtttacggttttaactttaaccgttaacccgttttcggtaacccgtttcgggttaacccggggg

SEQ ID NO: 108500 - DNA, 556 bp, Homo sapiens
  misc_feature: GYAE6OF02GOR6C.14.71.G05.1.454.CMB.1.raw
tcagcgtctagtaccacgaccggtgctcgatttagtgtcgtcgcaagagagaggggcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccgagggagggctggagtgggtctcgtgcttattcctggcaggtggtgatatcgaatacacgcagactccgtggaacgggccggttacactcgttaccagacgactaacttaccaaagaacaacactagtatcgtgcagatacgaccacgcctagagacgaccgaggaccgacggtaccgtatacttacgtgtagacgaacgacctaagtacgttttaggagtttaggttattacgttacgtttacgtacttcgtacggg

SEQ ID NO: 108501 - DNA, 740 bp, Homo sapiens
  misc_feature: GYAE6OF02H4TJI.14.71.G05.1.454.CMB.1.raw
  modified_base (285)..(285): a, c, t, g, unknown or other
  misc_feature (285)..(285): n is a, c, g, or t
tcagcgtctagtaccacgaccggtgctcgatttagtgtcgtcgcaagagagagggggcccagccctgggattttcaggtgttttcattcggtgatcaggactgaacagagagaactcaccatggagtttgggctgagctggtcttttcttggtggctattttaaaaggtgtgcagtgtgaggtgcagctggttggagtcgtgggggaggcttggtacaggccgtggggggtccctgagacctctccgtgtgcacgcctcgtggtacttcgtctttagctagctancgccatgacgcgtggcctccgccgacggccgtaccgagggggaacgggcgtgggtaggtcgggtctcgtggcttacgttccgtggcgtacggttggtacgtatacgtacgaacgtaacgtacgacgtaacgtaccgtacggtagggaaccgggtccgttacgactttacggttacgaacgtacgaaacctaacttaaccgaaaacgaaccgtaactacgttacgttaacttcgtacggtactaaggtaactacggaaccctaacggtacctagggaaccggaacgcccgggaaacggaccgtaaccggtaccgtaagttaaccgttcgtacggaccggtaacccgaaaaccggtaccgttaaacggttacggttttttaacggaggttttaaccggtttaagtttaaccctttaacccggttttacggtacccgtttaccgggttaacccggggg

SEQ ID NO: 108502 - DNA, 684 bp, Homo sapiens
  misc_feature: GYAE6OF02HDZTK.14.71.G05.1.454.CMB.1.raw
  modified_base (282)..(282): a, c, t, g, unknown or other
  misc_feature (282)..(282): n is a, c, g, or t
tcagcgtctagtaccacgaccggtgctcgatttagtgtcgtcgcaagagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtcgtgggggaggcttggtacagccgtgggggtccctgagactctcctgtgcagcctctggattcgtctttagcagctatgccatgagngtggctcgccaggctccgagggagggcgtggaggtgggtctgtgtccgttacttccgtggcgtacggttgggtagtaattaacgtacgtaaacttactacgcgtaacgtaccgtaccggtacggaacggggtccgttaccgcgtttacggttaccaaggtacgaaacctaacttaaccgaaagtaaaccaacctaacgtaggttactacgttacgactaagtacgtcaaccgtagtcccgtagacgaccggtaccggaagggacccgacgggtaccgttaagtttaacttaccggtaggttaccggaaaccggtaaaccggttaaccgtaaggtttacggtttttaagggacgggttttacggttaactttacgttacccgtttaggtacccgtttacgggg

SEQ ID NO: 108503 - DNA, 757 bp, Homo sapiens
  misc_feature: GYAE6OF02H175I.14.71.G05.1.454.CMB.1.raw
  modified_base (263)..(263): a, c, t, g, unknown or other
  misc_feature (263)..(263): n is a, c, g, or t
tcagcgtctagtaccacgaccggtgctcgatttagtgtcgtcgcaagagagaggggcccagccctgggattttcaggtgttttcattcggtgatcaggactgaacagagagaactcaccatggagtttgggctgagcgtggcttttcttagtggctattttaaaaggtgtgcagtgtgaggtgcagctgttggagtcgtgggggaggcttggtacagccgtggggggtccctgagactctcctgtgcagcctcgtgattcgtntttagcagctatgccatgagcgtgggctcgccacggctccgaggggagggctgggagtcgggttctcgtggcttacgttccgtgggtactaggttggtgtaattaacgtacgtaaaacttaccgtaacgccgaacgtacccgttaccgggtagggaaacggggttccccggtttactaacgtttcggtttacccgaggtaaacgtaaccttaattacccgaaaggaaacctaccaaccgttcgttaacttcccgttaggaacctaagtaacgtaccgaacccgtacggtacccgttaggaacggtaccggcccgggtaacggacccgtaaccggggtacccgtttaattaaccgttaccgttaggtacccggaacccggtaaaaccggtacccgttaaaagggtttacggtttttaacgggaaggttttaacggttttaactttaccgtttaaaccgtttttacggtacccggttttgggttaaccccgggggg

SEQ ID NO: 108504 - DNA, 335 bp, Homo sapiens
  misc_feature: GYAE6OF02JJRKP.14.71.G05.1.454.CMB.1.raw
  modified_base (225)..(225): a, c, t, g, unknown or other
  misc_feature (225)..(225): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (282)..(283): a, c, t, g, unknown or other
  misc_feature (282)..(283): n is a, c, g, or t
  modified_base (285)..(287): a, c, t, g, unknown or other
  misc_feature (285)..(287): n is a, c, g, or t
  modified_base (289)..(290): a, c, t, g, unknown or other
  misc_feature (289)..(290): n is a, c, g, or t
  modified_base (293)..(294): a, c, t, g, unknown or other
  misc_feature (293)..(294): n is a, c, g, or t
  modified_base (296)..(297): a, c, t, g, unknown or other
  misc_feature (296)..(297): n is a, c, g, or t
  modified_base (299)..(335): a, c, t, g, unknown or other
  misc_feature (299)..(335): n is a, c, g, or t
tcagcgtctagtaccacgaccggtgctcgatttagtgtcgtcgcaagagagagggggtcaggcactgatttcacactgaaaatcagcagggtggaggctgaggatgttggggtttattactgcatgcaagggacacactggcctccgggggacgttcggccaagggaccaaggtggaaatcaaacgactgtaggctgcaccatctgtctcatcctcccgccatcngagtactagacgctgagcgggctggcaagggccncaagtagntgcagcatcgtantnntnnntnntanncnntnnnnnnnnnnnnnnnnnnnnnnnnnnnnnnnnnnnnn

SEQ ID NO: 108505 - DNA, 795 bp, Homo sapiens
  misc_feature: GYAE6OF02I3WHH.14.71.G05.1.454.CMB.1.raw
tcagcgtctagtaccacgaccggtgctcgatttagtgtcgtcgcaagagagaggggcccagccctgggattttcaggtgttttcattcggtgatcaggactgaacagagagaactcaccatggagtttgggctgagctggcttttcttgtggctattttaaaaggtgtgcagtgtgaggtgcagctgttggagtcgtggggaggcgttggtacagccgtgggggtccctgagactctcctgtgcagcctctggattcgtctttagcagctatgcctagtgacgtcgtgggctcgccaggccgtccgaggggacgggcgtgggaggtcgggtctcgtcgtctacttccgtggtcgaggttggtcgtagttacgtacgaaataccgtaacgcaacgtaccgttccggtaggaaccggggtcccggtttacgtaccgtttcgtttacccgaaggtaacgtaaccgtaaacgtttacccgaaaacggaaaccctaaaccgtaccggtaacggttaccttaccgtacgtacccgtaaacgttaaacgtcccggtaaaccccgaaccgggttccgttaacgggaaccgggtacccgggttaaaccggggaaccggtaacccggtaaaccgggtaacccgtttaaagttaccgtttacggacggttaaccggaaacccggtaaacccgttaaaccggttaacggttttaagggtttttacgggttaacgggtttaacgggttttaactttaacccgttttacggtttaccggtacccggtttacggggttaacccccggggg

SEQ ID NO: 108506 - DNA, 265 bp, Homo sapiens
  misc_feature: GYAE6OF02GFEDI.14.71.G05.1.454.CMB.1.raw
  modified_base (263)..(265): a, c, t, g, unknown or other
  misc_feature (263)..(265): n is a, c, g, or t
tcagcgtctagtaccacgaccggtgctcgatttagtgtcgtcgcaagagagagggggtcaggcactgatttcacactgaaaatcagcagggtggaggctgaggatgttgggtttattactgcatgcaagggacacactggcctccgggggacgttcggccaagggaccaaggtggaaatcaaacgaactgtggctgcaccatctgtcttcatcttcccgccatctgagtactagacgctgagcgggctggcaaggcgcatagnnn

SEQ ID NO: 108507 - DNA, 665 bp, Homo sapiens
  misc_feature: GYAE6OF02FM78O.14.71.G05.1.454.CMB.1.raw
tcagcgtctagtaccacgaccggtgctcgatttagtgtcgtcgcaagagagaggggcccagccctgggattttcaggtgttttcattcggtgatcaggactgaacagagagaactcaccatggagtttgggctgagctggctttttcttgtggctattttaaaaggtgtgcagtgtgaggtgcagctgttggagtcgtgggggaggcttggtacaggccgtgggggtccctgagactctcctgtgcagcctcgtggattcgtctttagcagctatcgccatgagcgtgggctcgccaggctccgagggagggctgggagtgggtctgtgcttacttccgtggcgtaggtggtagatatacgaatacgtacgcagtaccgtcgtaggaacggggtcccgttacacgtttcgttaccgagtacgaaacgtacttaacccgaaagtaaccactactagttacttcgtagactagtaccgtgaacccgagtacccgaggacgacggtaccgggaacgggtaccgaccgggtaaccgttaagtttaacgttcgtcggtaggaacccggtaaaaccggtacccgttaaagggtttcgtttttaacgggtaagggtttacgtttaattttaaccgttaccggttttacggtaccgttcgggttacccggggg

SEQ ID NO: 108508 - DNA, 692 bp, Homo sapiens
  misc_feature: GYAE6OF02GBAH5.14.71.G05.1.454.CMB.1.raw
tcagcgtctagtaccacgaccggtgctcgatttagtgtcgtcgcaagagagaggagcccagccctgggattttcaggtgttttcattcggtgatcaggactgaacagagagaactcaccatggagtttgggctgagctggcttttcttgtggctattttaaaaggtgtgcagtgtgaggtgcagctgttggagtcgtgggggagcttggacagccgtgggggtccctgacgactctcctgtgcagcctcgtggtacttcgttctttagcacgctatcgaccatcgagtcgtcgggctaccggacgacggtcctaccggagggggaacggggcgtaggggagggttacggggtccttcggtcggtaccttacgttccggtcgggacgtaggttgggtacgtattacgttacgtaaacgttacgaccgtacgtacgtaccgttccgggtaaggaccgggtccgttacctacgtttccgttacgaggtaactaacctaacgttaccaaacgtaaccacgtactgtaactcgtagactagactacgaccctgaccgtgaacggaccgtaccggaacgtacccacggtaaccttaagttacttacgggcgtaaccgaaccggtaaccctggttaaagttttcgtttaggacggtttactttaacgttactttaccggtttacgtaccgttaccgggg

SEQ ID NO: 108509 - DNA, 765 bp, Homo sapiens
  misc_feature: GYAE6OF02G9EYS.14.71.G05.1.454.CMB.1.raw
  modified_base (205)..(205): a, c, t, g, unknown or other
  misc_feature (205)..(205): n is a, c, g, or t
  modified_base (269)..(269): a, c, t, g, unknown or other
  misc_feature (269)..(269): n is a, c, g, or t
  modified_base (573)..(573): a, c, t, g, unknown or other
  misc_feature (573)..(573): n is a, c, g, or t
tcagcgtctagtaccacgaccggtgctcgatttagtgtcgtcgcaagagagaggggcccagccctgggattttcaggtgttttcattcggtgatcaggactgaacagagagaacgtcaccatggagtttgggctgagctgcttttctgtggctatttaaaggtgtgctagtgtcgaggtgcagtctggttggagtcgtgggggancgtttagggtacaggccgtcggggggtccctaggacgacgtccttccgtgtcgcacgtcctcgnggtattcgttcttagcagtctatcgctagtgagccgttgggaccgtcggacctacggccgtacggaacgggggacgggtcggtagggtcggtgggttccgtacgtcgtaccgttaccgtttcccggtgggtacctaggtggtacgtaattaccggtacgtaaaccttacgtacgaccgtaggtaacccgttccggtaagggtacccgggtcggtttaccttaccgtttacggttaaccctagggtaaacgtaacgttaacgttaacccgaaaagaaccctacgtaacgttagtacttcgtacgngacacgtaaccgacgtcgtaccggtagacgtaaccgggcgtacgaccgtaacccggtgttaaccttagttacctcgggtaaaccggtaaccggtaaacccgtacggttaacgtttaacgggttttacggaaccggttttaagttacgtttaaccgtttccgtaccggtttacggtacccgggttaaccgggg

SEQ ID NO: 108510 - DNA, 799 bp, Homo sapiens
  misc_feature: GYAE6OF02F5UMO.14.71.G05.1.454.CMB.1.raw
  modified_base (175)..(175): a, c, t, g, unknown or other
  misc_feature (175)..(175): n is a, c, g, or t
  modified_base (565)..(565): a, c, t, g, unknown or other
  misc_feature (565)..(565): n is a, c, g, or t
  modified_base (792)..(792): a, c, t, g, unknown or other
  misc_feature (792)..(792): n is a, c, g, or t
tcagcgtctagtaccacgaccggtgctcgatttagtgtcgtcgcaagagagaggggcccagccttgggattttcaggtgttttcattcggtgatcaggactgaacagagagaactcaccatggaggtttggctgagctggtcgttttcttagtggcttaagttttaaaaggtgtncagtgtgtaggtgcagtctggttggagtcgtagggggagtcgttacggtactacggtccggttcggggggtacccctggtacgtaccgttcctcccgtaggttcggaccgtaacggtcccttaccggtaggttaacgtttccggttacttttacgacgtacggcttagtcgtaccgtagacggtacgtcgtcggtaccgtccgtaccggacggtaccgtacgggaacggggtaggtcggtagggtacgggtacggttcctgtaccggttaccgttacgttcgtaggtaccgtagggttgtaacgtacgttaacgtacgtaaactcccgaacgaccgtaaccggtacccgttacgggtacggtaaccggttccggtacccaccgtttaacncccggtaaccggtaaagtaccggtaacccttccgtaacccgggtaacgaccggtacgtaccggttataccggttacgtaacgaaccttaagtaccggaaacgtcggttaaccgagtaacggtccgaagtcggaacgtacgacggtacttagtaacgttcgacgtttacgaacggtaaccgtaggtacgtaccgggtaggtacctgggtcgtaccggccgggttccgngttaacg

SEQ ID NO: 108511 - DNA, 1028 bp, Homo sapiens
  misc_feature: GYAE6OF02I22SY.14.71.G05.1.454.CMB.1.raw
  modified_base (279)..(279): a, c, t, g, unknown or other
  misc_feature (279)..(279): n is a, c, g, or t
tcagcgtctagtaccacgaccggtgctcgattttagtgtcgtcgcaagagagaggagcccagcccctggggatttttcaggtgtttttcattcggtgatcaggactgaacagagagaactcaccatggagtttgggctgagctggtctttttcttgtggcttaagtttttaaaaggtgtgcagtgtgaggtgcagcgttggttggtagtcggtgggggaggtcgtttggtacgtaggccggttcggggggtccctggacgtacctccgttcgtgtcgcncgccttcggtggttactttccgtttcgtttacggtcagttcgttagtccgcctagtggtacggtacggtcgggtccgtcccggtacccgaacggggtcccgtaccggggaacggggggtaacgggggtccggttagggggtacggttcggggtacccgttcgttcggttaccgttttacgttcccggttgggtaaccggttagggttggttaacgttacttaacggttaaaccgtttaaacggttaccgtaaccggtaacgtaacccgttaacccggttaccgggttaacgggtaaccgggggtttaccccgggtttaaccgtaaccccggttttccgttaaaccggaaacggttaaacccgtaaccgttaaaaccttaaacccggaaaacgtaaaccccgttaaccgtacgttttaaaccggtaaacgttcccgttaacgggtaccggtaaaggttaaacccggaccgtaaacccgggtaaccgtacccccggttaggggaaacccggttacccggggaaaaccccgggacgggttaaacccggtccccgggttaaacgttaacccggttttttaacgttacccggttaggtaaaaccccgggaaccccgttaaaacccggtaaacccggttttaaaggttttaaacgggttttttaacgggttttaaccggtttaacgggtttttttaaacgttttaccccgggtttaaacgtttttcccggtttaaaccgggtttttcccgggggg

SEQ ID NO: 108512 - DNA, 667 bp, Homo sapiens
  misc_feature: GYAE6OF02GBXJI.14.71.G05.1.454.CMB.1.raw
  modified_base (207)..(207): a, c, t, g, unknown or other
  misc_feature (207)..(207): n is a, c, g, or t
  modified_base (390)..(390): a, c, t, g, unknown or other
  misc_feature (390)..(390): n is a, c, g, or t
  modified_base (514)..(514): a, c, t, g, unknown or other
  misc_feature (514)..(514): n is a, c, g, or t
tcagcgtctagtaccacgaccggtgctcgatttagtgtcgtcgcaagagagaggggcccagccctgggattttcaggtgttttcattcggtgatcaggactgaacagagagaactcaccatggagtttgggctgagcgtgtcgtttctagtggctaagtttaaaggtgtgcagtgtgagtgcagctgttgacgtcgtaggggtcgtnttggtacacggccggtcgggggtccctgaagtcctccgtactcgtgcgacgtccctgtacgtctttcccggttatttacgccgaaggtctacgtcgacctagtcgagtcggtcggtccgtccgacggcgtccgacggaagggtcggaacggtcgggtaggtcggcttgtcgtcgttacttcgnggtacgtacggtggtatacgttactacgtaacttacgccgtagaactcgtccggtaggaccggtcgtacgtcgtagttccgaaggactacgtaactacgaaacgaacctatactacgtttaccncacgtaactagtaaccgtacgacgcgtacgacggtaccgaccggaccggtaacgaccggtactacgttagtaacgtcgtacgacgtacgtacgtacgttacgttgttagtacgttacgttagttaccttcggtttactaccggttaggtccgg

SEQ ID NO: 108513 - DNA, 256 bp, Homo sapiens
  misc_feature: GYAE6OF01EN57N.16.38.D05.1.454.CMB.1.raw
  modified_base (256)..(256): a, c, t, g, unknown or other
  misc_feature (256)..(256): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacacttttggccaggggaccaagctggagatcaaacgaactgtggctgcaccatctgtcttcatcttcccgccatctgagagtagtacactgagcgggctggcaaggcgcatagn

SEQ ID NO: 108514 - DNA, 256 bp, Homo sapiens
  misc_feature: GYAE6OF01ALLPG.16.38.D05.1.454.CMB.1.raw
  modified_base (255)..(256): a, c, t, g, unknown or other
  misc_feature (255)..(256): n is a, c, g, or t
tcagtgtactactccacgaccggtgctcgatttagtatctgatagttgggtttgggacagacttcactctcaccatcagcaccctgcagtctgaggatttgcaatttattattgtcagcagtataattactggcctccgtacacttttggccaggggaccaagctggagatcaaacgaactgtggctgcaccatctgtcttcatcttcccgccatctgagagtagtacactgagcgggctggcaaggcgcatagnn

SEQ ID NO: 108515 - DNA, 502 bp, Homo sapiens
  misc_feature: GYAE6OF01CI8Y9.16.38.D05.1.454.CMB.1.raw
  modified_base (202)..(202): a, c, t, g, unknown or other
  misc_feature (202)..(202): n is a, c, g, or t
  modified_base (496)..(496): a, c, t, g, unknown or other
  misc_feature (496)..(496): n is a, c, g, or t
tcagtgtactactccacgaccggtgctcgatttagtatctgatagttgggtttggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccacctctcctgcagggccagtcagagtgttgccaccaatttagcctggtaccagcaaaacctggccaggctcccaggctcctcatctatggtgcatctaccagggccactgatgtcccaggccggttcagtggcagtgggtttgggacagacttcactctcaccatcagcaccctgcagtctgaggattttgcaatttatattgtcagcagtataattactggcctcgtacacttttggcctaggggaccaagctggagatcaaacgactgtggctgcaccatctgtcttnagttcc

SEQ ID NO: 108516 - DNA, 258 bp, Homo sapiens
  misc_feature: GYAE6OF01DG28Q.16.38.D05.1.454.CMB.1.raw
  modified_base (256)..(258): a, c, t, g, unknown or other
  misc_feature (256)..(258): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactgtcctccgtacacttttggccaggggaccaagctggagatcaaacgaactgtggctgcaccatctgtcttcatcttcccgccatctgagagtagtacactgagcgggctggcaaggcgcatagnnn

SEQ ID NO: 108517 - DNA, 257 bp, Homo sapiens
  misc_feature: GYAE6OF01EAXUF.16.38.D05.1.454.CMB.1.raw
  modified_base (256)..(257): a, c, t, g, unknown or other
  misc_feature (256)..(257): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacacttttggccaggggaccaagctggagatcaaacgaactgtggctgcaccatctgtcttcatcttcccgccatctgagagtagtacactgagcgggctggcaaggcgcatagnn

SEQ ID NO: 108518 - DNA, 259 bp, Homo sapiens
  misc_feature: GYAE6OF01C4F5O.16.38.D05.1.454.CMB.1.raw
  modified_base (256)..(258): a, c, t, g, unknown or other
  misc_feature (256)..(258): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacacttttggccaggggaccaagctggagatcaaacgaactgtggctgcaccatctgtcttcatcttcccgccatctgagagtagtacactgagcgggctggcaaggcgcatagnnnc

SEQ ID NO: 108519 - DNA, 257 bp, Homo sapiens
  misc_feature: GYAE6OF01CJA8S.16.38.D05.1.454.CMB.1.raw
  modified_base (255)..(257): a, c, t, g, unknown or other
  misc_feature (255)..(257): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacacttttggccaggggaccaagctggagatcaaacgactgtggctgcaccatctgtcttcatcttcccgccatctgagagtagtacactgagcgggctggcaaggcgcatagnnn

SEQ ID NO: 108520 - DNA, 257 bp, Homo sapiens
  misc_feature: GYAE6OF01C70BO.16.38.D05.1.454.CMB.1.raw
  modified_base (255)..(257): a, c, t, g, unknown or other
  misc_feature (255)..(257): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacacttttggccaggggaccaagctggagatcaaacgaactgtggctgcaccatctgtcttcatcttcccgcatctgagagtagtacactgagcgggctggcaaggcgcatagnnn

SEQ ID NO: 108521 - DNA, 512 bp, Homo sapiens
  misc_feature: GYAE6OF01B97IT.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagcaaaaacctggccaggctcccaggctcctcatctatggtgcatctaccagggccactgatgtcccaggccggttcagtggcaggtgggtttgggacagacttcactctcaccatcagcacctgcagtctgagtattttgctaatttattattgtcagtcagtataattactggcctccgtactacttttggcctagggaccaagctggagatacaaacgtactgtaggctgcacatctgtcttcgattccg

SEQ ID NO: 108522 - DNA, 269 bp, Homo sapiens
  misc_feature: GYAE6OF01EL5VJ.16.38.D05.1.454.CMB.1.raw
  modified_base (258)..(269): a, c, t, g, unknown or other
  misc_feature (258)..(269): n is a, c, g, or t
tcagtgtactactccacgaccggtgctcgatttagtatctgatagttgggtttgggacgagacttcactctcaccatcagcaccctgcagtctgaggatttgcaatttattattgtcagcagtataattactggcctccgtacacttttggccaggggaccaagctggagatcaaacgaactgtggctgcaccatctgtcttcatcttcccgccatctgagagtacgtacactgagcgggctggcaaggcgcgatagnnnnnnnnnnnn

SEQ ID NO: 108523 - DNA, 259 bp, Homo sapiens
  misc_feature: GYAE6OF01EJXKZ.16.38.D05.1.454.CMB.1.raw
  modified_base (256)..(259): a, c, t, g, unknown or other
  misc_feature (256)..(259): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacacttttggccaggggaccaagctggagatcaaacgaactgtggctgcaccatctgtcttcatcttcccgccatctgagagtagtacactgagcgggctggcaaggcgcatagnnnn

SEQ ID NO: 108524 - DNA, 278 bp, Homo sapiens
  misc_feature: GYAE6OF01DYKU4.16.38.D05.1.454.CMB.1.raw
  modified_base (255)..(278): a, c, t, g, unknown or other
  misc_feature (255)..(278): n is a, c, g, or t
tcagtgtactactccacgaccggtgctcgatttagtatctgatagttgggtttgggacagacgttcactctcaccatcagcaccctgcagtctgaggatttgcaatttattattgtcagcagtataattactggcctccgtacacttttggccagggaccaagctggagatcaaacgaactgtggctgcaccatctgtcttcatcttcccgccatctgagagtagtacactgagcgggctggcaaggcgcatagnnnnnnnnnnnnnnnnnnnnnnnn

SEQ ID NO: 108525 - DNA, 542 bp, Homo sapiens
  misc_feature: GYAE6OF01CEH0Z.16.38.D05.1.454.CMB.1.raw
  modified_base (203)..(203): a, c, t, g, unknown or other
  misc_feature (203)..(203): n is a, c, g, or t
  modified_base (404)..(404): a, c, t, g, unknown or other
  misc_feature (404)..(404): n is a, c, g, or t
  modified_base (534)..(534): a, c, t, g, unknown or other
  misc_feature (534)..(534): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagacaaaacctggccaggctcccaggcctcctcatctatggtgcatcctaccagggccactgatcgtccccaggtccggttcaggtggcgtaggtgggtttgggacagacttcactctcaccatcagcaccctgcagtctgagtnttttgctaatttatattgtcagtctaagttataattactggccttacgtactacgttttggccgtaggggacctagcgtaggagactacgaaacgactggtaggctgacaaccgtattcctgttccttcncgttcccg

SEQ ID NO: 108526 - DNA, 257 bp, Homo sapiens; identical to SEQ ID NO: 108517
  misc_feature: GYAE6OF01A6AJX.16.38.D05.1.454.CMB.1.raw
  modified_base (256)..(257): a, c, t, g, unknown or other
  misc_feature (256)..(257): n is a, c, g, or t

SEQ ID NO: 108527 - DNA, 270 bp, Homo sapiens
  misc_feature: GYAE6OF01BLXEQ.16.38.D05.1.454.CMB.1.raw
  modified_base (259)..(270): a, c, t, g, unknown or other
  misc_feature (259)..(270): n is a, c, g, or t
tcagtgtactactccacgaccggtgctcgatttagtatctgatagttgggtttggggacagacttcactctcaccatcagcaccctgccagtctgaggattttgcaatttattattgtcagcagtataattactggcctccgtacacttttggccaggggaccaagctggagatcaaacgaactgtggctgcaccagtctgtcttcatcttcccgccatctgagagtagtacactgagcgggctggcaaggcgcatagnnnnnnnnnnnn

SEQ ID NO: 108528 - DNA, 554 bp, Homo sapiens
  misc_feature: GYAE6OF01CVNWY.16.38.D05.1.454.CMB.1.raw
  modified_base (122)..(122): a, c, t, g, unknown or other
  misc_feature (122)..(122): n is a, c, g, or t
  modified_base (126)..(127): a, c, t, g, unknown or other
  misc_feature (126)..(127): n is a, c, g, or t
  modified_base (132)..(132): a, c, t, g, unknown or other
  misc_feature (132)..(132): n is a, c, g, or t
  modified_base (137)..(137): a, c, t, g, unknown or other
  misc_feature (137)..(137): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
tcagtgtactactccacgaccggtgctcgatttagtatctgatagttgggtttgggctcaactctcttgtctcaccatggagtttgggctgagcggtgtttcgctaagcttagagtgcatgnagtnnagtgngatcnggggagcgtgccagcctggaaggtcctgagctctcgtgtgcagcgtctggattcatctttaatgttttccatgcatgatccgcaggctcaggcagggctggagtgggcgagagagtgtcactgatggagcaatacatactcgcagactccgtgaaggcgactcaccattccagagagatacaacaacacgcncncatntnacanacgacacctacgacgacgacgacgacgacgtcgtcgtactacttacgtgtgtgtacgtacttacttagttcgttcggttcggttcgttacgtacgttacggtacgggtcggtacggtacgtccgtccggtccgtaccgtccgtcccgtccgtccgtcccgtacccgacccgtaaccggacccgtaccgttcccgttccccgttccccgtcccg

SEQ ID NO: 108529 - DNA, 256 bp, Homo sapiens; identical to SEQ ID NO: 108513
  misc_feature: GYAE6OF01D90W8.16.38.D05.1.454.CMB.1.raw
  modified_base (256)..(256): a, c, t, g, unknown or other
  misc_feature (256)..(256): n is a, c, g, or t

SEQ ID NO: 108530 - DNA, 272 bp, Homo sapiens
  misc_feature: GYAE6OF01C5HXK.16.38.D05.1.454.CMB.1.raw
  modified_base (254)..(272): a, c, t, g, unknown or other
  misc_feature (254)..(272): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacacttttggccaggggaccaagctggagatcaaacgactgtggctgcaccatctgtcttcatcttcccgcatctgagagtagtacactgagcgggctggcaaggcgcatagnnnnnnnnnnnnnnnnnnn

SEQ ID NO: 108531 - DNA, 528 bp, Homo sapiens
  misc_feature: GYAE6OF01C17WM.16.38.D05.1.454.CMB.1.raw
  modified_base (203)..(203): a, c, t, g, unknown or other
  misc_feature (203)..(203): n is a, c, g, or t
  modified_base (520)..(520): a, c, t, g, unknown or other
  misc_feature (520)..(520): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccacctctcctgcagggccagtcagagtgttgccaccaatttagcctggtaccagcaaaacctggccaggctcccaggctcctcatctatggtgcatctaccagggccactgatcgcccaggccggttcagtggcaggtgggtttgggacagacttcgactctcaccatcagcaccctgcagtctgaggtattttgactaattttattattgtcagctagttataattactgtccttaccgtactacgttttggaccgtaggggaccagcgtaggtagagtacaaacgtactgtggctgcacgtatctgtccttntcgttccc

SEQ ID NO: 108532 - DNA, 511 bp, Homo sapiens
  misc_feature: GYAE6OF01CFPKX.16.38.D05.1.454.CMB.1.raw
  modified_base (203)..(203): a, c, t, g, unknown or other
  misc_feature (203)..(203): n is a, c, g, or t
  modified_base (501)..(501): a, c, t, g, unknown or other
  misc_feature (501)..(501): n is a, c, g, or t
  modified_base (506)..(507): a, c, t, g, unknown or other
  misc_feature (506)..(507): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagcaaaaacctggccaggctcccaggctcctcatctatggtgcatctaccagggccactgatgtcccaggccggttcagtggcagtgggtttgggacagacttcactctcaccatcagcaccctgcagtctgaggtattttgctaatttattattgtcagtcagtataattactggtcctccgtactacttttggcctaggggaccagctggagatacaaacgactgtggctgcaccatctntcttnntccc

SEQ ID NO: 108533 - DNA, 513 bp, Homo sapiens
  misc_feature: GYAE6OF01B5Y1S.16.38.D05.1.454.CMB.1.raw
  modified_base (203)..(203): a, c, t, g, unknown or other
  misc_feature (203)..(203): n is a, c, g, or t
  modified_base (473)..(473): a, c, t, g, unknown or other
  misc_feature (473)..(473): n is a, c, g, or t
  modified_base (491)..(491): a, c, t, g, unknown or other
  misc_feature (491)..(491): n is a, c, g, or t
  modified_base (507)..(507): a, c, t, g, unknown or other
  misc_feature (507)..(507): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagacaaaaacctggccaggctcccaggctcctcatctatggtgcatctaccagggccactgatcgtcccaggccggttcagtggcaggtgggtttgggacagacttcactctcaccatcagccaccctgcagtctgacggtattttgactaattttattattgtcagcagtataattactgtcctcgtactcgtttgccagggaccagctgganatacaaacgactggtgcngcaccatctgtcttgnttcccg

SEQ ID NO: 108534 - DNA, 620 bp, Homo sapiens
  misc_feature: GYAE6OF01CKS8T.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagacaaaaacctggccaggctcccaggctcctcatctatggtgcatctaccagggccactgatcgtcccaggccggttcagtggctaggtgggtttgggacagacttcactctcacatcagcaccctgcagtctgaggtattttgactaatttattattgtactagtctaagttaattaatttaacgtcggtcccttaccgttaactaccgtttttcggacccgtaacgggggaaccctaaggtccgttaagggaacgtaacgtaacccgtaaaaacggtaaaccgttgggtacgggtccttacggaaccctaacccgtaactttccgttaggtttccctttccgtaacttttccccccgg

SEQ ID NO: 108535 - DNA, 173 bp, Homo sapiens
  misc_feature: GYAE6OF01ANPJ9.16.38.D05.1.454.CMB.1.raw
  modified_base (173)..(173): a, c, t, g, unknown or other
  misc_feature (173)..(173): n is a, c, g, or t
tcagtgtactactccacgaccggtgctcgatttagtatctgatagttgggtttgggggaagaggaagactgacggtcccccaggagttcaggtgctgggcacagcggccctgggctgcctggtcaaggactacttccgagtagtacactgagcgggctggcaaggcgcatagn

SEQ ID NO: 108536 - DNA, 510 bp, Homo sapiens
  misc_feature: GYAE6OF01COF7T.16.38.D05.1.454.CMB.1.raw
  modified_base (204)..(204): a, c, t, g, unknown or other
  misc_feature (204)..(204): n is a, c, g, or t
  modified_base (503)..(504): a, c, t, g, unknown or other
  misc_feature (503)..(504): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaancgccaccctctcctgcagggccagtcagagtgttgccacaattagcctggtaccagcaaaaacctggccaggctcccaggctcctcatcctatggtgcatctaccagggccactgatcgtcccaggccggttcagtggcagtgggttgggacagacttcactctcacatcagcacctgcagtctagaggtattttgactaatttattattgtcagctagtataattactgcctcgtactacgtttggcctagggaccagcgtggatactcaaacgacgtgtggctgcactatctgtctnnttcccg

SEQ ID NO: 108537 - DNA, 258 bp, Homo sapiens
  misc_feature: GYAE6OF01BF4PA.16.38.D05.1.454.CMB.1.raw
  modified_base (255)..(258): a, c, t, g, unknown or other
  misc_feature (255)..(258): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacacttttggccaggggaccaagctggagatcaaacgaactgtggctgcaccatctgtcttcatcttcccgcatctgagagtagtacactgagcgggctggcaaggcgcatagnnnn

SEQ ID NO: 108538 - DNA, 524 bp, Homo sapiens
  misc_feature: GYAE6OF01BEATR.16.38.D05.1.454.CMB.1.raw
  modified_base (518)..(518): a, c, t, g, unknown or other
  misc_feature (518)..(518): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctcccaggctcctcatctatggtgcatctaccagggccactgatgtcccaggccggttcaggtggcaggtgggtttgggacagacttcactctcaccatcagccaccctgcagtctggtaggtattttgctaatttattattgtcagctagtattaattactggtcctccgtactacgttttggcctaggggaccaggctggatatacgaaacgactggtggctgccaccatctgtcttcnttcccg

SEQ ID NO: 108539 - DNA, 543 bp, Homo sapiens
  misc_feature: GYAE6OF01BFGAC.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcaggagtgtcacttgatggagccaatacatacttcgcagactccgtgaagggccgattcaccatttccagagagaattccaacaacacgctgcatctgcaaatggacaccctgagacctgacgacacggctgtctattactgtgtgagactcttattgcgttcgggctttgacttacgtggggccagggactcccgtcggtccacccgtctccctcacgccctacccacccgaacgggccccagtccggttccttcccccgtcgg

SEQ ID NO: 108540 - DNA, 535 bp, Homo sapiens
  misc_feature: GYAE6OF01BYZAO.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagcaaaaacctggccaggctcccaggctcctcatctatggtgcatctaccagggccactgatgtcccaggccgttcagtggcagtgggtttgggacagacttcactctcaccatcagcaccctgcagtctgaggtattttgctaattttattattgtcagcagttataattactggccttaccgtactacgttttggacctaggggacctaagcctaggaacgataccgaaacggtactggtaggctaggcaccgtatcttgtccttcgattcccg

SEQ ID NO: 108541 - DNA, 515 bp, Homo sapiens
  misc_feature: GYAE6OF01BZQU9.16.38.D05.1.454.CMB.1.raw
  modified_base (203)..(203): a, c, t, g, unknown or other
  misc_feature (203)..(203): n is a, c, g, or t
  modified_base (509)..(509): a, c, t, g, unknown or other
  misc_feature (509)..(509): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagcaaaacctggccaggctcccaggctcctcatctatggtgcatctaccagggccactgatgtcccaggccggttcagtggcagtgggtttgggacagacgttcactctcaccatcagcaccctgcagtctgaggtattttgactaattttatattgtcagtcagtatatactgcctacgtactactttggacctagggaccagctggagtactacaacggtactggtgctgcacctatctagtcttctnttcccg

SEQ ID NO: 108542 - DNA, 257 bp, Homo sapiens; identical to SEQ ID NO: 108517
  misc_feature: GYAE6OF01AY5EQ.16.38.D05.1.454.CMB.1.raw
  modified_base (256)..(257): a, c, t, g, unknown or other
  misc_feature (256)..(257): n is a, c, g, or t

SEQ ID NO: 108543 - DNA, 493 bp, Homo sapiens
  misc_feature: GYAE6OF01CBCH9.16.38.D05.1.454.CMB.1.raw
  modified_base (203)..(203): a, c, t, g, unknown or other
  misc_feature (203)..(203): n is a, c, g, or t
  modified_base (390)..(390): a, c, t, g, unknown or other
  misc_feature (390)..(390): n is a, c, g, or t
  modified_base (410)..(410): a, c, t, g, unknown or other
  misc_feature (410)..(410): n is a, c, g, or t
  modified_base (458)..(458): a, c, t, g, unknown or other
  misc_feature (458)..(458): n is a, c, g, or t
  modified_base (470)..(470): a, c, t, g, unknown or other
  misc_feature (470)..(470): n is a, c, g, or t
  modified_base (474)..(475): a, c, t, g, unknown or other
  misc_feature (474)..(475): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgtgccacaatttagcctggtaccagcaaaacctggccaggctcccaggctcctcatctatggtgcatctaccagggccactgatgtcccaggccgttcagtgcaggtgggtttgggacagacttcactctcacatcagcaccctgcagtctgaggnttttgctaatttatattgtnagcagtatattactggcctcgtatacgttttgcagggaccagctgagntacaaacgatgnggcnncacatctntctnattccg

SEQ ID NO: 108544 - DNA, 557 bp, Homo sapiens
  misc_feature: GYAE6OF01DG794.16.38.D05.1.454.CMB.1.raw
  modified_base (201)..(201): a, c, t, g, unknown or other
  misc_feature (201)..(201): n is a, c, g, or t
  modified_base (551)..(551): a, c, t, g, unknown or other
  misc_feature (551)..(551): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctcaggggaancgccacctctcctgcagggccagtcagagtgttgccaccaatttagcctggtaccagacaaaactggccaggctcccaggctcctcatctatggtgcatcctaccacgggccactgactcgtccccgaggtcccggttcgaggtcggcgtagggttggggtttcgggacaggtacttcgactctcacctatcagcaccctgcagtctagtaggtattttgacttaattttattattgtactagctagtattaattcgtggtccttaccgtactacgttttcggaccgtagggtaaccaggtctaggatacgtacgtaaacgacttggaggctagcactatctagtcttcnttcccg

SEQ ID NO: 108545 - DNA, 512 bp, Homo sapiens
  misc_feature: GYAE6OF01BV3JP.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagcaaaaacctggccaggctcccaggctcctcatctatggtgcatctaccagggccactgatgtcccaggccgttcagtggcagtgggtttggacagacttcactctcaccatcagcacctgcagtctgaggtatttgctaatttattattgtcagtcagtataattactggcctaccgtacacttttggcctaggggaccaagctggagatacaaacgtaactgtggctgcactatctagtcttcgattccc

SEQ ID NO: 108546 - DNA, 190 bp, Homo sapiens
  misc_feature: GYAE6OF01B5J38.16.38.D05.1.454.CMB.1.raw
  modified_base (176)..(190): a, c, t, g, unknown or other
  misc_feature (176)..(190): n is a, c, g, or t
tcagtgtactactccacgaccggtgctcgatttagtatctgatagttgggtttggggggaagaggaagactgacggtccccccaggacgttcaggtgctgggcacagcggccctgggctgcctggtcaaggactacttccgagtagtacactgagcgggctggcaaggcgcatagnnnnnnnnnnnnnnn

SEQ ID NO: 108547 - DNA, 511 bp, Homo sapiens
  misc_feature: GYAE6OF01A2GJS.16.38.D05.1.454.CMB.1.raw
  modified_base (506)..(507): a, c, t, g, unknown or other
  misc_feature (506)..(507): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctcccaggctcctcatctatggtgcatctaccagggccactgatgtcccaggccggttcagtggcaggtgggtttgggacagacttcactctcaccatcagcaccctgcagtctgaggtattttgctaattttattattgtcagctagtataattactggtcctaccgtactacttttggccaggggaccagctggagatcaaacgactgtaggctgcacatctgtctnntccg

SEQ ID NO: 108548 - DNA, 539 bp, Homo sapiens
  misc_feature: GYAE6OF01DXPK3.16.38.D05.1.454.CMB.1.raw
  modified_base (438)..(438): a, c, t, g, unknown or other
  misc_feature (438)..(438): n is a, c, g, or t
  modified_base (502)..(502): a, c, t, g, unknown or other
  misc_feature (502)..(502): n is a, c, g, or t
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcattctttaatagttttcctatgcactggatccgcaggctccaggcaggggactggagtgggtggcaggagtgtcacttgatggagccaatacatacttcgcagactccgtgaagggccgattcacctatttccaagagagaacttccaaacaacacgctgcatctgacaaatcgacaccctgacgacctgacgacacggctgtctattactgtcgtgagtactnttattgtacgttcggtctttgacttacgtgggccgaggactcccgtggtcctaccgtctcctcncgcctccaccgacggcccatccggtccctccccgtcg

SEQ ID NO: 108549 - DNA, 531 bp, Homo sapiens
  misc_feature: GYAE6OF01CWPT2.16.38.D05.1.454.CMB.1.raw
  modified_base (203)..(203): a, c, t, g, unknown or other
  misc_feature (203)..(203): n is a, c, g, or t
  modified_base (330)..(330): a, c, t, g, unknown or other
  misc_feature (330)..(330): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccacctctcctgcagggccagtcagagtgttgccacaatttagcctggtaccagcaaaacctggccaggctccaggctcctcatctatggtgcatctacagggccactgatgtcccaggccgttnagtggcaggtgggttggacagacttcactctcaccatcagcaccctgcagtctgaaggtattttgactaatttattattgtctagctagttatattactggtacctacgtactacgttttcggctacggggaccaggtctaggagactacaaacggacttggtaggctagacctacgtattctagttcttcgtgttccccg

SEQ ID NO: 108550 - DNA, 598 bp, Homo sapiens
  misc_feature: GYAE6OF01DX597.16.38.D05.1.454.CMB.1.raw
  modified_base (203)..(203): a, c, t, g, unknown or other
  misc_feature (203)..(203): n is a, c, g, or t
  modified_base (575)..(575): a, c, t, g, unknown or other
  misc_feature (575)..(575): n is a, c, g, or t
  modified_base (581)..(581): a, c, t, g, unknown or other
  misc_feature (581)..(581): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaancgccaccctctcctgcagggccagtcagagtgttcgccacctaatttacgccgtggtaccagaccaaaaacctggaccaggcctcccaggctcctcatctatggtgctatctaccgagggccacgtgactcgtccccgaggtccggttcaggtggcgagggttggggtttagggacgtagtacttcacttcgtacacctatccacgccaccctgctagtctaggtgtattttgacttaattttattatttgtactagtactagttaacttaatttaccgtcggtcccttacgttacgttacgttttcggaccgtacggggtacctagtcgtaggagactaacgaaacgtacgtggtcggtctcgacaccgtnttcgtnttccttcacgttccccg

SEQ ID NO: 108551 - DNA, 605 bp, Homo sapiens
  misc_feature: GYAE6OF01CWCVA.16.38.D05.1.454.CMB.1.raw
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (409)..(409): a, c, t, g, unknown or other
  misc_feature (409)..(409): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagngtgtgccacaatttagcctggtaccagcaaaaacctggccaggctcccaggctcctcatctatggtgcatctaccagggccactgatgtcccaggccggttcagtggcaggtgggtttggacagacttcactctcaccatcagcacctgcagtctgaggtattttgactaaattttnttatttgtcagtctaagttaataactttacgtcggtcccttaccgttaactacgtttttcgggaccgtaacgggggtaaccctaaggtccgtagggagaacgttaccgaaaaccggtaacgttggtacgggtcctacgggtaccctaacccgtacgtttacccgttaggtttaccctttccgtacgtttacccccg

SEQ ID NO: 108552 - DNA, 596 bp, Homo sapiens
  misc_feature: GYAE6OF01EB8IV.16.38.D05.1.454.CMB.1.raw
  modified_base (572)..(572): a, c, t, g, unknown or other
  misc_feature (572)..(572): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagtgccaccctctcctgcagggccagtcagagtgttgccacaatttagcctggtaccagacaaaacctggccagctcccaggctcctcatctatggtgcatcctaccgagggccacgtgatcgtcccgagggtccggttcacggtggcgtaggtggggtttgggactaggtacttcactctaccacctatccagcccaacccgtcgactacgtcgtaggtaggtattttagacttaatttatttatttgtactagtctaagttaattaattaccgtcggtacccttaccgtacgttacgttttcgggaccgtacggggacctacggcgtaggagtactaaccgaaacggtactggtcggctacgaccactnttcgttagttccttcgtcttcccg

SEQ ID NO: 108553 - DNA, 284 bp, Homo sapiens
  misc_feature: GYAE6OF01D530Z.16.38.D05.1.454.CMB.1.raw
  modified_base (274)..(284): a, c, t, g, unknown or other
  misc_feature (274)..(284): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggccctcgtactactttggccgagggaccaagcgtggagatacaaacgaactggtggctgcaccatctgttcttcatccttcccgactatctagagtagtacgtacacgtgaggcgggctggacgaagggccgctaagtagnnnnnnnnnnn

SEQ ID NO: 108554 - DNA, 705 bp, Homo sapiens
  misc_feature: GYAE6OF01B41IF.16.38.D05.1.454.CMB.1.raw
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaagcgccaccctctcctgcagggccagtcagagtgttgccacctaatttagcctggtaccagcaaaaacctggccaggcctccaggctcctcatctagtggtgctatcctaccgacgggccactgaactcggtacccgtagggtcccggttacgaggtcggcgtagggttgggggtttacggggaactaggtaccttacgacttcctaccgaacctattaccgacgaccctaacccgtgaccgtaggttccgtagggtaagggtttattttacgtaacgtttaaatttttaagtttagtttcggtactaagtactaaggttaatttaacgtttaacgtcggtacccgttaccggttaaccgtttacggtttttaccggacccgggtaacggggtaaccctaggtccggtaacgggtaagtaacgtaaaccggaaaacgttaacgttgggtacggtacgttacgacctaacgtacttccgttagtttcctcgtacgtttaccccg

SEQ ID NO: 108555 - DNA, 242 bp, Homo sapiens
  misc_feature: GYAE6OF01DCQ25.16.38.D05.1.454.CMB.1.raw
  modified_base (230)..(242): a, c, t, g, unknown or other
  misc_feature (230)..(242): n is a, c, g, or t
tcagtgtactactccacgaccggtgctcgatttagtatctgatagttgggtttgggcagagctcgtggggaggaactgctcagttaggacccagacggaaccatggaagccccagcgcagcttctcttcctcctgctactctggctcccaggaactgtggctgcaccatctgtcttcatcttcccgcatctgaagtagtacactgagcgggctgggcaaggcgtcatagnnnnnnnnnnnnn

SEQ ID NO: 108556 - DNA, 531 bp, Homo sapiens
  misc_feature: GYAE6OF01BLADA.16.38.D05.1.454.CMB.1.raw
  modified_base (203)..(203): a, c, t, g, unknown or other
  misc_feature (203)..(203): n is a, c, g, or t
  modified_base (424)..(424): a, c, t, g, unknown or other
  misc_feature (424)..(424): n is a, c, g, or t
  modified_base (483)..(483): a, c, t, g, unknown or other
  misc_feature (483)..(483): n is a, c, g, or t
  modified_base (501)..(501): a, c, t, g, unknown or other
  misc_feature (501)..(501): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccacaatttagcctggtaccagcaaaaacctggccaggctcccaggctctcatctatggtgcatctaccagggccactgatcgtcccaggccggttcagtggcaggtgggtttgggacagacttcactctcacatcagcacctgcagtctgaggtatttgactaatttatattgtcagtctaagtnttaattactggccttaccgtactaacgttttggacctaggggaccctaagccttagganatacgaaacgacttaggnggctgacactatctagtccttgacttcccg

SEQ ID NO: 108557 - DNA, 517 bp, Homo sapiens
  misc_feature: GYAE6OF01ARKEY.16.38.D05.1.454.CMB.1.raw
  modified_base (203)..(203): a, c, t, g, unknown or other
  misc_feature (203)..(203): n is a, c, g, or t
  modified_base (511)..(511): a, c, t, g, unknown or other
  misc_feature (511)..(511): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccacctctcctgcagggccagtcagagtgttgccaccaatttagcctggtaccagcaaaacctggccaggctcccaggctcctcatctatggtgcatctaccagggccactgatgtcccaggccggttcagtggcagtgggtttgggacaggacttcactctcaccatcagcaccctgcagtctgaggtatttgctaatttatattgtcagctagtataattactggcctcgtactactttggcctaggggacccagccgtggagactacgaaacgacgtgtggtctgccactattctagtcttcnttcccg

SEQ ID NO: 108558 - DNA, 260 bp, Homo sapiens
  misc_feature: GYAE6OF01BHKL0.16.38.D05.1.454.CMB.1.raw
  modified_base (256)..(260): a, c, t, g, unknown or other
  misc_feature (256)..(260): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacacttttggccaggggaccaagctggagatcaaacgaactgtggctgcaccatctgtcttcatcttcccgccatctgagagtagtacactgagcgggctggcaaggcgcatagnnnnn

SEQ ID NO: 108559 - DNA, 566 bp, Homo sapiens
  misc_feature: GYAE6OF01BROXY.16.38.D05.1.454.CMB.1.raw
  modified_base (203)..(203): a, c, t, g, unknown or other
  misc_feature (203)..(203): n is a, c, g, or t
  modified_base (560)..(560): a, c, t, g, unknown or other
  misc_feature (560)..(560): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccacaatttagcctggtaccagacaaaacctggccaggctccagctcctcatctatggtgcatctaccagggccactgatcgtcccgaggtccggttcaggtggcgtaggttggggtttgggacagtacttcactctcaccatcagccaccctgctagtctgacggtatttacgacttaatttatttattgtctagtactagttaacttaattacgtcggtacccttcgttacgtacgttttcgggaccgtacggggacctagtcgtaggacgtactacgaaacgtacgtgtggctcgactaccgtatccttagtccttgtnttcccg

SEQ ID NO: 108560 - DNA, 607 bp, Homo sapiens
  misc_feature: GYAE6OF01BWZRA.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagacaaaacctggccaggctcccaggctcctcatctatggtgcatctaccagggccactgatcgtcccaggccggttcaggtggcgtaggttggggtttgggactagtacttcactctcaccatcagccaccctgcagtctgtagtatttgcttaattttattatttgtcagtctagttattaattacgtcggtcccttaccgttacttacgtttttcgggaccgtaacggggacctaacggtcgttagggtaacgtaacgtaccgaaaaccggtacgttgggtacggtccgttacgaccctaacccgtacgttaccgttacgtttccctttccgtaccgtttccccg

SEQ ID NO: 108561 - DNA, 523 bp, Homo sapiens
  misc_feature: GYAE6OF01DY3NN.16.38.D05.1.454.CMB.1.raw
tcagtgtactactccacgaccggtgctcgatttagtatctgatagttgggtttggggctgggagacgagcccagcactggaagtcgccggtgtttccattcggtgatcagcactgaatacagaggactcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcattctttaatagttttcctatgcactggatccgccaggctccagggcagggggactgggagtgggtggcagggagtgtcacttgatgggagccaatacatactcgcagactcgtgaaggccgattcaccattccagagagaacttaccaacaacacgctgcatctagacaaatggaccaccctgacgacctgacgacacggctgtctattactgtgtgagacttcttagttgtacgttgggtctttgctacgg

SEQ ID NO: 108562 - DNA, 255 bp, Homo sapiens
  misc_feature: GYAE6OF01CXLMR.16.38.D05.1.454.CMB.1.raw
  modified_base (254)..(255): a, c, t, g, unknown or other
  misc_feature (254)..(255): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacacttttggccaggggaccaagctggagatcaaacgactgtggctgcaccatctgtcttcatcttcccgccatctgagagtagtactgagcgggctggcaaggcgcataggnn

SEQ ID NO: 108563 - DNA, 623 bp, Homo sapiens
  misc_feature: GYAE6OF01CSOX0.16.38.D05.1.454.CMB.1.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagcccaccctgtctgtgtctccgaggggaaancgccaccctctcctgcagggccagtcagngtgtgccaccaatttacgcctggtacagaccaaaaccggccaggctcccaggctcctcatctatggtgcatcctaccgacggccactgatcgcccgaggtcccggttcagtggcgtaggttgggtttagggacagtacttcgacgtctacacctatccagccaccctgccagtctagtagtatttgacttaattttattagtttgtacctagtacctaagttaacttaaagttaccgtggtccctttaccgtacttacgttttcgggaccgtacggggtaaccctaaggtccgtagggaacgtaactaaccgtaaacgtacgttggtacggccgttacggacctaaccgtacttccgtacgttacctttactacgttcccgttaccccg

SEQ ID NO: 108564 - DNA, 542 bp, Homo sapiens
  misc_feature: GYAE6OF01A001S.16.38.D05.1.454.CMB.1.raw
  modified_base (498)..(498): a, c, t, g, unknown or other
  misc_feature (498)..(498): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
  modified_base (535)..(535): a, c, t, g, unknown or other
  misc_feature (535)..(535): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctcccaggctcctcatctatggtgcatctaccagggccactgatcgtcccaggtccggttcagtggcaggttggggtttgggacagacttcactctcaccatcagcaccctgcagtctgaggtattttgctaaattttattattgtactagtctagttattaatttactggtcccttaccgtactacgttttcggccgtaaggggacccaagccgtagganatacgaaacgactgtcggctgcaccgntctntcttcncttcccg

SEQ ID NO: 108565 - DNA, 258 bp, Homo sapiens
  misc_feature: GYAE6OF01AWTDF.16.38.D05.1.454.CMB.1.raw
  modified_base (257)..(258): a, c, t, g, unknown or other
  misc_feature (257)..(258): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacacttttggccaggggaccaagctggagatacaaacgaactgtggctgcaccatctgtcttcatcttcccgccatctgagagtagtacactgagcgggctggcaaggcgcatagnn

SEQ ID NO: 108566 - DNA, 561 bp, Homo sapiens
  misc_feature: GYAE6OF01A2QXI.16.38.D05.1.454.CMB.1.raw
  modified_base (510)..(510): a, c, t, g, unknown or other
  misc_feature (510)..(510): n is a, c, g, or t
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcaggagtgtcacttgatggagccaatacatacttcgcagactccgtgaagggccattcaccatttccagagagaacttccaacaacacgctgcatctgacaaagtcgaccacctgacgacctagacgacgacggctcgtactattactgtgtgagtctacttagtgtcgttcggtctttcgacgttacgtcgggacctagggtactcccgtggtccgtaccgtctccgtccncgccctacccgaccgtaacggccccagttcccgtccgttcccccgtaccgg

SEQ ID NO: 108567 - DNA, 237 bp, Homo sapiens
  misc_feature: GYAE6OF01CJWSD.16.38.D05.1.454.CMB.1.raw
  modified_base (231)..(237): a, c, t, g, unknown or other
  misc_feature (231)..(237): n is a, c, g, or t
tcagtgtactactccacgaccggtgctcgatttagtatctgatagttgggtttggggcagagctctggggaggaactgctcagttaggacccagacggaaccatggaagccccagcgcagcttctcttcctcctgctactctggctcccaggaactgtggctgcaccatctgtcttcatccttcccgcatctgagagtagtacactgagcgggctgggcaaggcgcatagnnnnnnn

SEQ ID NO: 108568 - DNA, 612 bp, Homo sapiens
  misc_feature: GYAE6OF01ANU1D.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcattctttaatagttttcctatgcactggatccgccaggctccgaggcgaggggactgggagtggggtggcaggagtgtcacttgatggagccaatacatacttcgcagactccgtgaagggtcattcaccatttccagagagaattccaacaacacgctgacatctgacaaatcggaccacccgtagacgacctggaccgaccgacggccgtactattacgtgtgtagtacgacttcttagttcggtcggtttcgggtctttacggtaccgttacggtcgggtaccggagggtactcccggtggtcccgtacccgtccgtcccgtcgtaccgtccctacccgaacccgtaacccgggccctacgttcccggttccccttcccccgtcggtaccccccg

SEQ ID NO: 108569 - DNA, 618 bp, Homo sapiens
  misc_feature: GYAE6OF01AIFCJ.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaancgccaccctctcctgcagggccagtcagagtgttgccaccaatttacgcctggtaccagacaaaacctggccaggctcccaggctcctcatctatggtgcatcctaccgagggcccactgatcgtccccgaggtccggttcaggtcggcgtaggttggggtttgggactaggtaccttcgactctaccaccctatcacgccacccgtgccagtctgacggttattttgacttaattttattattgtactagctagtacttaattacgtcggtccttccgttacgtacgttttcggaccgtaacggggtacccaaggtccgtaggacgtaacgtaccgaaaacgtacgttcgggttaggccgttacggacctacccgtaacgttccgttacggtttcctttacctacgtttccccg

SEQ ID NO: 108570 - DNA, 578 bp, Homo sapiens
  misc_feature: GYAE6OF01B8KWO.16.38.D05.1.454.CMB.1.raw
  modified_base (204)..(204): a, c, t, g, unknown or other
  misc_feature (204)..(204): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaancgccaccctctcctgcagggccagtcagagtgttgccacctaatttagcctggtaccagacaaaaacctggccaggctccaggctcctcatctatggtgcatcctaaccgagggccactgatgtcccgaggccggttcaggtcggcgtaggtggggtttgggacagtacttcactctcaccatcagcacctgcagtctgagtatttgactaattttattattgtctagtactagttaattaattacgtcggtccttaccgtaacttacgttttgggacctaaggggaccaagtcgtagggtacgataaccgaaacggtaacgtagtcgggtctacggaccaccgtaattccttggttcttccgtactttccccg

SEQ ID NO: 108571 - DNA, 542 bp, Homo sapiens
  misc_feature: GYAE6OF01BJ87E.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccacctctcctgcagggccagtcagagtgttgccacaatttagcctggtaccagcaaaaacctggccaggctcccaggctcctcatctatggtgcatctaccagggccactgatgtcccaggccggttcagtggcaggtggggtttgggacagtacttcactctcaccatcagcacctgcagtctgagtatttgctaatttattattgtcagcagttataattactggccttaccgtactactttttggaccgtaggggaccaaggtccgtggtagagtacgaaaacggtacgtagtggcttagtccaccgtactcgttagtcttccgtattccccg

SEQ ID NO: 108572 - DNA, 299 bp, Homo sapiens
  misc_feature: GYAE6OF01CXHOV.16.38.D05.1.454.CMB.1.raw
  modified_base (289)..(299): a, c, t, g, unknown or other
  misc_feature (289)..(299): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggccctcgtactacgttttcggccgacggggaccaagcgtggagtactaccgaaaacgtactggtcggctgccaccatctgtcttcacttccttccccgctatcgtagaagtagttactacacgtggacggcgggctgggacaaggccacaagtagnnnnnnnnnnn

SEQ ID NO: 108573 - DNA, 259 bp, Homo sapiens
  misc_feature: GYAE6OF01E1I2I.16.38.D05.1.454.CMB.1.raw
  modified_base (256)..(259): a, c, t, g, unknown or other
  misc_feature (256)..(259): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacacttttggccaggggaccaagctggagatcaaacgactgtggctgcaccatctgtcttcatccttcccgccatctgagagtagtacactgagcgggctggcaaggcgcatagnnnn

SEQ ID NO: 108574 - DNA, 581 bp, Homo sapiens
  misc_feature: GYAE6OF01AWLVZ.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtcgtgggggagcgtggtccagcctggaaggtccctgagactctcgtgtgcagcgtctggattcattctttaatgttttccatgcactggactccgccaggctccgaggcgagggactggagtgggtggcgaggagtgtcacgttgatggagaccaatacatacttcgcagactcgtagacggcattcacctattccagagagtaactaccaacaacacgctgacatctagacaagtcgaccacccgtgacgaccgtagacgacgacgctagtactattacgtgtgtagacgtactcttacgtcgtccggttccggtctttcgacgttcgtcgggacctacgggtctacccgtcggtaccctaccgttcctcgttaccgcgtcccaccgacccgaacggtccctacggttcccgtcccgtccccgtaccgg

SEQ ID NO: 108575 - DNA, 689 bp, Homo sapiens
  misc_feature: GYAE6OF01AJGGE.16.38.D05.1.454.CMB.1.raw
  modified_base (204)..(204): a, c, t, g, unknown or other
  misc_feature (204)..(204): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaanccgcccaccctctcctgcagggccagtcagagtgtcgccactaatttacgcctggtaccagaccaaaacctggccaggcctcccgaggcctcctcactctagtggtgcactcctaccgacgggccacgtgacgtccggtcccgacgggtccggttcgaggtcggacgtagggttcggggtttagggactaggtaccttacgacctctaccacctactcgacgccctacccgtgcgtacgtcgtaggtacggttagttttacgactttaaagttttatttagtttacgtacgtacgtacttaagttaactttaagtttaccgttacggtacccttaaccggtttaccgttacggttttaccgggaccggtaacggggtaaccgtaacggtcgtagggacgtaacgtaaccgtaaacggtacgttgggtacggtccttacggacccttaaccgtacgttccgttacgttcttccgtacgtttccccg

SEQ ID NO: 108576 - DNA, 594 bp, Homo sapiens
  misc_feature: GYAE6OF01BPGJU.16.38.D05.1.454.CMB.1.raw
  modified_base (204)..(204): a, c, t, g, unknown or other
  misc_feature (204)..(204): n is a, c, g, or t
  modified_base (437)..(437): a, c, t, g, unknown or other
  misc_feature (437)..(437): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaancgccaccctctcctgcagggccagtcagagtgttcgccaccaatttacgcctggtaccagacaaaaacctggccaggctcccaggctcctcatctatggtgcatctaccgagggccactgactcgtcccaggtccggttcaggtggccgtaggttggggtttgggacgtagacttcactcctcaccatcagccaccctgctagtctgaggtattttgacttaatttattattntcagtcgtagtataattactcggtcctaccgttactacgttttcggaccgtacggggtaccaaggtcgttaggacgtaagtacctaaaacggtacgtaggttcgggccttacggacctaacccgtattccgttagttcctttcgtaccgtttccccg

SEQ ID NO: 108577 - DNA, 802 bp, Homo sapiens
  misc_feature: GYAE6OF01DJZDD.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggactccgccaggctccgaggcgaggggactggagtgggtggcaggagtgtcacttgatggagccaatacatactcgacagactccgtagaacgggccgatccacctatttccagagagtaacttaccaaacaacacgctacgctaatctagactaaaacgtcggaacctaccccgtcggaacgtaccgtaacggaacccgaaccgtaacccgggtccttacggttaccttaacgttttaaccgttggttacggttacggtaacggttaacccttttacgttttaacgtttccgggttaccggggtttttacccggggttccgttttttacgggaacccgtttaaccgggttaccggggggtacccggtaacgggggttacccgtttacccccggtccgggtttaccccgtaacccccgggtttccccgttacccccgttaccccgtaacccggttacccccccgttaacccccgaaacccccgggtaaaccccggggtaccccccgttaaccggtttccccccggggtttccccccgtttccccccccgggttacccccggg

SEQ ID NO: 108578 - DNA, 265 bp, Homo sapiens
  misc_feature: GYAE6OF01AUNBN.16.38.D05.1.454.CMB.1.raw
  modified_base (263)..(265): a, c, t, g, unknown or other
  misc_feature (263)..(265): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacactttggtccacgggaccgaacgactggagatcaaacgaactagtggctgcaccatctgtcttcatcttcccgccatctgagagtagtacactgagcgggcgtggcgaaggcgccatagnnn

SEQ ID NO: 108579 - DNA, 558 bp, Homo sapiens
  misc_feature: GYAE6OF01AMS2Q.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaancgccaccctctcctgcagggccagtcagagtgttcgccaccaatttacgcctggtaccagacaaaaacctggccaggctcccaggcctcctcatctatggtgcatcctaccgagggccactgatcgtcccaggccggttcagtggctaggtggggtttgggacagtacttcactctcaccatccagccacccgtgcagtctgaggtattttgactaatttattattgtcagtctagtataattactcggtcccttcgttactacgttttcggaccgtaggggaccaggcgtggtagactacgaaacgtagtggtacggtcgtcgccaccgtattcgtagttcttcgtacttcccg

SEQ ID NO: 108580 - DNA, 733 bp, Homo sapiens
  misc_feature: GYAE6OF01CXRYT.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtcgtgggggaggcgtggtccagcctggaaggtccctgagactctcgtgtgcagcgtctggattcattctttaattagtttcctatgcactggactccgcaggctccgaggcgagggactggagtgggtggcagggagtgtcacgttgatggacgaccaagtacatacttcgacacgactccggtagaagggcctattccgaacctatttaccgagtagaagtaacttaccaaacgaacacgccttagccaacttctcggaactaaacgttccggaacctaaccccgttaggaaccgtaacccgtacggaacccgtaaccgaaccgggtcctacgttaccttaatttaccgtggttgtaggacgtacctttacttttaacgttcggtaccggtttccgggtccgttttaggtaccgttaccgggtacggggacccggtaacgggtaccgttccccggttacgggtccccttaccccggttcccttcccgttaccgtacccgttaccccttaccccgaacccgggtaacccgggtacccctacgggttaccccggttcccccgtttccccccggtacccccggg

SEQ ID NO: 108581 - DNA, 819 bp, Homo sapiens
  misc_feature: GYAE6OF01BE8AA.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaancgccaccctctcctgcagggccagtcagagtgttcgccactaagtttacgccttggtaccagaccaaaaaccgtggaccaggcctccgaggcctcctcacttcgtatggtcgctatcctaccgtagggccctacgtgactcgtacccgaggtccggttacaggtcggacgtaggttcggggtttacgggacgtaacggtaccttacaaccgttccgtacctaacccgtacttacccgaacggtaccctaccccgttacggaccttaacgggttaccgttagggtaacggggtttaactttttacgggtaaccctttaaaagttttttaacgtttaacgtttttacgggttaaccttaagggttacccttaaaggttttaaacgtttaaacgttttacccggtttacgggtaccccgttttaacccggtttaaccgttaccggttttttacgggaaccccggttaacggggggtaacccctaagggtaccgtttaacgggaacggttaaaccgtaaaccgttaaaaccgggtaaacgttgggtaacggtaccgttacgggtaccctaacccggtagtttaccggtttacgttaccgtttcctaaccggtttcccccg

SEQ ID NO: 108582 - DNA, 574 bp, Homo sapiens
  misc_feature: GYAE6OF01CEGY2.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcattctttaatagttttcctatgcactggactccgccaggcctccgaggcaggggactggagtgggtgcgaggagtgtcacttgatggagccaatacatacttcgcagactccggtgaacgggccgtattccacctatttccaaggagaacgtaattcccaaacaacacgctagcattcgtagacaaagtcggacctacccgtgacgacctacgacgacgacggtctgtactagttacgtgtgtgagtacttcgttagttcgtcgttcggtcgtttgtacgtacgtcgggccgacggtctccgtcggtccgccgtctcctcgcgccctccaccgtacggccctactccgtcctccccgtcg

SEQ ID NO: 108583 - DNA, 259 bp, Homo sapiens; identical to SEQ ID NO: 108523
  misc_feature: GYAE6OF01A6QCX.16.38.D05.1.454.CMB.1.raw
  modified_base (256)..(259): a, c, t, g, unknown or other
  misc_feature (256)..(259): n is a, c, g, or t

SEQ ID NO: 108584 - DNA, 611 bp, Homo sapiens
  misc_feature: GYAE6OF01ESQZT.16.38.D05.1.454.CMB.1.raw
  modified_base (204)..(204): a, c, t, g, unknown or other
  misc_feature (204)..(204): n is a, c, g, or t
tcagtgtactactccacgaccggtgctcgatttagtatctgatagttgggtttgggggaggaactgctcagttaggacccagacggaaccatggaagcccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagacaaaacctggccaggctcccaggctcctcatctatggtgcatcctaccgagggccactgatcgtcccgaggtcccggttcaggtggcgtaggtggggtttgggacagacttcactctcacatcacgccaccctgccagtctggtaggttatttgacttaattttattatttgtacagtactagttattaacttacgtcggtaccttaccgttacttacgttttacgggacccgtaacgggggaaccaaggtcgtaggaacgtacgtaaccgtaaaaccggtacgttggtcggtacctacggaccacccgttaacttccgttagtttacctttccgtactttacccccg

SEQ ID NO: 108585 - DNA, 782 bp, Homo sapiens
  misc_feature: GYAE6OF01C89MY.16.38.D05.1.454.CMB.1.raw
  modified_base (206)..(206): a, c, t, g, unknown or other
  misc_feature (206)..(206): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaaggggaaacncgccaccctctcctgcagggccagtcagagttgtcgccaactaatttacgcctggtaccaagacaaaaacctggaccacggcctcccaggcctcctcatctagtggtcacactaccgtaccgacgggcccacgtcgaactcggtaccccgacgggtcccgttacgaggttcggacgttaggggtttgggggttttacgggacgtacggttaaacctttcctaaccttccgtacctaaccctacgttaccgacaccccgtacccctacggtaccgttaaggttccgttagggtaacgggtttacttttttacggtaactttaaatttttacgtttaagtttcgttacgtaacgtacgtttaaagtttaatttaaactttaccgttacgggttaaccctttaccggtttaaccgtttacggtttttaccggggaccggtaaacggggtaaccgtaacgggttccggttaaggtaacggtacgttaaaccgtaaaaccggttaaacgttcgggttacggaccttaccgggaccctaacgttcttacccgttgttttacccttccgtacgttttcccccg

SEQ ID NO: 108586 - DNA, 890 bp, Homo sapiens
  misc_feature: GYAE6OF01A9U3F.16.38.D05.1.454.CMB.1.raw
tcagtgtactactccacgaccggtgctcgatttagtatctgatagttgggtttgggctgggagacgagcccagcactggaagtcgccggtgtttccattcggtgatcagcactgaatacagaggactcaccatggagtttgggctgagtcttgggttttcctcgttacttcttttaaggaggttgtaccaatgtcaggtgctaggttggtggtagtcggtgggggagcgtggtccagccgtaggaacgtcctagagactcgtcgtgtgcagtcgtcgtggtattcattactttaattacgttttccatgctactggactccgcgacggctaccgaggccgaggggtactagggaggtgggtcgacgagggtacgttcgtactaacggttggacgtaggaacgtacctaaaagtacctaacgttaaccttccggacgtaaacgtacccggttaccggtaacgggtaaccgggtacccttaacgtttacccctaaaccgtttaaccgtttaaccccggaaagggttaaacggtaaaccgttaaaacccgtttaaccccgaaaaaccgtaacccgttaaaccggtaccgtttaaccgaacccgtttaaaccttacccggtaaaccggtaaaccgttaaaaaccggttccgggtaaacccctaaccccggttaggaaaccccggttaacccgttacggggaaaccccggtaacccgtaaccggggttacctttaaccggtttaaaccgttttaaacggtttaaccgttacgggtttaccggttaccgggtaaaccgtttacccgttttaacggtttaacggtttaccgggtttccggggttttaacccggggttttactttttaaccgggtaacccgggtttaaccccgggggg

SEQ ID NO: 108587 - DNA, 619 bp, Homo sapiens
  misc_feature: GYAE6OF01AOJJO.16.38.D05.1.454.CMB.1.raw
  modified_base (381)..(381): a, c, t, g, unknown or other
  misc_feature (381)..(381): n is a, c, g, or t
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcaggagtgtcacttgatggacgccaatacataccttcgacagactccgtgaagggccattcacctattccagagagaacttaccaaacaacacgctgacatcngacaagtcgaccaccgtagacgacctgacacgacgctgtactattactgtgtgacgtctacgttagtcgtcggttcggtctttacgtacgttacggtcgggtaccgtacgggtaccgtcccggtacggtcccgtacccgttccgttcccgtaccgtccgtacccctaccccgaaccccggtaaccgggtccccctaaccggttccccgggtttcccccgttccccccggttaccccgg

SEQ ID NO: 108588 - DNA, 689 bp, Homo sapiens
  misc_feature: GYAE6OF01AMLO1.16.38.D05.1.454.CMB.1.raw
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
tcagtgtactactccacgaccggtgctcgatttagtatctgatagttgggtttgggggagggaacgtgctcagttaggacccagacggaaccatggaagccccagcgcagcttctcttcctcctgctactctggctcccagacacgactggagaagtagtgatgacgcagtctccagccacctgtctgtgtctccgagggaancgccacctctcctggcncgggccagtcagtagtgtcgacctactaatttacgccttaggaccagaccaaaacctggaccacggcctcccgacggtcctaccttacactacttaggtcggttcgaccttacgtaccgtacccggacgggaccctagttacgaacgtttcggtaccccgtacgggtaccggttcgacggttcggacggtagggtttcggggtttacgggactacggtacgttaccgtacgtccctacctacgaactcgtacgtacctacccgtgacgtagttaccgtaggtacgtttacgtttacgaactttagtttaactttgtacgtcgagtactagtacttagttcgtacgtcgtacctcttagttacggaccgtaacgggaccgtagtcgtacggtagtaacctacgtaaacggtgtagttacggcgttaacgctaccgttactcttaggttacccctgtaccgtttacccccg

SEQ ID NO: 108589 - DNA, 552 bp, Homo sapiens
  misc_feature: GYAE6OF01C17B9.16.38.D05.1.454.CMB.1.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (524)..(524): a, c, t, g, unknown or other
  misc_feature (524)..(524): n is a, c, g, or t
  modified_base (544)..(544): a, c, t, g, unknown or other
  misc_feature (544)..(544): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaanccgccaccctctcctgcagggccagtcagagtgttgccaaccaatttgcctggtacagacaaaactgcagctccagctctcatctatggtnctatctaccgaggccactgatcgtccaggtccgttcaggtgcgaggtgggttgggacagtactcactctcaccatcacgacaccctgactagtctagaggtattttgactaaattttattattgtacagtctaagtaataattacgtcggtacctccgtactagttttcggaccgaaggggtaaccaagtccgtagggaactagtaacaaaacggattagggtgacgtnaaccgactatcgtagtcttnacttcccg

SEQ ID NO: 108590 - DNA, 721 bp, Homo sapiens
  misc_feature: GYAE6OF01A10SH.16.38.D05.1.454.CMB.1.raw
tcagtgtactactccacgaccggtgctcgatttagtatctgatagttgggtttgggctcaactctcttgtctcaccatggagtttgggctgagcgtgggttttcctcgttactctttaagaggtgtccaatgtcaggtgcagttggtggagtcgtgggggaggcgtggtccagcctggaaggtccctgagactctcgtgtgcagcgtctggattcattctttaatagttttccatgcactggatccgccaggctccaggcaggggactgggagtgggtgcaggagtgtcacttgagtggacgccaatacatacttcgcagactccggtagaacgggccgtattccaccctatttccgaaagtacgaacgtaaacttacccaaacgaaaccgtaccgaccttaggaccaagttccgtacggtaacctaaaagtccgggaaccctacccgtaggaaccgtaccctacgggaacccgtaacgaccgggtcgttacggttacctaagtttaccgtggttacgtaggtaacgtacttaccgttttaagttcggtaccgggtttacgggtcttttacggaaccgttacggtacgggggtacccgtaacggggtccttcccggttacggttcccgtaccccggttcccgtacccgtcgtacccgtccccttaccccgaacccggtaccgggacccctaacgttcccggttccccgttcccccgtccgg

SEQ ID NO: 108591 - DNA, 692 bp, Homo sapiens
  misc_feature: GYAE6OF01CFTSH.16.38.D05.1.454.CMB.1.raw
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaancgccaccctctcctgcagggccagtcagagtntcgccactaatttgcctggtaccagacaaaacctggaccaggcctcccgaggtcctcctcatctagtggtgactactcctaaccgagggacccaacgttgaacttccggtacccgacgggtccggtttcgaggtcggtcgtagggttcggggtttagggaactacggtaccttcgaaccttcctaccgacctatccgaacgccctaaccctgacgtaggttccgtaggtaagggttactttttgaactttaaagttttactttagtttcgttactaagtacctaagttaactttaactttaccgtacgtaccccttaccggttaaccttacgtttttaccgggaccgtaacggggtaacccaggtccgtaaggtagtaaacgtaccgaaaacgttacgtaggtacggtctacggtacctaaccgtattacgttacgttctttccgtcgttaccccg

SEQ ID NO: 108592 - DNA, 823 bp, Homo sapiens
  misc_feature: GYAE6OF01CW1BD.16.38.D05.1.454.CMB.1.raw
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaacnccgccacctctcctgcgacgggccagtcagngtcgttcgacctactaagttacgccgttacggtaccagtaaccaaaaaccgtcggaccgacggtacctacccgaggtcctcctactactcttacgtggtcgactacgtaccgtaaccgacgggacctacgtacggtacgtccggtacccgacgggttccggttacgaggtcgggtcgtaggggttcggggtttacgggaactacggtaccttcgtacctctaccgtacctactacgaccgtaccctacccggtagtaccggtacgttccggtaaggtaacggttacgttttacgtaactttaaatttttagttacgtttacggttactaacggtacgttaaagtttaactttaaacgtttaccgttacggttaccctttaaccgggttaacccgttttcgggtttaaccggggtaacccggtaacggggtaacccgttaagggtaccggttaacggggtaacgtaaaccgttaaaaccggtaaaaccggttaaccggttagggtaccggtaccgtaccgggtaaacccgtaccgttaaccgtttcggtttaccgttttacccgtaccgtttaacccgtttacccccgg

SEQ ID NO: 108593 - DNA, 744 bp, Homo sapiens
  misc_feature: GYAE6OF01EG8PR.16.38.D05.1.454.CMB.1.raw
  modified_base (204)..(204): a, c, t, g, unknown or other
  misc_feature (204)..(204): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactgggagaagtagtgatgacgcagtctccagccaccctgtctgtgtctccgaggggaanccgccaccctctcctgcagggccagtcagagtgtcgccaactaagtttacgcctggtaaccagtaccaaaaacctggaccaggcctccaggctcctcatctagtggtcgcactactaccgacgggccacgtgacgtcgtcccgacggtccggtttacgaggttcggcgtaggttcgggggtttacgggacgtaacggtacctttacgtaccgttaccttaccgaccctactacccgaacgtccctacccgttccgaccgtacgttaccgtagggtaaggtttacttttacgaactttaaatttttaacgttttaagtttacggttactaaggttaccttaaagtttaacgtttaaacgtttaccgttacggtacccttttaacccggttaacctttacgggttttaccgggtacccgggtaaccggggtacctaaacgggtcgttaagggaacgttaaacgtaaaccgtaaaacggtacgttagggtacggtactcgaaccctaccgtacttcgttacgtttccttcgttccttaccccg

SEQ ID NO: 108594 - DNA, 846 bp, Homo sapiens
  misc_feature: GYAE6OF01CYG5E.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagcccaccctgtctgtgtctccaggggaancgccaccctctcctgcagggccagtcaggagtgttgccaccaatttacgcctaggtaaccaagaccaaaaacctcggaccaggcctacccgaggcctccctctacttcctagttgggtgctactccgtaacccgacggggccctaacgtcgaacgttccggtaccccgacgggtcccgggtttcgaacggttcgggacgtaggggtttcgggggttttacggggaacgtacggtaaccgtttaccaccgttacccttacctaaccctaacgttcccgaacgtaccctaccccgtacgccgtacggttaccgtagggtaacgggttacttttttcggaactttaaacgttttttatttaacgttttacggttaccgtaacggtaccgttaaagttttaaacgtttaaacgttttaaccgttaccggggttaccccctttaaccggtttaacccgttttaaccgggttttttaccggggacccggttaaacgggggggtaacccctaagggttaccggtaggggtaaaccgtaaacggttaccgtaaaaaccgggttaacggttacgggttacgggttaccttaccggtacccgtaaccgttacgtttaccgtttcgttacctttccgtaccttttaccccccgg

SEQ ID NO: 108595 - DNA, 800 bp, Homo sapiens
  misc_feature: GYAE6OF01ETH0T.16.38.D05.1.454.CMB.1.raw
  modified_base (205)..(205): a, c, t, g, unknown or other
  misc_feature (205)..(205): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggcctcccagacacgactggagaagtagtgatgacgcagtctccagcccacctgtctgtgtctcgaaggggaacnccgccaccctctccgtgccgacgggccagtacgagtacggttcgttaccgaccctaacttaagtttacgaccgttacgggtaaccaacgaaccgaaaaaccgtcggacccgaacggtccctacccgacggtcccttacctacctacttacgttacgtcgggtacgacctacgttaccgtaaccggacgggccctacgtacgtacgtccggtaccgtacgggtccgttacgtaggtcggacggttaggggttgggttacggtaaccgtacggttaccttacgtaccttacctaccgtaacctacgtaccgaacgaccctacccgtgaccgttacgttcggttaggttacggtttacgttttacgaacttttaagtttactttagttcgtaacgtactaacgttaacgtttaacttaacgttccgtacgttaccgttaccgttacgtttaccggtttacggaaccggtaacgggtaacctacgggtaccgtaggtaaccgtaacgtaaccggtaaacggtacggttcggtacggtccgtacgtaccgtaaccgttagtttacccgttacgtttacccttccgtacccgtttaccccg

SEQ ID NO: 108596 - DNA, 797 bp, Homo sapiens
  misc_feature: GYAE6OF01C5ZNY.16.38.D05.1.454.CMB.1.raw
  modified_base (202)..(202): a, c, t, g, unknown or other
  misc_feature (202)..(202): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgagggaanccgccaccctctcctgccgagggccagtcagtagtgtcgaccactaatttacgcctaggtaccagacctaaaaccgtggccacggcctcccgaggtcctactcactcgtagtggtcgactactaccgtaaccgacgggaccctacgtacgtacgttccgtaccccgtacggtcccggtttacgacggttcggtacgtagggtttcgggggtttacgggacgtaggttaacccttaccgtaacctccgtacctaccctagttacccgacgaccctacccgtcgacctaacggttccgtaggttaacggttctttttacgtaacgtttaaattttttacgttacgtttacgtaccgttaggtaccttaaggtttaacttaacgtttacccggtacggttaccccgttaccccggtttaacgtttaaccccggtttttaggggaaccccgggttaacggggtaaccctacgggttaccggtaacgggtacgtaaacccgttaacggtaaaaaccgttccggtacgggttcggaccgtttacggaacccctaccgttaacgttcgttaccgtttaccccgtgttacccgtttacccccg

SEQ ID NO: 108597 - DNA, 618 bp, Homo sapiens
  misc_feature: GYAE6OF01DD8XY.16.38.D05.1.454.CMB.1.raw
  modified_base (181)..(181): a, c, t, g, unknown or other
  misc_feature (181)..(181): n is a, c, g, or t
  modified_base (271)..(271): a, c, t, g, unknown or other
  misc_feature (271)..(271): n is a, c, g, or t
  modified_base (360)..(360): a, c, t, g, unknown or other
  misc_feature (360)..(360): n is a, c, g, or t
tcagtgtactactccacgaccggtgctcgatttagtatctgatagttgggtttggggctgggagacgagcccagcactggaagtcgccggtgtttccattcggtgatcagcactgaatacagaggactcaccatgggagtttgggctgagctgggttttcctcgttactctttaagaggtntccaatgtcaggtgctaggttggtggagtcgtggggggagcgtggtccagcctgggaacggtccctgacgactcgtcgtgtgcagcgtcnggtattcattcttttaatcgttttccattcgcactggactccgccgaggcctccgaggccgaggggactgggaggtggggtgacgaggngtgtacagttgatacgggacaccctaaatacgtacttaccgttcgacgtagtaccgtccggtaaggaacgggtcctaattcccaaccttattaccgaagaacgtataacctaccaaacaacgcgtctcactatctacgacaagtcgaaccaccgtagacctaaccgtgaaccgaccgtacggtctacgttatattaccgtgtagtacgtactactttctttagttcggtcggtttagggtcctttacggcgttcgggg

SEQ ID NO: 108598 - DNA, 709 bp, Homo sapiens
  misc_feature: GYAE6OF01EXWCT.16.38.D05.1.454.CMB.1.raw
  modified_base (346)..(346): a, c, t, g, unknown or other
  misc_feature (346)..(346): n is a, c, g, or t
tcagtgtactactccacgaccggtgctcgatttagtatctgatagttgggtttggggctgggagacgagcccagcactggaagtcgccggtgtttccattcggtgatcagcactgaatacagaggactcaccatggagtttgggctgagctgggttttcctcgttactcttttaagaggtgtccaatgtcaggtgcaggttggtggagtcgtgggggagcgtggtccagcctggaacggtccctgagactctcgtgtgcagtcgtctggattcattctttaaatagttttcctatgcacgtggactccgccaggcctccgagggcgagggggactgggaggtgggnggcgaggtacgtgtctacgttggagtgggacaccaaatactacttacgtcgacctaggtaaccctcggtaaggaacgggtcctaacgttccgaacccgtagtttacccgaaaggaagtaaacgtaaacttaacccaaaccgaacgtaccgctacgactacgtacgtacgacgtaaaacgtcggaacccctacccggtggtaaacccgtaaccgttacggaaccggaacccgtaccgggtacccttacggtttaccctaaagtttaccggttcggtacggttaggtaccgttaacctttacgtttaacgtttcggggttaccggtttaccgggttacgttttacggaacggtttaacccggggg

SEQ ID NO: 108599 - DNA, 690 bp, Homo sapiens
  misc_feature: GYAE6OF01BKJF7.16.38.D05.1.454.CMB.1.raw
  modified_base (204)..(204): a, c, t, g, unknown or other
  misc_feature (204)..(204): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaanccgccaccctctcctgcagggccagtcagagtgttcgccacctaatttacgcctggtaccagacaaaaacctggccaggcctcccgaggctcctcatctagtggtgcatctaccgagggccacgtgactcgtcccgaggtccggttcgaggtcggacgtagggttggggtttacgggacgtacggtacctttccaccgttcctaccaaccgtacttccgacggtccctaccccgttgcctacggttcgttaggtaggttacttttacggacttaatttttagtttatttagtacctagtactaagttaacttaacgtttaccgtacggtacccgttaccggttaaccgttacgtttttacgggaccgtaacgggggaaccctaagggtccgttaggggaacgtaacgtaaccgtaaaacggtacgttaggtacggtctacggtaccctaccgtacttaccgttacgttccttcgtacctttccccg

SEQ ID NO: 108600 - DNA, 610 bp, Homo sapiens
  misc_feature: GYAE6OF01BNOGU.16.38.D05.1.454.CMB.1.raw
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (382)..(382): a, c, t, g, unknown or other
  misc_feature (382)..(382): n is a, c, g, or t
  modified_base (397)..(397): a, c, t, g, unknown or other
  misc_feature (397)..(397): n is a, c, g, or t
  modified_base (424)..(424): a, c, t, g, unknown or other
  misc_feature (424)..(424): n is a, c, g, or t
tcagtgtactactccacgaccggtgctcgatttagtatctgatagttgggtttggggctgggagacgagcccagcactggaagtcgccggtgtttccattcggtgatcagcactgaatacagaggactcaccatggagtttgggctgagctgggttttcctcgttactcttttaagagtgtccaatgtcaggtgcagttggtggagtcgtgggggagcgtggtccagcctggacgtccctgagactcgtcgtgtgcagcgtctggattcattctttaatacgttttccatgcactggactcccgcaggcctccgaggcgaggggctgggagtgggngcgaggngtgtcagttgagtggacncaatacatactcgcagctcgngacggcctatcactnttcagagacgactaccaacacacgtcngcactctacgactaagtcgaaccctacccgtaggaacgtacccgtacggaaccgaccgaccggtcttacggttaccttaacgtttaccgttggttacggttacggtacgttaccgtttaccgttttagtttacgggttcccgggttttaccgggttcgttttaccgggaccgtttaacccgggggg

SEQ ID NO: 108601 - DNA, 697 bp, Homo sapiens
  misc_feature: GYAE6OF01AVFFC.16.38.D05.1.454.CMB.1.raw
  modified_base (204)..(204): a, c, t, g, unknown or other
  misc_feature (204)..(204): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaanccgccaccctctcctgccagggccagtcagagtgttcgccacctaatttacggcctggtaccagacaaaaccgtggccaggcctccagcctcctcatctagtggtgcatccgtaccgaggccaacgtgtacgtcgtacccgtacggtcccggtttcgacggttcggaccgtaaggggtttcggggtttacggggaactacgggtacctttaccgaaccttccgtaccaacctacttaccgaacggtaccctaacccgtcggactaacggttcgtaggtaacggttattttacggactttaaattttaagtttacgtttcgtaccgtaagacgttaagtttacttaacttttaccgtcggtacccgttaccgtttaacgttaccgttttacgggaccgtacggggtaaccaacggtccgtaggacttaacgtaacaaacggtcttaggacgtcgtacgacctacctagttctacggttcttcgtacgttccccg

SEQ ID NO: 108602 - DNA, 697 bp, Homo sapiens
  misc_feature: GYAE6OF01B2XSQ.16.38.D05.1.454.CMB.1.raw
tcagtgtactactccacgaccggtgctcgatttagtatctgatagttgggtttgggctgggagacgagcccagcactggaagtcgccggtgtttccattcggtgatcagcactgaatacagaggactcaccatggagtttgggctgagcttgggttttcctcgttactcttttaagaggtgtccaatgtcaggtgcagttggtggagtcgtgggggagcgtggtccagcctggaacgtccctgagactcgtcgtgtgcagcgtctggattcattctttaatagttttccatgctacgtggactcccgccgaggctccgaggcgaggggactgggaggtgggtggcaggagtcgtcacgttgagtggaacgacccaatactattaccgttcgactaacggtaccgtccgggtagggaaccgggtcccgtaactttccgaacccgttacgtttacccgaaggtaacgtaaacgtaacttaaccccgaaaccaaccgtacgtcgtacgacctaacgttccgtagaaacctaaagtccgggaaccctaccccgtaggtaacccgtaaccgttacggaacccgaccggaccggtaccttacgttacctttaagttacgttgggttacgtacggtacgtacctttacgttagttcggtcccgggtttaaccgggttccgttttacgggaccgtttacccgggg

SEQ ID NO: 108603 - DNA, 850 bp, Homo sapiens
  misc_feature: GYAE6OF01EFF8D.16.38.D05.1.454.CMB.1.raw
  modified_base (212)..(212): a, c, t, g, unknown or other
  misc_feature (212)..(212): n is a, c, g, or t
tcagtgtactactccacgaccggtgctcgatttagtatctgatagttggggtttgggggaggaactgctcagttaggacccagacggaaccatggaagccccagcgcagcttctcttcctcctgctactctgctcccagacacgactggagaagtagtgatgacgctacgtcctccacgcccaccttgtctgtctctaccggaaggggaacnccgacccaccctcgtcctgcgacgggccagtacgagtagtgttacgaccaacttaagtttacgccgttacggaacctacgaacctaaaaaccgtcggacccgagggtcccctacccgaggtcccttccctactacttccgttaagtgggtcctactaccgttccgaaccggacgggtaccctacgtacggtacttccggtaaccccgtacgggtaccgtttacgacgggttcggaccggtaggggttttcggggttaacggaaccgtacggtaccttcgaccttcgaccctacgtactccgacgtaccctaccgtgaccgttagtacgtagggtaacgttattttaccgtaattttaaacgttttattacgttacgtaccgtagttactaacggttttaaacgttaaccgtttaccggtacggtttaacccccgtttaagttacccggtttacgggttttacccgggaacccggggtaaggtaaccccgtaaggttaccggtaaagggaaccgttaaacctaaaaaccgggttaacggtaaccggttaggtaacccggtcgtaaacccggtacttaaaccccggttaacttttccgttaaaccggttttcccttaaactacccccggttttacccccg

SEQ ID NO: 108604 - DNA, 623 bp, Homo sapiens
  misc_feature: GYAE6OF01BMX8N.16.38.D05.1.454.CMB.1.raw
  modified_base (203)..(203): a, c, t, g, unknown or other
  misc_feature (203)..(203): n is a, c, g, or t
  modified_base (355)..(355): a, c, t, g, unknown or other
  misc_feature (355)..(355): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtcgtccgggggaancgccaccctctcctgcagggccagtcagtagtgtcgccacctatttacgcctaggtaccagacaaaaaccgtggaccaggctcccgaggcctcctcatctagtggtcgactatcctaccgagggcccactgactcgtccgagggtccgttanaggtggcgtggttggggttggacacgtacttcacttcncactntacacgcctacctgacgtacgtcgtagagttattttcgtaacttaattttattacgtttagtacgtagtacttaagtaatttaacgttacgtccgttacgtacccgtacttacgtttcgggaccgtaacgggtacacgtcgaggtactagtaaccgaaaggtccgtaggtacggacgtacgacccgtacctagttcgttcgttacttctactttcccgttacccg

SEQ ID NO: 108605 - DNA, 600 bp, Homo sapiens
  misc_feature: GYAE6OF01D7I1P.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaanccgccaccctctcctgcagggccagtcagagtgttcgcccacctaattttacgccttagggtaacccaagaccaaaaaaccctggaccaggcctcccaggcctcctcatctatggtgcatctaccgagggccacgtgatcgtcccgacgggtccggttcaggtcggcgtaggttggggtttagggacagtacttcactctacaccataccacgccacccgtgacctagtctaggtaggttattttgacttaatttatttattgtacagtactagttattaattacgtcgtcccttacgttacttacgttttcggaccgtacggggacctagtcgtaggagtactacgaaacgtacgtggtcggtctcgaccactacttctacgttcttctcttcccg

SEQ ID NO: 108606 - DNA, 640 bp, Homo sapiens
  misc_feature: GYAE6OF01BUB5I.16.38.D05.1.454.CMB.1.raw
  modified_base (203)..(203): a, c, t, g, unknown or other
  misc_feature (203)..(203): n is a, c, g, or t
  modified_base (614)..(614): a, c, t, g, unknown or other
  misc_feature (614)..(614): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaanccgccaccctctcctgcagggccagtcagagtgttcgccacctaatttagcctggtaccagacaaaaacctggaccaggcctcccaggcctcctcatctatggtgcatcctaccgagggcccacgtgactcgtcccgagggtcccggttcgaggtcggcgtagggttggggtttgggactagtaccttcactctccacctatccacgcctacccgtgccgtacgttccgtaggtacggttattttacgactttaaatttttagtttagtttcgttacgtagtactaaggtttaactttaacgtttacgttacggtcccttaccgttaccgttacgttttcggaccgtacggggacctaaggtcgtaggaacgtactaacgaaacgtacgtgtcggtcgtacgaccaccgtnttcgtagttccttacgtccttccccg

SEQ ID NO: 108607 - DNA, 573 bp, Homo sapiens
  misc_feature: GYAE6OF01EZK4U.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggagcgtggtccagcctggaaggtccctgagactctcgtgtgcagcgtctggattcatctttaatagttttcctatgcactggatccgccaggctccaggcaggggactggagtgggtggcaggagtgtcacttgatggagccaatacatacttcgcagctccgtgaagggccattccactatttccgaagagagaattccaacaacacgctagacatctgacaaatcggaccaccctagaacgacctacgaacgacgacggtctacgtcttatactgtgtgatacttctattgtcgttcggtctttggacttaggtcgggccgagggtactccgtcggtcctaccggtcctccctctaccgccctacccgacccgaacgggtaccccacgttcccggttcccgttccccgtccgg

SEQ ID NO: 108608 - DNA, 615 bp, Homo sapiens
  misc_feature: GYAE6OF01B6SQR.16.38.D05.1.454.CMB.1.raw
  modified_base (297)..(297): a, c, t, g, unknown or other
  misc_feature (297)..(297): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagcccaccctgtctgtgtctccgaggggaaagcgccaccctctcctgcagggccagtcagagtgttgccacctaatttacgcctggtaccagacaaaaacctggaccaggcctcccagctcctnatctatggtgcatcctaccgaggccacgtgatcgtcccaggccgttcagtggcaggttgggttggacagacttcactcgtcaccatcagccacccgtgctagtctagtaggtattttgacttaatttattagtttgtcagtctaagtattaaacgtttacgtacgggtccttaccgttactacgtttttacgggaccgtacggggtaaccaggtaccgtagggaaagtacgttaacgaaaaccggtaacctaggttacggcgttacggacctaaacccgtacttacgttacggtttccttacccgtagtttacccccg

SEQ ID NO: 108609 - DNA, 794 bp, Homo sapiens
  misc_feature: GYAE6OF01BE42C.16.38.D05.1.454.CMB.1.raw
  modified_base (215)..(215): a, c, t, g, unknown or other
  misc_feature (215)..(215): n is a, c, g, or t
  modified_base (515)..(515): a, c, t, g, unknown or other
  misc_feature (515)..(515): n is a, c, g, or t
tcagtgtactactccacgaccggtgctcgatttagtatctgataggttgggtttgggggaggaactgctcagttaggacccagacggaaccatggaacgccccagcgcagtcttctcttcctcctgctactctggcctcccagacacgactggagaagtgtgatgacgcagtctccacgcccacccgtgtctggtcgtccgtacgaaggggaacnccgccctaccctctccgtgccgacgggccagtcgaggtcgttcgacctaaccgtaagtttacgtaccgtcggtaccgaacgaaccgtaaaacccgacggtccgacgtaccgtcccgacggtcctcctactacgtcttcgtaggtcgctacctcgtaccggtacggctactaggtactccgtcccgtacgggtccgttacggtcgtcgggtcgtagggttacggggttgggtaacacgtaacttccgtacctacgtcctaaccgctacgaaccgcctacccgttagccgtgttaaccgggngtaaacgggtttctttacgtaacgtttaaatttttacgttgtttaacgtcctaagggttacgttaaagtttaaccggtttactttaaccgggtccgtttaccccgtttacccggttaaggttttacccgtttacggggaaccccgggttaacgggaaaccgtagggtaccccggttggtaaaccgggaaaccttaccgggttaaacccgtaggttccggttaggaccgccgttaaactccggtaactttcgtcgttaccctgtccccgttctaccccgg

SEQ ID NO: 108610 - DNA, 689 bp, Homo sapiens
  misc_feature: GYAE6OF01BQKPO.16.38.D05.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaancgccacctntcctgcagggccagtcagngtnttgccacaatttgcctggtaccagacaaaacctggaccaggcctcccaggctcctcatctatggtcgctactctaccgagggacctagtgactcgtcccgaaggtccgttagaggtcggcgtaggttggggtttggacctaggtaccttcacgttctaccaccgtacttaccacggtacccacccgttggacctacgttccgtaggtaggttacttttaggacctttaaagttttacttatttggttaccgaagtccgtaagttaacttaattccggtacgtcccttacggttaacctacggttttcgggaccgttacggggtacctaaggtcgtaacgggtacgtaacggttaacccgaaaacgggtaaccgtcgggttacgggtaccgttaggaccccgtaacccgtaacgtttcccgttaagtttcccgtttactaccggtttaacccccgg

SEQ ID NO: 108611 - DNA, 747 bp, Homo sapiens
  misc_feature: GYAE6OF01A6MQF.16.38.D05.1.454.CMB.1.raw
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagcccaccctgtctgtgtcctccgaggggaaacgccgcccaccctctcctgcgacgggccagtcagtacgtgttcgcctaacctaagtttcgcctggtaaccacgaaccaaaaccgtcggaccacggccctacccgacggtccttaccgtactactccttagtcgggtcgacctactccgtaaccggacgggtcccacgttacgacgttccggttaccccgacggggttcccgttacgtacggtcgggtaccgtaggggtttcggggtttacgggaacctacggttaccgttacctacccgttactacccgaaccgtacttacgaaccgtacccaacccgttcggacccgtacgttcggtaggtaacggtttactttaggtaactttaatttagttacgttgtaacacgttagtaacgttaattaaccgttacgtacgtcccttaccgttacgtttacgtttccggaaccgtaacgggtacctacggtcgtaagggtaactacgtaacgtaaaacccgtgttacggtcgtcgtaccgtaccacgttactcgttactccttactcgttaaccccg

SEQ ID NO: 108612 - DNA, 588 bp, Homo sapiens
  misc_feature: GYAE6OF01EW4XS.16.38.D05.1.454.CMB.1.raw
  modified_base (204)..(204): a, c, t, g, unknown or other
  misc_feature (204)..(204): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaancgccaccctctcctgcagggccagtcagagtgttgccacaatttagcctggtaccagcaaaaacctggccaggctcccaggctcctcatctatggtgcatctaccagggccactgatgtcccgaggtccggttcagtggcgaggtggggtttgggacagtacttcactctcaccatcacgccaccctgcagtctgtagtatttcgacttaatttattattgtcagtctaagttaattaattacgtcggtacccttacggtacttacgttttcggacccgtacggggacctaacggtcgtagggtacgtaacgtaccgaaaaacggtacgttaggttacggctacggacctaaccgtacttcgttagttccttcgactttccccg

SEQ ID NO: 108613 - DNA, 949 bp, Homo sapiens
  misc_feature: GYAE6OF01E3UXW.16.38.D05.1.454.CMB.1.raw
  modified_base (215)..(215): a, c, t, g, unknown or other
  misc_feature (215)..(215): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtgtgatgacgcagtcctccagcccacccgttgtctggtcgtccgtaccggaaggggaaacnccgaccccaccctctccgtagcgacggcctagtcgaggtacgttcgtaccgaccctaaacgttaagtttaccggaccgttacggaaccaacggaaacctaaaaaccggtccggaaccgacggtcccgtacccgacggtcccttccgtactagttaccgtaggtcggtacgaccttaacgtaccgtaaccggaccgggtaccctaggtacgtaccgtcccggtaccggtaccggttccggttacggtagggtccggtacggttagggtttacggggttaaacggtaccgaacgtttaaccgttccgtaacgttacccgtacgtaacccgtaacgtacccgtacgtaccccgtaccggtacggtaccgttaacccgggttaggtaacgggtttaacggtttacgtttttacgtaaacgttttaaacgtttttaacgttaacggtttacgtaaccgtaaggtttaacgttaaacgtttaaaccgtttttaacgtaccgggtttacccggttccctttaaaccgggttaaccgttttaccggggttaacccggaacccggggtaaaccgggtaaccgtacgggtacggttaaaccggtaacgtaaacccggtaaaaaccgtaaaccgggttacggttacggttaccgggtacccgtaaccggttaccctaaacccgggtttaacctttcccggttttaaaccttccccgtttaacccgttaaccccgtttcccccggg

SEQ ID NO: 108614 - DNA, 653 bp, Homo sapiens
  misc_feature: GYAE6OF01E00OE.16.38.D05.1.454.CMB.1.raw
  modified_base (205)..(205): a, c, t, g, unknown or other
  misc_feature (205)..(205): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagcccaccctgtctgtgtctccgaggggaaancgccaccctctcctgcagggccagtcaggagtgttcgccacctaatttacgcctggtaccagacaaaacctggccaggctcccgaggctcctcatctagtggtgctatccgtaccagggccacgtgatcgtcccgaggtccggttgaggtggacgtaggttggggtttgggactacggtacttcactctaccacctactaccgacgaccctaccctcgctacgttcgtagtaagggttattttgacttaattttaagtttatttacgtactaagtcttaagttaattaacgttcgtacggtcccttaaccgttaccttacgttttacgggacccggtaacggggtaaccaacggtccgtaggtacgtaacgtaaccgaaaacggtacgttagggttcggaccgtcgaccctaccgtacttacgtactttaccttcgtactttccccgg

SEQ ID NO: 108615 - DNA, 734 bp, Homo sapiens
  misc_feature: GYAE6OF01C4EFU.16.38.D05.1.454.CMB.1.raw
  modified_base (206)..(206): a, c, t, g, unknown or other
  misc_feature (206)..(206): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagcccaccctgtctgtgtctccgaggggaaacnccgcccaccctctcctgcgagggccagtcagagtgttcgccaacctaattttacgccgttaggtaaccagtaaccaaaaaccgtggaccaacgggcctcccgaggtcctcctcactctagtggtcgctactcctaaccgagggaccacttacggacgtccgtccccgagggtccggttacgacggtggacgtacggttggggtttacggacgtaagtaccttaccgacttcctaccgactaacgtccacgtacccacccgttgacctacgtaccgtaggtaagggtttcttttaggtaaccttaaagtttttaacttacgttacgttacgtagtactaacgtttaaattaacttaacgttacggtccctttaccggttacgtttaaccggttttacccgggaaccggttaacggggtaacctaacgggcgttaacggggtaacaacgttaaccgaaaacggtaacgttagggtacggcttaaccgccaaaccttacgttacgttagtttccttacgtccgttaccccg

SEQ ID NO: 108616 - DNA, 861 bp, Homo sapiens
  misc_feature: GYAE6OF01A5HMM.16.38.D05.1.454.CMB.1.raw
  modified_base (204)..(204): a, c, t, g, unknown or other
  misc_feature (204)..(204): n is a, c, g, or t
  modified_base (317)..(317): a, c, t, g, unknown or other
  misc_feature (317)..(317): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaancgccaccctctcctgccgagggcctagtcagagtgttcgccactagtttagcctggtaccagaccaaaaccgtggaccacggcctcccgacggcctcctctatctagtggtcncgactcctaccgacgggcctacgtacgtagtccggtaccccggtacggtccggtttcgacggtggggacgtaggggtttcggggtttacggggacctaggtacctttaccgtacgttacctaccgacctaactccgaaccgtacccgtaccccttggaccgttaccggttacgttacgggtacggttttaacgttttacggtaacctttaaagtttttaacgttttacgttttacgttacgtacgttaaccttaaaggtttaaacgttttaaacggtttacccgtttaacgggttaccccgtttaaccccggttttaacccggtttacccgggttttttaaccgggggaaccccgggtttaacgggggtaaaaccccgtaaccggggttaccgggttaacggggaaacggttaaaccgttaaacccggggtaaaaaccgttacgggtttacgggttacgggtaccggttaaccgggtaacccttaacccggttacgtttaccggtttacctttacccgttacccgttaccccgtttacccccgg

SEQ ID NO: 108617 - DNA, 873 bp, Homo sapiens
  misc_feature: GYAE6OF01DIWGK.16.38.D05.1.454.CMB.1.raw
  modified_base (204)..(204): a, c, t, g, unknown or other
  misc_feature (204)..(204): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaacnccgccacctctcctgcgacgggccagtcagtagttgttcgacctaaccgtaatttacgccgtacggtaaccagaaccaaaaaccgtcggaccacggcctacccgaggtcctcctacacttcgtacgtggtacgctacttaccgtaacccggacggggacctacgttacgaacgttccggtacccccggtacggggttacccggttcgtaacgggttcggggaccgttaaggggggtttcggggggttttacggggaacgttaaccgggtttaacctttcctaaaccgtttcccgttaaaccctaacccggtaacgttacccgtaccggacccgttaacccccgttaggtacccgttaacggttaccggtttaagggtaaaccggttttacgttttttaacgggaaccttttaaaagtttttacggtttttaacgtttcggttaacctaaggttaccgttaaagttttaacgtttaacttttaccgtaccgggtttacccgtttaacccgtttaaccggttttaaccgggttttaccgggaacccgggtaaggggtaacccgtaaggtaccggttaggtaaacggtaaccgtaaacgtaaaccggttaagttcggtaacggtcgaccgtacctacgtacttcgtttccgttacttccgtactttccccgg

SEQ ID NO: 108618 - DNA, 737 bp, Homo sapiens
  misc_feature: GYAE6OF01BVPBY.16.38.D05.1.454.CMB.1.raw
  modified_base (172)..(172): a, c, t, g, unknown or other
  misc_feature (172)..(172): n is a, c, g, or t
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
tcagtgtactactccacgaccggtgctcgatttagtatctgatagttggggtttgggggaggaactgctcagttaggacccagacggaaccatggaagccccagcgcagcttctcttcctcctgctactctggctcccagacacgactggagaagtagtgatgacgcagtcnccacgccacctgtctgtgtccnccgaaggggaaacnccgccacctctcngcgaggcctagtcgagagtgttcgacctaacctaagttacgaccgtaggtaaccaacggtaaacctaaaaaccgtcggaccgacggtccctacccggacggtccctacctactaacttccgttaaggttcggacgtactaacttaccgtaaccggtacgggaaccctaacgtacggtaaccgtccggtaacccggcgggttacccggttagtaacggtcggtcgttagggttcggggttacggaacgtacgtactcgactctacaactacgtcaacgcctaccgtgacgtacgttacgtagttaagggttacttttacgtaactttaagttttacttacggtcgtaacacgtactaaggttaactttaacgttaccgtacgtccctaacggtttaccttaaacgggttccggaaacccggttaagggaaccctaggtacgttaaggaacttacgtaaaccgtaaacggtctgggtacacggttcaacttacgtacttcttgtactcgtcttacccg

SEQ ID NO: 108619 - DNA, 803 bp, Homo sapiens
  misc_feature: GYAE6OF01DOK7Q.16.38.D05.1.454.CMB.1.raw
tcagtgtactactccacgaccggtgctcgatttagtatctgatagttgggtttgggggaggaactgctcagttaggacccagacggaaccatggaagccccagcgcagcttctcttcctctgctactctggctccagacacgactggagaagtagtgatgacgcagtctcacgccacctgtctgtgtcctccgaaggggaactccgccaccctctctggcaggccagtccgagtagtgtcgacctaccttaagtttacgccgttcggtaaccaagaaccgaaaaaccgtcggaccgacggtcctacccgacggtcctcctacactcgttacgtggtcgactactccgtaacgaccgggcctacgtcggacgttccggtaccgtacgggttccggtcgaaggttcgggtacgtaggttcggggtttaggacgtacgtaccttccgaacttccgtactaccgtataccgaacgccctacccggtcgcctaagttccgtacgtacggtttaagttttgtaaccgtttaatttttaaggttactttaggtaaccgttacgacgttaaacgtttaacgtttaaccgtttaccgttaccgttacccgtttaacccggttacccgttttaaaccgggttttaccgggtaaccccgggtaaacggggttaaccctaaacggggtccgttaaacgggagttaaaaccggtaaacgtaaaacccgggttacggttacgggtaccggtcgttaaccggacccgttaaacctcgtttaccgttacgtttccccggtttactaccgttttcccccg

SEQ ID NO: 108620 - DNA, 638 bp, Homo sapiens
  misc_feature: GYAE6OF01CYAMM.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctccagacacgactggagaagtagtgatgacgcagtctccagccaccctgtctgtgtctccgaggggaaancgccaccctctcctgcagggccagtcagagtgttcgccacaatttagcctggtaccagacaaaacctggccaggctcccaggctcctcatctatggtgcatctaccacgggccacgtgattcgtccccagggtccggttccaggttcggcgtaggttcggggtttagggacgaggtaacctttcaccgttcctcacctacttcacgaccaccctgacacgttcgtggtaggtagtttttgacttaaatttttactttattacgtctagtactaagttacttaactttaccgtgtacccgttaccgttaaccttcgttttacgggaccgtaacggggtaacctagggtacgtagggacgtaacgacgtaaaaccgtacgttggtacggcgttacgacctaaccgtacgttcttaggtttaccttgttccgttcccg

SEQ ID NO: 108621 - DNA, 630 bp, Homo sapiens
  misc_feature: GYAE6OF01BUS1P.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaancgccaccctctcctgcagggccagtcagagtgttcgccaaccaatttagcctggtaccatacaaaaccgtggccaggcctcccaggcctcctcatctagtggtgcatcctaccgacgggccactgactcggacccgaggtccgttcgaggtggcgtaggttgggtttcgggacagtacttcactctaccaccgatcacgccacccgtgctacgtcgtaggtagttatttacgtacttaattttatttatttcgtacagtactagtttaacttaagtttaccgtcggtcccctttaccgttaactttacggtttttaccgggacccgtaacggggaccctaacggcgtaagggtacgtactaacgaaaccggtacgttggtcggtccttgcctaccgtagttccttcgttacttccgtacgttccccg

SEQ ID NO: 108622 - DNA, 833 bp, Homo sapiens
  misc_feature: GYAE6OF01DK3RJ.16.38.D05.1.454.CMB.1.raw
  modified_base (209)..(209): a, c, t, g, unknown or other
  misc_feature (209)..(209): n is a, c, g, or t
tcagtgtactactccacgaccggtgctcgatttagtatctgatagttgggtttgggggaggaactgctcagttaggacccagacggaaccatggaagccccagcgcagcttctcttccctcctgctactctggctcccagacacgactggagaagtagtgatgacgcagtctccagccctaccctgtcctgtgtctccgaggggaaacnccgcccaccctcctcctgcgacgggcctagtcaagtgtcgttcgaccctaacctaatttacgccgtacggtaaccaacgaaccaaaaaccgtcggaccaacgggccctacccgacggtcctccctacaacttccgttaagtgggttcgactacttcccgtaacccggacgggcctaacgtacgtacgttccgtccccgaacgggtccgtttacgaagggtcggtcggtagggtttcgggggtttacggaaccgtacggttaacctttacctacccgttacccgtttacccaaccttaaccgttcgaaccggtcccctaacccgttcgtaccgtacgtccggttaggtaacggtttagttttactaacgttttaagttttaatttaacgtttcgtaacgtactaacgttaagtttaaagtttaacgttacgttccgtacccgtttaaccgttaaccggtttacggttttacggacccgggttaaagggtaaccccgtaaggtccggttaacgggtacgtaaaaccgtaagtaaaacccggttaagttacgggtttacggcgttaccggtacctaacccggttaacttcgttacccgtttccttaccgtcccgtttaaccccccgg

SEQ ID NO: 108623 - DNA, 898 bp, Homo sapiens
  misc_feature: GYAE6OF01E5ZRR.16.38.D05.1.454.CMB.1.raw
tcagtgtactactccacgaccggtgctcgatttagtatctgatagttgggtttgggctgggagacgagcccagcactggaagtcgccggtgtttccattcggtgatcagcactgaatacagaggactcaccatggagtttgggctgagtcgttgggttttcccttcgtttacttcgttttaaaggaggttgtaccaatggttcagggtgcgtaggttgggtggtaggtcggtggggggacggtcggttggtcccaggtcccgtagggtaaccggtccctaggacgtaccttccgttcggtggtcgccgaggtccggttcgtggtaactttctattttacttttaaagtttcgttttcctagtcgtccgtacggtcggtacctccccggaccgacgggtccctaccggaacggggaccgggtaggggggtaccgttggggtacggggttgggggtacggtacggtaaggggttgtttaccggtaccgttaccgttagggaacggtacgggtaaccgaaacccgttaaagtaccgtaacgtttacccggtaccggtaccgtaacccggtacccggtaccggggtaacggtaacccgggtccgttaaccttacccgtaaccgttaccgtttaaccggaaggtaaaccgttaaacgtaaccttaacccgaaacccgtaacccgaccgtacgtacgacctacgtacgtaacgaaccgtaacgtacccggtaacccgtaacccgtaacggtacccggtaaccgtacgggaacccgtacccggtaccggttacttaccgtttaaccgttacgtttacgttcggttaggtacgttcggtttacctttacgtttacggtttacggttcgggtttaccggttccggtttaaccgtcgggtacccgggg

SEQ ID NO: 108624 - DNA, 798 bp, Homo sapiens
  misc_feature: GYAE6OF01CQ3B7.16.38.D05.1.454.CMB.1.raw
  modified_base (202)..(202): a, c, t, g, unknown or other
  misc_feature (202)..(202): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgagggaancgccaccctctcctgcgagggccagtcagtagtgtcgacctactaattacgcctggtaaccagaccaaaacgtcggaccacggtcctacccgaggcctcctactacttccgtagttcggtcgtacctacgtaccgtaccgacgggtacccaacgtcgtacgtccggtaccccgacgggtacccggtttacgtacggtcggtcggtaggggttagggggtttcggaaccgtaggtacctttccgactcccgtacccaacctacgtaccgaccgtacccgtaccgtacgtaccgtacgttccgttagggtaacggtttagttttcggtaactttaaattttagtttacgttcgttaacgtacgtaccttaagtttaaacgtttaacgtttaccgttaccgggttaccctttacccggttaaccgtttaccggtttttaccgggaacccgggtaaccgggtaaccgttaccggtacggtacgggtaacgtaaaccgtaaaccggtaaaccggttaacgttcggtaaccgggtccctaaccggtaccctaacccgttaaccgttcttaccgtttaccgttaaccgttcccgtttaccccg

SEQ ID NO: 108625 - DNA, 654 bp, Homo sapiens
  misc_feature: GYAE6OF01C8QJ1.16.38.D05.1.454.CMB.1.raw
  modified_base (201)..(201): a, c, t, g, unknown or other
  misc_feature (201)..(201): n is a, c, g, or t
  modified_base (488)..(488): a, c, t, g, unknown or other
  misc_feature (488)..(488): n is a, c, g, or t
  modified_base (579)..(579): a, c, t, g, unknown or other
  misc_feature (579)..(579): n is a, c, g, or t
tcagtgtactactccacgaccggtgctcgatttagtatctgatagttgggtttgggggaggaactgctcagttaggacccagacggaaccatggaagcccagcgcagcttctcttcctcctgctactctggctccagacacgactggagaagtagtgatgacgcagtctccagccacctgtctgtgtctccgaggggaacncgccaccctctcctgcagggccagtcagagtgtcgccactaatttacgcctaggtaccagacaaaaccgtggaccaggcctccgaggcctcctcactctatggtcactactctaccgacgggccactgtacttcggtacccgacgggtcccggttcgaggtcggcgtagggttcggggtttagggacgtacgtacgttccacgttctcacctactcgacgcctaccgtcgctacgtcgtaggaggttacttttacgaactttaatttactttagttcgtactacgtntaagtttaacttaacgtttacctacggtcccttacggttactttacggtttcggaccggtaacgggtaaccacggttacgtacgggaaacncgttaacgaaaccgtacgttagggtacgtcgttagaccctacgttacttcgttcttacctcgttaccgttccccg

SEQ ID NO: 108626 - DNA, 894 bp, Homo sapiens
  misc_feature: GYAE6OF01EU3F2.16.38.D05.1.454.CMB.1.raw
  modified_base (524)..(524): a, c, t, g, unknown or other
  misc_feature (524)..(524): n is a, c, g, or t
tcagtgtactactccacgaccggtgctcgatttagtatctgatagttgggtttgggctcaactctcttgtctcaccatggagtttgggctgagcgttgggttttcctcgttacttcttttaagaggtgtccaatgtcaggtgctaggttggtggagtcggtgggggaggtcgtggtccagccgttaggaacggtccctgacgtacctcgtcgtggtcgacaggtcggttctaggtactttactattttaccttttaaagtttaccgtttttccctaatcggtacctaacggttagggaaccttccccggaaccgacgggtaccctaccggacggggaccgggtaacgggggtaccgttggggacggggttggggtacgggacggtagggtacgttcggtactaacggtttgaacgtacggacgtacctaagtactactaaccgtcgacacgtccggtcgtaaggaccgggtactacttaccgaacttacttacgaagtaacgaactaactaaccaaacgtaccnccggtctacggtaccagttaccgtacgaacctaaacggtccggtaaccctaccgttaacgaaccggtaaccgtaacgaacccggaaccggtacggtaccgtttaccgtttacgtttaacgttacggttacgtacggttaacgaacgtttaaccctttgggtttaaccgttcggggtttaccgggtttaccggttaacgttttccggaaccgggtttaccggggttacgggtacccgttacgggtacccgtttcccggttaccggtacccgttaccgttcccgtaccgtaccggtacccctacccggacccgttaacccgggacccgtaccgttaaccccggtttcccccgttcccgtcccccgtaaccgg

SEQ ID NO: 108627 - DNA, 960 bp, Homo sapiens
  misc_feature: GYAE6OF01EDO0F.16.38.D05.1.454.CMB.1.raw
  modified_base (212)..(212): a, c, t, g, unknown or other
  misc_feature (212)..(212): n is a, c, g, or t
tcagtgtactactccacgaccggtgctcgatttagtatctgatagttgggtttgggctcaactctcttgtctcaccatggagtttgggctgagcttgggttttcctcgttactcttttaagaggtgtccaatgtcaggtgctagttggtggagtcgtgggggagcgtggtccagccgtggaacggtccctgagctctcgtgtgcagcgtacnggtacttcagttacttttaaattcgttttcctatcgactacgtggactccgacgaggcctaccgaggcgaggggtctagggtaggtgggtaggacgaaggtgttcgtacgtagttggaagtcgggaactacctaaagttactacgttaccgttcgactacggtaccgttaccgggtaggaacgggtccctaagttcccaaccgttaagtttaccgaaggtaacgtaaacgtaaaccttaacccgaaaaccgtaacgtacccggtcttacgacgtaaaccgttcttaacgggaaaacttaaaccggtaccgggtaacccctacccgttaacggaacccgtaacccgttacgggaaacccgtaaccggtaccgggtaccgtttaacgttaccgtttaacgtttacgtacgggtttaggtacgttaacccgtttacgttttaaccggtttacggtttacgggtttaccccgggtttaccggggtttacccttttaaccggggttaacccggtttacccgggggttaaccgggggtaaccccggtttaaccggggtttaccccgtttacccccgggtttacccgggtttaacccgttacccccccggtttcccgttaacccgttacccccggtaacccggttacccccccgttaacccccggaacccgggttaaaccccccggttccccggttaaacccccggggtttcccccgggttttacccccccctccccccgggggtttaacccccg

SEQ ID NO: 108628 - DNA, 835 bp, Homo sapiens
  misc_feature: GYAE6OF01CX9W5.16.38.D05.1.454.CMB.1.raw
  modified_base (204)..(204): a, c, t, g, unknown or other
  misc_feature (204)..(204): n is a, c, g, or t
  modified_base (401)..(401): a, c, t, g, unknown or other
  misc_feature (401)..(401): n is a, c, g, or t
  modified_base (471)..(471): a, c, t, g, unknown or other
  misc_feature (471)..(471): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctccagacacgactggagaagtagtgatgacgcagtctccacgccaccctgtctgtgtctccgaggggaacncgccaccctctcctgcgacggccagtcagtagtgttacgacctaacctaagtttacgccgtacggtaaccagaccaaaaaccgtcggaccacggacctcccgaacggtcctcctacacttcgttaagtcggtgactactaccgtaaccggacgggcctaacgtcgtacgtccggttacccgacgggtccggttacgnggttacgggcgttaggggttcggggtttacgggaacgtacggttaccttacgactccgtaccaacccgtnttaccgacgacctacccgtacgtaccgtagttccgtagggtaacggtttactttttacgtaacgttttaaagtttttactttaacggttttacgtaacggtacgttaacgttaacggttttaaaactttaaccggttttaaccggttacggtttacccccgtttaaccgtttaaccggttttaaccggtttttaccggggaacccgggttaaaccgggggttaaccaacgggttaccggttaacggggtaaactaaaccgggttaaacctaaaaccgggtaaggttccgggttacggttacggtacctacccggtaacttaccgttacgttcgtttaacccttaccgttccgttttaacccccg

SEQ ID NO: 108629 - DNA, 724 bp, Homo sapiens
  misc_feature: GYAE6OF01C8BJJ.16.38.D05.1.454.CMB.1.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctccagacacgactggagaagtagtgatgacgcagtctccagccaccctgtctgtgtctccaggggaanccgccaccctctcctgcagggccagtcagngtgttcgccaacctatttacgcctggtaccagacaaaactggccaggctccaggctcctcatctatggtgcatctaccgaggccactgatcgtcccgacggtccggttgaggtggcgtaggttgggggttttgggaaccgtacggtacgtttcaacttcctaccgaccaattccacgaccaccctgaccacgttccgtaggtacggttactttttaggacctttaaatttttagtttaagtttcggtacgtaagtaccgttaaggtttaactttaaaccgtttacgttaccggtacccgtttaccccggtttaaacgtttacccgggtttttccgggacccggtaacggggtaaccctaacgggtacgttaacgggaacgtaaaccgtaaccggtaaaaccgtaacggttagggttacgggtaccgttaccggacccttaacccgtaacgtttcccgtttacgtttcccttaacgtcccgttttaccccccgg

SEQ ID NO: 108630 - DNA, 765 bp, Homo sapiens
  misc_feature: GYAE6OF01B6S8C.16.38.D05.1.454.CMB.1.raw
  modified_base (303)..(303): a, c, t, g, unknown or other
  misc_feature (303)..(303): n is a, c, g, or t
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtcgtgggggaggcgtggtccagcctggaaggtccctgagactctcgtgtcgcagcgtctggattcattactttaattacgtttttccattgacctacgttggactccgccgaggcctaccgaggccgaggggactgggagtgggtgcgaggngtgctacgttgagtggagaccaatacatactcgcacgtctccggaggacggccgtataccacctattaccaaggacgtaacgtaacttaacccgaaacaaccgaccgtctcgacctaactccgtagaaccgtaaagtaccgggaacccacccgtacggaaccgtaccgtaacggaaccgtaacgtaccggcgttacgttaccttaaggttacgttggttacggtagtaaccgttactttacttttaaggttcggtttaccgggtttaccgggttcgttttaccgggtaaccggtttacccgggtacggggtacccggttaacggggtaccctttccccgggtgggttacccccgtcccgttcccgttaccccgtacggaccccgttacccccgtaacccgtaacccgggtaacccgggtaccccctacggttcccccggttccccgttcccccgtaccccgg

SEQ ID NO: 108631 - DNA, 795 bp, Homo sapiens
  misc_feature: GYAE6OF01DTACM.16.38.D05.1.454.CMB.1.raw
  modified_base (151)..(151): a, c, t, g, unknown or other
  misc_feature (151)..(151): n is a, c, g, or t
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactgganaagtagtgatgacgcagtctccagccaccctgtctgtgtctccgagggaancgccaccctcncctgcgagggccagtcagagtgttcgccactaatttagcctgtaccagacaaaactgccagctccagctcctcatctagtggtcgcacgtctaccgacggccacgtgactcgtaccgacggtccgttcgaggtcggcgtagggttgggtttacggacgtacggtacctttacgaccttacctaccgacctaacgtcgaacggtaccctaacccgttgaaccgttcggttaccgttaggtaacgggtttactttttacggaacctttaaacgtttttattttaacgtttcggttaacctaggtacgttaaaggtttaactttaaacgttttaacccgttcggggttaacccctttacccggtttaaaccgtttaaccggggtttttaccggaacccgggttaacggggggtaacccctaagggtacccgggttaagggtaacgttaaaccgttaaccggtaaaaaccgggtttaaccggttacgggttacgggttaaaccgttaccgggtaaaccccttaacccgttaaacgttttcccggttaccggttttaccctttcccggttaaccttttaccccccgg

SEQ ID NO: 108632 - DNA, 763 bp, Homo sapiens
  misc_feature: GYAE6OF01A9H6H.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtcgtgggggaggcgtggtccagccgtggaacggtccctgagactctcgtgtgcagcgtctggattcattctttaatagttttccatgcactggactccgcaggtcctcgaggcggtagggactgggaggtgggtgcgaggtagtggtcaagttgagtaggacgacctaaatacgattaccgttacgacagtaccgtacggtaggaacgggtcctaactaccgtaacctacgttccgaagtagaacgtaaactaccaaacaacctacgcgtacgactagtactagaacgtaacgtccgaaccacccgtagaaccgtaccgtacggaacgaaccgacggtacttacgttacttaacgttacgttcggtagtacggaacttacgtttacgtttaggttacccgttccggggtttacggttccgtttaccggtaacgttacggggtaccggtaccgggtaccgggttaccgttacccggtccgggttacccgttacccggtttccgtaccccgttacccgtacccggttcccccgtaaaccccgtaaccccgggtaaacccggcccccgtttaaaccgttcccccggttccccccgttaaccccggtaccccccgg

SEQ ID NO: 108633 - DNA, 819 bp, Homo sapiens
  misc_feature: GYAE6OF01C3NBG.16.38.D05.1.454.CMB.1.raw
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggcctcccagacacgactggagaagtagtgatgacgcagtctccagccaccctgtctgtgtctcgagggaacnccgccnccctctcctgcagggccagtcagagttgttcgacctacctaatttacgccgtaggtaaccagtaaccaaaaccgtcggaccgacggcctacccgacggcctcctacactctagtggtgacacgtcctaccgacgggcctacgtgtacgttcggtacccgacgggtcccggtttacgacggttcgggtcgttaggggtttcgggggtttacggggaccgtaacggttaccgtttacctaaccgttccctaccctaaaccgtacgtaccaccggtaccctacccgtagaccgtacggtttcgtacgggttacgtttaacgttttttcggtaacttttaaaacgtttttacttttagtttacgtttacgttacgtacttaagttttaacttaaacttttacggtaccggttccccgttaaccgttttacccggtttacggtttttaccggggacccgggtaaaccgggggtacctaacgggtacggttaacgggtaacgttaaaccgtaacccgttaaaccggttaaacggttcgggttaacgggtcccgttaacgacccgttaaacccttacggtttcctttacggtttacccttcttccccgtttcccccg

SEQ ID NO: 108634 - DNA, 758 bp, Homo sapiens
  misc_feature: GYAE6OF01BOA4P.16.38.D05.1.454.CMB.1.raw
  modified_base (689)..(689): a, c, t, g, unknown or other
  misc_feature (689)..(689): n is a, c, g, or t
tcagtgtactactccacgaccggtgctcgatttagtatctgatagttgggtttggggctgggagacgagcccagcactggaagtcgccggtgtttccattcggtgatcagcactgaatacagaggactcaccatcggagtttgggctgagcttgggttttcctcgttactcttttaagagtgtccaatgtcaggtgctagttggtggtagtcgtgggggagcgtcggtccaggcctaggaacggtccctgacgtactcgtcgtgtgcagcgtctgattctattactttaatacgttttcctatcgcactggactcccgacgacgtcctccgaaggccggaacggggtctacggggtaggtcggggtggacgtagggtacgttcggtaccgtacgttgaagttcggaactacccgtaaagtacctaagttaccgttaccgtaccgtaacgtaaccccggtttaccgggtaacgggtaaaccgggtaccccgttaactttaaccgtaaaccccgttacgtttaaccccgaaaggtaaacgaaaccggtaaaccttaaccccgaaaacgtaacccgtaccggttaaccttccgaacgtaccttacgtacaaaccgttaaagtcccgaacccgtacctacggaaccgttaccgacgaacccgtaacgtccggtcgtagtacttagttaaccgnggttacgagttcctacttacgttacggttccgtacgggtttaccggtctttcggggaccttaccggggg

SEQ ID NO: 108635 - DNA, 890 bp, Homo sapiens
  misc_feature: GYAE6OF01EPO3X.16.38.D05.1.454.CMB.1.raw
  modified_base (205)..(205): a, c, t, g, unknown or other
  misc_feature (205)..(205): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggcctcccagacacgactgggagaagtagtgatgacgcagtctccagccaccctgtctgtgtctcgaggggaacnccgccaccctctcctgcgagggccagtcagtagttgttcgaccaactaagtttacgcctaggtaccacgaaccaaaaccgtcggaccacggtcctacccgacggtcctccctacgtacttctaacgtcggtacgacctacgttaccgtaacccggacgggacctacgtacgtacttccggtaccccgtacgggtccggttacgacgggtcggtcgtacggggtttagggggtttacggaacgtacggtaccttaccgtaccttcctaccgacctacttaccgaaccgtaccctaacccgttcgaaaccgttcggttaccgttacgggttaacgggttttaacttttaacggtaaacttttaaattttttaacgtttacgtttacggttacgtaacggtacgttaagtttaactttaaccgtttaccgttaccggttaccccgtttaacccggtttaaccgtttaacccgggtttttaccggggaacccgggtaaaccgggggttaacccttaacgggtaccggttaacggggtaaacgttaaaccgttaaacccggtaaaacgggttaaccgggtttacgggtaccggggttaccctaaccgggtaaccccttaaaccccggttacgttttacccgtttaccggtttaacccgtttaccccgttaaccccggttttaccccccgg

SEQ ID NO: 108636 - DNA, 859 bp, Homo sapiens
  misc_feature: GYAE6OF01DYNM2.16.38.D05.1.454.CMB.1.raw
  modified_base (210)..(210): a, c, t, g, unknown or other
  misc_feature (210)..(210): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggcctcccagacacgactggagaagtaggtgatggacgctagtctccagcccaccctgtctgtgtcgtacgaggggaacnccgccgaccctcgtccgtggcgacggcacgtcgaggtagttgttcgaccctaacgtaatttcggccgttacggtaaccaacgtaaccaaaaacccgtcggaccgacggtacccctcccgaacggtccttcctactacttactacgttacgggttacgaccgtacgtaccgtaccggaacgggccctacgtacggttacgtaccggtacccggtacggttcccggtagtaccgggttggtaccggttaggggtttcgggggttttacgggaaccgtacgtttacccgttacctaccgttacccgtaccctaccgtaacgtacccgtaacgtaccccgtccggtagtaccggacgtttaccgtaggtttaaaccgggtttactttacgttactttaaacgttttagtttaagtacgttacgtaaacgtacgtttaacggttttaaacttaacggtttacccgtcgggtttaccccgttacgttaacccggttttacgggtttacccgggaccggggtaacgggtaacccggtaacggtcgggttaacgtaacggtacccgtaaaacgaaacgggttccgttaagggtccgtaccgtacgtaccgttaacctacgtttacgtacccttacgtttaccctcccggttaacccg

SEQ ID NO: 108637 - DNA, 690 bp, Homo sapiens
  misc_feature: GYAE6OF01AC2EE.16.38.D05.1.454.CMB.1.raw
  modified_base (206)..(206): a, c, t, g, unknown or other
  misc_feature (206)..(206): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtcctaccgaggggaacnccgcccaccctctcctgcgagggccagtcagagtcgtcgacctactattacgccgtaggtaccagaaccaaaaccgtcggacccacggcccttacccgaggcccttaccgtcattcctaagtcggggtcactacttaccgtaccggacgggccctaactcgtacgtccggtcccgacgggtcccggttatcgggtacggtcgtaggggtttcgggggttacggtaacgtagtaccgttaccacgttacccgtacaccctagtcccgaacgtcccaacctcgctacgttcgtaagtggttactttacggaacttttaatttacgttagttccgtagaccgtattacgttattaacgttccgtacgtccttacccggtattaccggtttcgacggttacggacagtcgtaggacactaacgtaacggtacttggtcgacggtccacccgtacgtactttccgtacgttcctccgttccttaccccg

SEQ ID NO: 108638 - DNA, 717 bp, Homo sapiens
  misc_feature: GYAE6OF01A5SDO.16.38.D05.1.454.CMB.1.raw
  modified_base (312)..(312): a, c, t, g, unknown or other
  misc_feature (312)..(312): n is a, c, g, or t
  modified_base (463)..(463): a, c, t, g, unknown or other
  misc_feature (463)..(463): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctcgaggggaagcgccaccctctcctgcagggccagtcagagtgttcgcccacctaatttacgcctaggtaccagaccaaaaacccgtggacccagggacctccccgacggcctccctcgtntcctatggtcgctagtcctaccggacgggtaccacgtagacgtccggtacccgtacgggtcccggttacgaggttcgggcgtagggttcggggtttacgggacgtagtaccgttctacctcgtaccaaccactccgacgacccctacccgngtacgtacgttcgttaggtacgttattttcggtaatttaatttttagtttaatttcggttacgtaacgtacgttaacgttaattaacttaccgtacgggtcccttaacccgttaaccgtttacggtttaccggacccgggtaaggggtacccaaggttaccgtaggaacgtactaaaccgtaaaggtccttagggtcggttcgtaccgacccgtaacctgttcccgttagttcctttaccgttccttaccccgg

SEQ ID NO: 108639 - DNA, 966 bp, Homo sapiens
  misc_feature: GYAE6OF01EJO0V.16.38.D05.1.454.CMB.1.raw
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtcctccacgccacccttgtcgtgtgtcctccgaaggggaacgccgcccaccctctcctgcgagggccagtcagagttcgtcgcctactaatttacgcctaggtaccagaaccaaaaccgtcgaccacggcctacccgagtcctcctacactcgtagtggtcgtactacgttaccgaccggtaccgggacctacggtacgtaacgttcccggtacccggtacgggttcccgggttacgtacgggttcggggacggtttacgggggtttacggggggtttacggtaaccgtacggttaccctttaccgtaaccgttccctaaccgacccgttacgtacccgtaaccgtacccgtacccgttacggacccgttacgttaccggttagggtttaaccggttttaacgtttttacgaaacgttttttaaacgtttttaacttttacggtttacggttaaccgtaacgtttaccgtttaaaacggtttaaacgttttaaacgttttacccgggtaccccggtttaaccccgttttaacccgggttttaaccgttttaaccggggtttttaaccccggggaacccggggttaaaaccggggttaacccgttaaacggggttacccgggtaaacgggttaaaccggttaaaacccggttaaaaccgttaaaaacccggggttcgtttacggggggttaccgtaaccccggttaccggttaaacccccgttaacggttaacccgttttcccggtttaacccgtttttaaccccgtttacccggttaaccccgtttttcccccccggg

SEQ ID NO: 108640 - DNA, 773 bp, Homo sapiens
  misc_feature: GYAE6OF01C9ZPP.16.38.D05.1.454.CMB.1.raw
tcagtgtactactccacgaccggtgctcgatttagtatctgatagttgggtttggggctgggagacgagcccagcactggaagtcgccggtgtttccattcggtgatcagcactgaatacagaggactcaccatggagtttgggctgagcttgggttttcctcgttactcttttaagaggtgtccaatgtcaggtgcagttggtggagtcgtgggggaggcgtggtccagcctggaacggtccctgacgactctcgtgtgcagtcgtctggattcattcttttaaattacgtttttcctaatgctacgtggactcccgccaggctccgaggcgaagggctggagtgggtgcaggagtgtcacttgatggacgcctaatactataccttcgacgtagtaccgtccggtaggaacgggtccgtaactttaccacccgttaacgttttacccgaacggtaacgtaacggtaaacctttaaccccgaaaccgtaaacccgtaccggtaccgttacggaacctaacgttacgtacggtaaacccaaaacggttccggaaaccctaacccccgttacgggaaccgtaccccgttaacggaacccggtaaccgtaaccggggttcccgtttaacggttacctttaaacgtttaacccggtttacggttacgggttaacggtaaccgttacccgtttttaccgtttaacggttttcccggggttaccgggtttttcccggggtttaccgttttaccgggtaacccggtttaacccgggggg

SEQ ID NO: 108641 - DNA, 768 bp, Homo sapiens
  misc_feature: GYAE6OF01C8S0P.16.38.D05.1.454.CMB.1.raw
  modified_base (139)..(139): a, c, t, g, unknown or other
  misc_feature (139)..(139): n is a, c, g, or t
  modified_base (147)..(147): a, c, t, g, unknown or other
  misc_feature (147)..(147): n is a, c, g, or t
  modified_base (203)..(203): a, c, t, g, unknown or other
  misc_feature (203)..(203): n is a, c, g, or t
  modified_base (325)..(325): a, c, t, g, unknown or other
  misc_feature (325)..(325): n is a, c, g, or t
  modified_base (459)..(459): a, c, t, g, unknown or other
  misc_feature (459)..(459): n is a, c, g, or t
tcagtgtactactccacgaccggtgctcgatttagtatctgatagttgggtttgggctcaactctcttgtctcaccatggagtttgggctgagcgtggttttcctcgttactcttttaagaggtgtccaatgtcaggtncagttggnggagtcgtggggaggcgtggtccagcctggaacgtccctgagcttctcgtgtgacncgcgtcgtggacttctattcttttaagttcgtttttaccagttcgactaacgtcggaacctcccgaccaggtcctccgacgggtacgagggaccgtgggtaggtcgggtcggacgtaagggnggttcctacgtacgttcgtagacggacgtacctaaagtacctattaccgtcgactacgaccgtaccgtagggaccggtaccttactacgtacctagttcgagacgaagtaaactccgaaactaacgcgctacgntacatcgaaactaacgtcggaacctaccgagtaccgaccgtacgaaaccgtctacccggcttacggtaatttacgttaggtcgttagtaccggtaactacggtttactttagggttccgttccgggtttccggttaactttccggtaccgttacgggtcccggggtactccgggttaccgtccggtacccggttccgaacccgtttcccgttacccgaccgttccccggtacccgtaaccccgacccgggtaaaccccggtctttaacccccggtccccttaaccccggtttcccccgtaaccccccgg

SEQ ID NO: 108642 - DNA, 786 bp, Homo sapiens
  misc_feature: GYAE6OF01B2EDW.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtcgtgggggagcgtggtccagcctggaacgtccctgagactctcgtgtgcagcgtctggattcattctttaattagttttcctatgctacgtggactcccgcaggcctccgaggcgaggggactgggaggtgggcggcgaggtgtgtactacgttgagtggactccaaagtaccacttactcgacgacgtaccgtcggtaggaacggcctattaccaaccttatttaccgaggaactaaacgtaaattaccccaaaactaaccgaccgtcgtagccttaactccgtaagaactaaacgtccgggtaaccctacccgtacggaacgtacccgtacgggaacccgaacgaaccggtacttacgttactttaacgtttaccgttagggtttagttacggtaacttacgtttacgttttacgttcggtttaccgggtttaccggttaccgttttacggtaaccgtttcggggttaccggggtaccggtaacggggttacccgttacccggttcggttaccccgttacccgttccttcccgtacccggtcccgttaccccgtaaccccgtaacccggtaaacccgggtcccccgttaaacggttcccccgggttttccccgttccccccgttaccccggg

SEQ ID NO: 108643 - DNA, 800 bp, Homo sapiens
  misc_feature: GYAE6OF01DMLMB.16.38.D05.1.454.CMB.1.raw
  modified_base (212)..(212): a, c, t, g, unknown or other
  misc_feature (212)..(212): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggcctccagacacgactggaagaagtagtgatgacgcagtcctccacgcccaccctgtctgtcgtcctacggaaggggaacnccgaccctaccctctcctgacgacgggccagtcgagtacgttcgtcgacctaacgttaatttcgaccgttacggaacacgaaccaaaacgtcggaccgacggcctacccgacgcctaccgtctacttcgtagtcgggtctactaccgttaccgtaaccggacgggtacctacgtacggacgttccggtacccgtaccgggtccggttacgagggtcggtacggttaggggttacgggggtttacgaacgtacggttaccttaccgaccttaccgtaccctaaccctagtacccgaccgtcccgtaacccgtaccggactacggttcgttaaggtacgtttacgtttacgtaacttttaagtttattacgttaggtactaacggtacttaagtttaacttaacgttaccggttaccgtacccgtttaacccggtttactttaacccggggttccgtaaccggggtaccggtaaccgtacggtacggttaacgggaacgtaaactaaacccggtaaacggttacgtagttccgggactacgacccgttacgtacgtttactacggtttcccttaccgttcccttaccccg

SEQ ID NO: 108644 - DNA, 606 bp, Homo sapiens
  misc_feature: GYAE6OF01AJBA4.16.38.D05.1.454.CMB.1.raw
  modified_base (394)..(394): a, c, t, g, unknown or other
  misc_feature (394)..(394): n is a, c, g, or t
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtcgtggggggaggcgtggtccagcctggaaggtccctgagactctcgtgtgcagcgtctggattcattctttaatacgtttttcctatgcatggactcccgccaggtcctccgaggccgaggggactgggagtggggtggcaggagtgtcacttgagtggagccaatacatactcgcagactccggagaacgggccattccacctatttccaagagacgtaattccaacaacacgctgcatcngacaagcgaccaccctagaccgactagacgacgacggctgtctatacgttgtgtagacgtacttacttgttcgccggtttcggtcgtttacgaccgttacgtcgggtcgacgggtctcccggtccggtacctccgttccctaccctcctccgtccctacccgacccggtacccggtacccgaccgttcccgttccccgttccccgtccccgg

SEQ ID NO: 108645 - DNA, 688 bp, Homo sapiens
  misc_feature: GYAE6OF01EIJ01.16.38.D05.1.454.CMB.1.raw
  modified_base (203)..(203): a, c, t, g, unknown or other
  misc_feature (203)..(203): n is a, c, g, or t
  modified_base (403)..(403): a, c, t, g, unknown or other
  misc_feature (403)..(403): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaanccgccaccctctcctgcagggccagtcagagtgttcgaccactaatttgccgtaggtaccagacaaaaccgtggccacggctcccaggctcctcatctagtggtgctatccgtaccgtacgggacctacgtgacttcgacccgtacggtccggttacgaggtggcgtagggttggggtttacgggactacggtacttacnccgttctaccgacctactccgacgtaccctacccgtgtacgtcggttaccgtagtaacgggtttacttttggtaacgttaaaattttttagtttattttacgggtactaagttaccgtaagtttaactttaagtttaccggttccgtaccctttaccgtaccgtttacgttttcgggacccggtacgggaaccttagcggttagggactaaacgtactaaacggtaccttgggtacggtcttacgaccacgttacgttccttagttccttcctcgtttacccccg

SEQ ID NO: 108646 - DNA, 758 bp, Homo sapiens
  misc_feature: GYAE6OF01B7BVZ.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtcgtgggggaggcgtggtccagcctggaaggtccctgagactctcgtgtgcagcgtctggattcattctttaatagttttccatgcactggactccgcaggcctaccgaggcgaggggactgggaggtgggtggcgaggtagtgtcacgttgagtggagacctaaatactagttaccgttcgactaacggtaccgtccggtaggaacgggtccgtaacgttccaacccgttatttacccgaaaggtaacgtaacgtaaacctttaccccaaaacgaaccctaaccggtctacgactaacgttactacgaactaaacgtccggaacctacccgtagaaccgtaccgtacgaacccgaacgtaccggtacttcgttacttaacgtttacgtcgttcggtacgtaacgtttaccttcgtttaacgtttcggtaccgggtttaccgggtacttttacggtaaccggttacgggttacggggtacccgtaacgggtacccgttcccggtacggtcccgtacccgttccttacccgtcctacccgtacccctaacccggaacccgtacccgggtccctaccggttccccggttccccgttcccccgtacccgg

SEQ ID NO: 108647 - DNA, 924 bp, Homo sapiens
  misc_feature: GYAE6OF01CUKQN.16.38.D05.1.454.CMB.1.raw
  modified_base (217)..(217): a, c, t, g, unknown or other
  misc_feature (217)..(217): n is a, c, g, or t
tcagtgtactactccacgaccggtgctcgatttagtatctgatagttgggtttgggggaggaactgctcagttaggacccagacggaaccatggaagcccagcgcagtcttctcttcctcctgctactctggcctcccagacacgactggaagaagtagtgatgacgctagtcctaccacgccctacctgtctgtcgtccgtaccggaaggggaacnccgtaccctaccgtttccgagccgaggacctagtcgtacgtagtcgttcgacctaaccgttaatttacggaccttacgggtaaccaacgaaaccgtaaaaacccgttcggaccgaacggtccctaccgaacggtccttaccgtactacgttcttaaggtcggttcgacctacgtaccgttaaccggaccggtcctaacgtacggtacgttacccggtaccccggtacggtacccgggtttacgacggtcggtacggttacgggtttggggttaaccggtaaggtaaccgtttacctttaccgtaaccttacctacccgtaaacctacgtacccgaacgtacccgtaccgtagaccgttaacggttcgttaacgggttacggttttatttaacgttaacgttttaacttttacgttacgtttagtaaccgttaagttaaccgtttaaaggttttaactttaaacgtttaccgtacccgttaccccggttaaccgttttaccgttttaccgggttttaaccgggaacccgggttaaaccgggacgttaaccggggtacgtttaacggggtaaaccttaaaaccgttaaaccgggaaaaaccgtttacggttacggggtaccttaaccggttaaaccgaccccgttaagttaaacccgtttccgtttacgtaaccccttttaaccgccccgtttaccccgttaaccccgg

SEQ ID NO: 108648 - DNA, 636 bp, Homo sapiens
  misc_feature: GYAE6OF01D5KXL.16.38.D05.1.454.CMB.1.raw
  modified_base (203)..(203): a, c, t, g, unknown or other
  misc_feature (203)..(203): n is a, c, g, or t
  modified_base (346)..(346): a, c, t, g, unknown or other
  misc_feature (346)..(346): n is a, c, g, or t
tcagtgtactactccacgaccggtgctcgattttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaanccgccaccctctcctgcacgggccagtcagagtgttcgccactaagtttacgcctggtaccagacaaaaacctggcaggctccagctcctcatctatggtcgcatctaccgagggccactgactcgtcccgtagggccggttnacggtggcgtaggttggggtttacgggactagcttaccacttcctcacctataccacgaccctaccctgctacgttccgtagtacgggtttattttcgacttaaatttttatttatttagtccaagtactaagttaatttaattaccgtcggtacccttaccgttactttaccggttttacggaccgtaacggggtacctaagtcgggtaggaagttacgtaacgaaacggtacttaggtcggacttcgctaacccgtacgttcttaacgttccttcgtctttaccccgg

SEQ ID NO: 108649 - DNA, 832 bp, Homo sapiens
  misc_feature: GYAE6OF01A0MW8.16.38.D05.1.454.CMB.1.raw
tcagtgtactactccacgaccggtgctcgatttagtatctgatagttgggtttgggctcaactctcttgtctcaccatggagtttgggctgagcgttgggttttcctcgttacttcttttaagaggtgtccaatgtcgaggtgcgtaggttgggtggaggttcggtggggggacggcgttcgggaccacggccgtacgggaacggtcccctggacgaccttcgtccggtgtcggcgtaggtccgttcgtggtattctatttacttttaagtttcttttccagtcgcgtagtggacctcccgccgtaggcctccggaggaccggaggggtagtcgggtaagggtcgggtggacggaagggtgttcgtacgtacgttggagtcggacgaacctaaagtcctagttaccgtggaactacggtaccgtcggagaacgggtcctaacttccgtaacgtcttaagaacgtagtaacgtaacctaccgaaacaaccggtcgtacacgacttacgtacgtacgaaagtaaccgtcggaccttacccgagaaccgtacgaaccgtacccgaacggtaccgtcgttaagtaccgtttagtccgttaggtcgtaaccgtacgttcctttacgttacgtccgggtttccgttaccggttcgggtttaaccgtacgggttacccggttcggggtaacccgttacggtcccctttaccgggtaaccgtttcccctttaccccggtcgtttaacccccgtcggaccccgtccccgttaaaccccgggacccgaacccggtttacccgtcccgttacccccgggttccccctaaccccgggtaccccg

SEQ ID NO: 108650 - DNA, 756 bp, Homo sapiens
  misc_feature: GYAE6OF01D8HPJ.16.38.D05.1.454.CMB.1.raw
  modified_base (216)..(216): a, c, t, g, unknown or other
  misc_feature (216)..(216): n is a, c, g, or t
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcaggttgggtggagtcgtgggggaggcgttggtccagccctgggaacggtccctgagacctctcgtgtgcagcgtcnggtacttctattctttaaattacgtttttcctatgcacgttaggactcccgaccgagtcctaccggaggcggtaggggactgggaggtggggtcggacgagggtagtcggtactacgttgacgtggtacgacctaaagtacctattaccgttcgcacgtacgtccgaggtaacgggacctagttaccactacttaccgagacgtaacgaacttaccgaaacacgacgtctacgactactcgacgaacgtaaagaccgtacctaacccgtacgaaccggtaccgtacgaacccggaaccgtccggtaccgttacttacgttacgtttaactggtacggtacgtacgtttaacctttactttacggtttccggttcgggtttacggttcccgtttagggttaaccttaccggggttcgggtaaccggtaggtcccttcccggtacgtccctaccggttccctccctaccgaccccgtacccgtacccgaacccgaacccggtccgtaacccggttccccgttccccgtccccggtaaccccg

SEQ ID NO: 108651 - DNA, 262 bp, Homo sapiens
  misc_feature: GYAE6OF01B3O12.16.38.D05.1.454.CMB.1.raw
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (255)..(262): a, c, t, g, unknown or other
  misc_feature (255)..(262): n is a, c, g, or t
tcagtgtactactccacgaccggtgctcgatttagtatctgatagttgggttgggacagacttcactctcaccatcagcaccctgccagtctgaggattttgcaatttattattgtcagcagtataattactggcctccgtacacttttggccaggggaccaagctggagatcaaacgactgtggctgcaccatctgtcttcatctcccgcattcngagnggtatcacgtgacgngggctggcaaggcgcatagnnnnnnnn

SEQ ID NO: 108652 - DNA, 760 bp, Homo sapiens
  misc_feature: GYAE6OF01DF53I.16.38.D05.1.454.CMB.1.raw
  modified_base (172)..(172): a, c, t, g, unknown or other
  misc_feature (172)..(172): n is a, c, g, or t
  modified_base (210)..(210): a, c, t, g, unknown or other
  misc_feature (210)..(210): n is a, c, g, or t
  modified_base (515)..(515): a, c, t, g, unknown or other
  misc_feature (515)..(515): n is a, c, g, or t
tcagtgtactactccacgaccggtgctcgatttagtatctgatagttgggtttgggggagaactgctcagttaggacccagacggaaccatggaacgccccagcgcagcttctcttcctcctgctactctggctcccagacacgacgtgagaagtagtgatcgacgcagtcnccagcccaccctgtctgtgtacctacggaaggggaacncccgtacccacccttcgtcccaggaccgacggggacccaggttacgaaggtagttccggtccgaaccctaacctaaatttcggacccgttaccggaaccaagtaaacccgtaaaaaccgttcggacccgaacggtccgtaccccgagtcccttaccttactacgttacctaagtcggacgaccttacgtaaccgtaccggacggtccaactgtactccgacccgtacgggtccttagacggtcggaacgttggtacggggttacgacgtaatacgtcgactccgtacacctagtacacgtaaccnccgtacacgtacgtacgtaggttacgtttagtttacgtaacttaagttttattacttagtaacgactagtaggtttaaacttaacttaccgtacgtacctaccgtttacgtacgttttaccgggaaccgtacgggtaacctacggtacggtacgtaaacgtacgttaaaaccgtaaacggttacgtaggtaccggtctaccggtaaccctagtacttcgttacgttaccttcgtacctaccccgg

SEQ ID NO: 108653 - DNA, 673 bp, Homo sapiens
  misc_feature: GYAE6OF01AS8NK.16.38.D05.1.454.CMB.1.raw
tcagtgtactactccacgaccggtgctcgatttagtatctgatagttgggtttgggctcaactctcttgtctcaccatggagtttgggctgagctgggtttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcgaggagtgtcacttgatggagccaatacatactcgcagactccgtgaacgggccattcaccatttccagagagaattcccaaacaacacgctcgctatctacgacaaacgtcggaccacccgtagacgaccctacggaccgaaccgaccggcttacgttcttaactttaaccgttggttacgtcggtaacgtacctttcgtttaacgtttcggtccggtttcggggttcctttttacggaaccgtttacgggttcggggtacccgaacggggtacttccccggttcggtcccgtacccggtcccttacccgttacgtacccggtcccctaccccgtaacccgtaaacccgggcccctaacgttccccggttccccgttcccccggtacccggg

SEQ ID NO: 108654 - DNA, 712 bp, Homo sapiens
  misc_feature: GYAE6OF01BYZMD.16.38.D05.1.454.CMB.1.raw
  modified_base (161)..(161): a, c, t, g, unknown or other
  misc_feature (161)..(161): n is a, c, g, or t
  modified_base (204)..(204): a, c, t, g, unknown or other
  misc_feature (204)..(204): n is a, c, g, or t
tcagtgtactactccacgaccggtgctcgatttagtatctgatagttggggtttgggggaggaactgctcagttaggacccagacggaaccatggaacgccccagcgcagcttctcttcctcctgctactctggctcccagacacgactggagaagtagtnatgacgcagtctccagccacctgtctgtgtcaccgagggaacnccgccacctctcctgcgacgggccagtcaggtgtcgttcgaccactaatttacgcctggtaccacgaaccaaaaccgtcggaccacggtcctacccgaggcctccgtcattctaacgttggtcgacctacttaccgtacccgagggaccacgttgactccgtccgacgggtccgttacgaggtcggcgtagggttacggggttaggacagtccgtactaccgttacgtaccaaccgtatccgacgtcccgaccctgacgtacgtcgttagtacgggttactttgtaaccgtttaattttacgtttagtttacgtctagtaaccgttaagtaatttaacggttccttagggttcccttaccggttaacgttaccggttttgggaaacccggtacgggtaccctaacgggtacgttacggaaagtaccgtaaaccggtaaacgtacgttacgggacgttaccgacgtaccctagtaccgttcttacccggtactttctaccggtttcccg

SEQ ID NO: 108655 - DNA, 727 bp, Homo sapiens
  misc_feature: GYAE6OF01CEO7G.16.38.D05.1.454.CMB.1.raw
  modified_base (97)..(97): a, c, t, g, unknown or other
  misc_feature (97)..(97): n is a, c, g, or t
  modified_base (108)..(108): a, c, t, g, unknown or other
  misc_feature (108)..(108): n is a, c, g, or t
  modified_base (238)..(238): a, c, t, g, unknown or other
  misc_feature (238)..(238): n is a, c, g, or t
  modified_base (413)..(413): a, c, t, g, unknown or other
  misc_feature (413)..(413): n is a, c, g, or t
  modified_base (494)..(494): a, c, t, g, unknown or other
  misc_feature (494)..(494): n is a, c, g, or t
tcagtgtactactccacgaccggtgctcgatttagtatctgatagttgggttgggggagaactgctcagttaggacccagacggaacctatggaacnccccagcgacncgtcttccgtcctttcctcctgctactcgtcggcctccagaccgacgactggagaagtagtgactacgacgtcgtacgtcctaccacgccctaccgttgtacgttgtcgccgtacggaacggggtaaccnccacccgtacccttctccgcgacgacgggtcacgagtcgtaggtacgtcaaccgttaacgttaacgtcgtccgtaacgaaccaacgtaaacctaaacggcgtaccacggtcccaccgtagtccctaactcagtacggttcgtagtccgtactaccgtaccggaccgtcgaacgtntacgcgtaccggcggtaccggtcgtagccggtaacgtcggtaggtttacgggtacacgtactcggtccatccgacgttacnccgacggtccctactcgtacgtacgcgtttacgtagttacgtttacgttattacgtttaaggtttctaacgttcgttagacgttaacttaagttacgtacgttaccgtccgttaaccgttcgttaccgtaacgtaccggacgttacgactacggtagtaagtaccagtaacggtacgtaccgtgttacgtaccgaacgacctgtccttacgcgttaaacctccgtcgtacccg

SEQ ID NO: 108656 - DNA, 297 bp, Homo sapiens
  misc_feature: GYAE6OF01DOWAP.16.38.D05.1.454.CMB.1.raw
  modified_base (176)..(176): a, c, t, g, unknown or other
  misc_feature (176)..(176): n is a, c, g, or t
  modified_base (183)..(183): a, c, t, g, unknown or other
  misc_feature (183)..(183): n is a, c, g, or t
  modified_base (205)..(205): a, c, t, g, unknown or other
  misc_feature (205)..(205): n is a, c, g, or t
  modified_base (254)..(297): a, c, t, g, unknown or other
  misc_feature (254)..(297): n is a, c, g, or t
tcagtgtactactccacgaccggtgctcgatttagtatctgatagttgggtttggggcagagctctggggaggaactgctcagttaggacccagacggaaccatggaagccccagcgcagcttcctcttccctcctgctactctggcctcccaggaactgtggctgccaccatctnttcctcnctccttcccgctattcgtgagngtaagtaccagtggaggcgggtcgtagggacgaacgggcctacagacgnnnnnnnnnnnnnnnnnnnnnnnnnnnnnnnnnnnnnnnnnnnn

SEQ ID NO: 108657 - DNA, 761 bp, Homo sapiens
  misc_feature: GYAE6OF01CP34C.16.38.D05.1.454.CMB.1.raw
  modified_base (222)..(222): a, c, t, g, unknown or other
  misc_feature (222)..(222): n is a, c, g, or t
  modified_base (401)..(401): a, c, t, g, unknown or other
  misc_feature (401)..(401): n is a, c, g, or t
tcagtgtactactccacgaccggtgctcgatttagtatctgatagttgggtttggggctgggagacgagcccagcactggaagtcgccggtgtttccattcggtgatcagcactgaatacagaggactcaccatggagtttgggctgagtcgttgggtttttccctcgttacttacgtttttaaggaggttgtaccaagttgtcgaggtgcgtaggtttggnggtacggttcgtaggggggacgtcgtacggtccgaggtcccgtagggtaaccgtcccgtaggacgtacgtccgtgttggtcgacgaggtcgtcgtggtaactttcgtaatttcgttttaaaactttcggtttttccaagtcggtacctcggttcgggaccttcccgaccgaacggtccncccggaagggcggtaacggggtcttggggacggttcgggtcggacgtagggtacgttcggtctacggtttggaagttacgggacaaccttaataccttaacttcggtaccgacgtaacgtaccggttccggaagggtacgtccgtaccttaccgtaaccttacgttaccgaagtaacgtaacgtaaccgtaaccaaccaaccgtaccgtactacgactacgtacctagaacgtacgtaacgaccaccgtacgacgtaccgtcgacgacgtacggtctacgttcgtacgttagtaggtgtactacgttcttaagttttcgtaccggttcggttaccgttaccgttaggtccggttaccggg

SEQ ID NO: 108658 - DNA, 862 bp, Homo sapiens
  misc_feature: GYAE6OF01BF2W3.16.38.D05.1.454.CMB.1.raw
  modified_base (370)..(370): a, c, t, g, unknown or other
  misc_feature (370)..(370): n is a, c, g, or t
tcagtgtactactccacgaccggtgctcgatttagtatctgatagttgggtttggggaggaactgctctagttaggacccagacggaaccatggaagccccagcgcagtctactctcctcctgctactctcggcctaccagtacacgtaactggagaagttagcgaactcggacgctaggtacctccaacgccctaacccgttgtccttggtcgtaccctacggaacggggtaactccgcccaccttctaccgtgcgaacgggcctaacggtcaagtcgttggtaactcctaaaccgtaaggttttcgaccgttacgggtaaccacgaacctaaaaccgtcggacgacggtccttaccgacgtccctacnctacgtcctaaggtcgtcggtacctacgttaccctaacggaccggtactaacggttacgtcgttcggacccggtaaccggtccggtttagacggtacgggtaccttagggggttacgggtttacgggaccgtaaacggttcgttaaccgtacgtcgttaccgaaccggtacgttacgacggttacccaccgacggttacccgagtacccggttagtacccggttattttaccggtaaacttactttttaggtaacctttcgggtaaactcggttaaactttagtaaaccgttttaatccgggttaccggtaaccctttaaccggtgttttaacccttaccgggaaacgggtttaccgggaaacccgttaagggtacctacgggaagttaaacccgttaacgggaaaacccggtttggtagggtacgtaaccgttacccgggaatacccggtaatttcccggtacttacccttacggttaaccctaccccggg

SEQ ID NO: 108659 - DNA, 257 bp, Homo sapiens
  misc_feature: GYAE6OF02HLB74.16.38.D05.1.454.CMB.1.raw
  modified_base (255)..(257): a, c, t, g, unknown or other
  misc_feature (255)..(257): n is a, c, g, or t
tcagtgtactactccacgaccggtgctcgatttagtatctgatagttgggtttgggacagacttcactctcaccatcagcaccctgcagtctgaggatttgcaatttattattgtcagcagtataattactggcctccgtacacttttggccaggggaccaagctggagatcaaacgaactgtggctgcaccatctgtcttcatcttcccgccatctgagagtagtacactgagcgggctggcaaggcgcatagnnn

SEQ ID NO: 108660 - DNA, 168 bp, Homo sapiens
  misc_feature: GYAE6OF02GANRX.16.38.D05.1.454.CMB.1.raw
  modified_base (168)..(168): a, c, t, g, unknown or other
  misc_feature (168)..(168): n is a, c, g, or t
tcagtgtactactccacgaccggtgctcgatttagtatctgatagttggttgggaagaggaagactgacggtccccaggagttcaggtgctgggcacagcggccctgggctgcctggtcaaggactacttccgagtagtacactgagcgggctggcaaggcgcatagn

SEQ ID NO: 108661 - DNA, 256 bp, Homo sapiens; identical to SEQ ID NO: 108514
  misc_feature: GYAE6OF02HDQSD.16.38.D05.1.454.CMB.1.raw
  modified_base (255)..(256): a, c, t, g, unknown or other
  misc_feature (255)..(256): n is a, c, g, or t

SEQ ID NO: 108662 - DNA, 503 bp, Homo sapiens
  misc_feature: GYAE6OF02GLP6C.16.38.D05.1.454.CMB.1.raw
  modified_base (467)..(467): a, c, t, g, unknown or other
  misc_feature (467)..(467): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctcccaggctcctcatctatggtgcatctaccagggccactgatgtcccaggccggttcagtggcagtgggtttgggacagacttcactctcaccatcagcaccctgcagtctgagattttgctaatttattattgtcagcagtataattactgcctccgtacacttttggcctagggaccaagctgganatcaacgactgtggctgcacatctgtcttcattccc

SEQ ID NO: 108663 - DNA, 258 bp, Homo sapiens
  misc_feature: GYAE6OF02H7028.16.38.D05.1.454.CMB.1.raw
  modified_base (256)..(258): a, c, t, g, unknown or other
  misc_feature (256)..(258): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacacttttggccaggggaccaagctggagatcaaacgaactgtggctgcaccatctgtcttcatcttcccgccatctgagagtagtacactgagcgggctggcaaggcgcatagnnn

SEQ ID NO: 108664 - DNA, 247 bp, Homo sapiens
  misc_feature: GYAE6OF02ITEO2.16.38.D05.1.454.CMB.1.raw
  modified_base (223)..(223): a, c, t, g, unknown or other
  misc_feature (223)..(223): n is a, c, g, or t
  modified_base (229)..(247): a, c, t, g, unknown or other
  misc_feature (229)..(247): n is a, c, g, or t
tcagtgtactactccacgaccggtgctcgatttagtatctgatagttgggtttggggcagagctctggggaggaactgctcagttaggacccagacggaaccatggaagccccagcgcagcttctcttcctcctgctactctggctcccaggaactgtggctgcaccatctgtcttcatcttcccgccatctgagagtgtacactgagcgggctggcaaggcncatagnnnnnnnnnnnnnnnnnnn

SEQ ID NO: 108665 - DNA, 514 bp, Homo sapiens
  misc_feature: GYAE6OF02G08C6.16.38.D05.1.454.CMB.1.raw
  modified_base (500)..(500): a, c, t, g, unknown or other
  misc_feature (500)..(500): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctcccaggctcctcatctatggtgcatctaccagggccactgatgtcccaggccggttcagtggcaggtgggtttgggacagacttcactctcaccatcagcaccctgcagtctgaggtatttgactaatttattattgtacagtctagtataattactggccttcgtactacttttggcctaggggaccaagcgtgagtatcgaaacgactgtggctgcacntctgtcttcattcc

SEQ ID NO: 108666 - DNA, 508 bp, Homo sapiens
  misc_feature: GYAE6OF02G01MB.16.38.D05.1.454.CMB.1.raw
  modified_base (203)..(203): a, c, t, g, unknown or other
  misc_feature (203)..(203): n is a, c, g, or t
  modified_base (471)..(471): a, c, t, g, unknown or other
  misc_feature (471)..(471): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagcaaaaacctggccaggctcccaggctcctcatctatggtgcatctaccagggccactgatgtcccaggccggttcagtggcagtggggtttgggacagacttcactctcaccatcagcaccctgcagtctgaggtatttgactaatttattattgtcagtcagtatattactgcctacgtactactttggcctagggaccagcgtagganatacgaacgaactgtgctgcacatctgtctctatccc

SEQ ID NO: 108667 - DNA, 513 bp, Homo sapiens
  misc_feature: GYAE6OF02G9NEF.16.38.D05.1.454.CMB.1.raw
  modified_base (204)..(204): a, c, t, g, unknown or other
  misc_feature (204)..(204): n is a, c, g, or t
  modified_base (473)..(473): a, c, t, g, unknown or other
  misc_feature (473)..(473): n is a, c, g, or t
  modified_base (498)..(498): a, c, t, g, unknown or other
  misc_feature (498)..(498): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctttgctgtgtctccaggggaaancgccaccctctcctgcagggccagtcagagtgttgccaccaatttagcctggtaccagcaaaaacctggccaggctcccaggctcctcatctatggtgcatctaccagggccactgatgtcccaggccggttcagtggcaggtgggtttgggacagacttcactctcaccatcagcacctgcagtctgaggtattttgctaatttattattgtcagcagtataattactgtcctcgtactacttttggcctaggggaccaaggctgganatacaacgtaactgtggctgcaccntcctgtcttcattcc

SEQ ID NO: 108668 - DNA, 506 bp, Homo sapiens
  misc_feature: GYAE6OF02FSE42.16.38.D05.1.454.CMB.1.raw
  modified_base (202)..(202): a, c, t, g, unknown or other
  misc_feature (202)..(202): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaancgccaccctctcctgcagggccagtcagagtgttgccaccaatttagcctggtaccagcaaaaacctggccaggctcccaggctcctcatctatggtgcatctaccagggccactgatgtcccaggccggttcagtggcagtgggtttgggacagacttcactctcaccatcagcaccctgcagtctgaggattttgctaatttatattgtcagcagtataattactggcctccgtactacttttggcctaggggaccaagctggagatcaacgactgtggctgcacatctgtcttcattcccg

SEQ ID NO: 108669 - DNA, 578 bp, Homo sapiens
  misc_feature: GYAE6OF02F5CYW.16.38.D05.1.454.CMB.1.raw
  modified_base (203)..(203): a, c, t, g, unknown or other
  misc_feature (203)..(203): n is a, c, g, or t
  modified_base (515)..(515): a, c, t, g, unknown or other
  misc_feature (515)..(515): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagcaaaaacctggccaggctcccaggctcctcatctatggtgcatcctaccagggccactgatcgtcccgaggtcggttcagtggcgtaggtggggtttgggactagacttcactctcaccatcacgcctaccctgactagtctaggtaggtattttgacttaattttattatttgtactagtctaagttaattaattacgtcgtcccttaccgttaccttacgttttcggaccgtaggggtaccaggcgtagganagtaacgaacgtaacgtggtacggtactcgacaccgtattccgtacgttccttacacttcccg

SEQ ID NO: 108670 - DNA, 179 bp, Homo sapiens
  misc_feature: GYAE6OF02FW3VV.16.38.D05.1.454.CMB.1.raw
  modified_base (175)..(179): a, c, t, g, unknown or other
  misc_feature (175)..(179): n is a, c, g, or t
tcagtgtactactccacgaccggtgctcgatttagtatctgatagttgggtttgggggaagaggaagactggacggtccccccaggagttcaggtgctgggcacagcggccctgggctgcctggtcaaggactacttccgagtagtacactgagcgggctggcaaggcgcatagnnnnn

SEQ ID NO: 108671 - DNA, 581 bp, Homo sapiens
  misc_feature: GYAE6OF02GL4LK.16.38.D05.1.454.CMB.1.raw
  modified_base (202)..(202): a, c, t, g, unknown or other
  misc_feature (202)..(202): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaancgccaccctctcctgcagggccagtcagagtgttgccaccaatttagcctggtaccagcaaaacctggccaggctccaggctcctcatctatggtgcatctaccagggccactgatcgtcccaggccggttcagtggcaggttgggtttgggacagacttcactctcaccatcagccacctgcagtctgagtattttgctaatttattattgtacagtctaagttattaaatttacgtcggtcccttaccgttacctacgtttttacgggaccgtacgggggtaacccaaaggtcgtagggacgtactacgtaaacggtaacgttggtacgggtcttacggacctaccgtacttccgttagtttccttactattccccg

SEQ ID NO: 108672 - DNA, 512 bp, Homo sapiens
  misc_feature: GYAE6OF02JB7RG.16.38.D05.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (394)..(394): a, c, t, g, unknown or other
  misc_feature (394)..(394): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccacctctcctgcagggccagtcagagtgttgccaccaatttagcctggtaccagcaaaaacctggccaggctccaggctcctcatctatggtncatctaccagggccaactgatgtcccaggccggttcagtggcagtgggtttgggacaggacttcactctcacactcagcacctgcagtctgagtntttgactaatttntattntcatcagtataattactggtcctacgtactatttcggaccaggggaccaaggctaggagatacaaacgactgnggntgacacatctgtcttacattcccg

SEQ ID NO: 108673 - DNA, 256 bp, Homo sapiens
  misc_feature: GYAE6OF02INS5T.16.38.D05.1.454.CMB.1.raw
  modified_base (255)..(256): a, c, t, g, unknown or other
  misc_feature (255)..(256): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacacttttggccaggggaccaagctggagatcaaacgaactgtggctgcaccatctgtcttcatcttccgccatctgagagtagtacactgagcgggctggcaaggcgcatagnn

SEQ ID NO: 108674 - DNA, 521 bp, Homo sapiens
  misc_feature: GYAE6OF02GLG7G.16.38.D05.1.454.CMB.1.raw
tcagtgtactactccacgaccggtgctcgatttagtatctgatagttgggtttggggctgggagacgagcccagcactggaagtcgccggtgtttccattcggtgatcagcactgaatacagaggactcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcagggagtgtcacttgatggagccaatacatacttcgcagactccgtgaagggccgattcaccatttccagagagaattccaaacaacacgctgcatctgacaaatggacaccctgacgacctgacgacacggctgtctattacgtgtgtgagtacttcttattcgcgttcgggctttgacttacgg

SEQ ID NO: 108675 - DNA, 536 bp, Homo sapiens
  misc_feature: GYAE6OF02IY80J.16.38.D05.1.454.CMB.1.raw
  modified_base (504)..(504): a, c, t, g, unknown or other
  misc_feature (504)..(504): n is a, c, g, or t
tcagtgtactactccacgaccggtgctcgatttagtatctgatagttgggtttggggctgggagacgagcccagcactggaagtcgccggtgtttccattcggtgatcagcactgaatacagaggactcaccatggagtttgggctgagctgggttttcctcgttactcttttaagaggtgtccaatgtcaggtgcagttggtggagtctgggggagcgtggtccagcctggaaggtccctgagactctcgtgtgcagcgtctggattcatctttaatgttttccatgcactggatccgcaggctccaggcaggggactgggagtgggtggcagggagtgtcacttgatggagccaagtcatactcgcagacctccgtgaacgggccgattcacctatttccagagagaattaccaaacaaccacgactcgacatctgacaaagtcggaccacccgtgacgtacctagaccgacacggctagtctattacgtgtagtgagtctnttacgttcgtcgttccggtctttacgatacgg

SEQ ID NO: 108676 - DNA, 577 bp, Homo sapiens
  misc_feature: GYAE6OF02GZ4PK.16.38.D05.1.454.CMB.1.raw
  modified_base (203)..(203): a, c, t, g, unknown or other
  misc_feature (203)..(203): n is a, c, g, or t
  modified_base (391)..(391): a, c, t, g, unknown or other
  misc_feature (391)..(391): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagcaaaaacctggccaggctcccaggctcctcatctatggtgcatctaccagggccactgatcgtcccaggccggttcagtggcaggtgggtttggacagacttcactctcaccatcagcaccctgcagtcngagtatttgactaatttatattgtcagtctagttattaattacgttcgccttaccgtactacgttttcggaccgtacggggtaacctaaggcgtagggacgtagtacgaaaccggtaacgttacggtacgggtcctacggacctaacccgtatttccgttacgttacctttcctactttacccccg

SEQ ID NO: 108677 - DNA, 510 bp, Homo sapiens
  misc_feature: GYAE6OF02FP5WT.16.38.D05.1.454.CMB.1.raw
  modified_base (203)..(203): a, c, t, g, unknown or other
  misc_feature (203)..(203): n is a, c, g, or t
  modified_base (472)..(472): a, c, t, g, unknown or other
  misc_feature (472)..(472): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccacactctcctgcagggccagtcagagtgttgccaccaatttagcctggtaccagcaaaaacctggccaggctcccaggctcctcatctatggtgcatctaccagggccactgatgtcccaggccggttcagtggcagtgggtttgggacagacttcactctcaccatcagcaccctgcagtctgaggtattttgctaatttattattgtcagtcagtattaattactggcctccgtactacttttgcctagggaccaagctgganatacgaaacgaactgtggctgcacatctgttcttctac

SEQ ID NO: 108678 - DNA, 573 bp, Homo sapiens
  misc_feature: GYAE6OF02IKR6R.16.38.D05.1.454.CMB.1.raw
  modified_base (204)..(204): a, c, t, g, unknown or other
  misc_feature (204)..(204): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaancgccaccctctcctgcagggccagtcagagtgttgccacaatttagcctggtaccagacaaaaacctggccaggcctccaggctcctcatctatggtgcatctaccaggccactgatgtcccaggtccggttcagtggctaggtgggtttggactagtacttcactcgtcaccatcagccacctgctagtctggagtattttgacttaatttattattgtactagtactaagttaattaattaccgtcgtacccttaccgttactacgttttacggaccgtaagggtacccaaggccttagggagtactaccgaaacgtacgtgtcggtactcgtacctacctattccgtgtacctttcgactttcccg

SEQ ID NO: 108679 - DNA, 233 bp, Homo sapiens
  misc_feature: GYAE6OF02HGIW1.16.38.D05.1.454.CMB.1.raw
  modified_base (230)..(233): a, c, t, g, unknown or other
  misc_feature (230)..(233): n is a, c, g, or t
tcagtgtactactccacgaccggtgctcgatttagtatctgatagttgggtttggggcagagctctggggaggaactgctcagttaggacccagacggaaccatggaagccccagcgcagcttctcttcctcctgctactctggctcccaggaactgtggctgcaccatctgtcttcatcttcccgccatctgagagtagtacactgagcgggctggcaaggcgcatagnnnn

SEQ ID NO: 108680 - DNA, 603 bp, Homo sapiens
  misc_feature: GYAE6OF02IFFTZ.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagcaaaaacctggccaggctcccaggctcctcatctatggtgcatctaccagggccactgatgtcccaggccgttcagtggcaggttgggtttgggacagacttcactctcacatcagcacctgcagtctgaggtatttgactaatttattattgtctagctagtattaattactggtcccttaccgtactacgtttttggcccgtaaggggaccctaaggtccgttagggaacgtacgttaccgtaaaaccggtaaaccgttagggtacgggtaccttacgggaccctaacccgtaacgtttcccgttacggttttaccctttcccgtacttttaccccccgg

SEQ ID NO: 108681 - DNA, 508 bp, Homo sapiens
  misc_feature: GYAE6OF02GTZUI.16.38.D05.1.454.CMB.1.raw
  modified_base (495)..(495): a, c, t, g, unknown or other
  misc_feature (495)..(495): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctcccaggctcctcatctatggtgcatctaccagggccactgatgtcccaggccggttcagtggcaggtgggtttgggacagacttcactctcaccatcagcaccctgcagtctgaggtattttgctaatttattattgtcagcagtataattactggcctccgtactacttttggcctaggggaccaagctgagatcaaacgactgtggctgcaccntctgtcttcatcc

SEQ ID NO: 108682 - DNA, 521 bp, Homo sapiens
  misc_feature: GYAE6OF02F9GG8.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagcaaaaacctggccaggctcccaggctcctcatctatggtgcatctaccagggccactgatgtcccaggccggttcagtggcagtgggtttgggacagacttcgactctcaccatcagcaccctgcagtcctgacggtatttgctaattttattattgttcagtcagtataatttactggcctcgtactacttttggccgtaggggaccaggccgtggagatcaaacgaactgtcggctgcacatctgtcttcgattcccg

SEQ ID NO: 108683 - DNA, 510 bp, Homo sapiens
  misc_feature: GYAE6OF02H6IVO.16.38.D05.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (351)..(351): a, c, t, g, unknown or other
  misc_feature (351)..(351): n is a, c, g, or t
  modified_base (495)..(495): a, c, t, g, unknown or other
  misc_feature (495)..(495): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccacctctcctgcagggccagtcagagtgttgccaccaatttagcctggtaccagcaaaaacctggccaggctccaggctcctcatctatggtncatctaccagggccactgatgcccaggccgttcagtgcagtgggtttggacngacttcactctcaccatcagcaccctgcagtctgaggtattttgactaatttattatttgtcagcagtataatctgcctaccgtactacttttggaccgtagggaccaaagtcgtggaatactcaaacgactgtggcttgcacntctgtcttcattccc

SEQ ID NO: 108684 - DNA, 258 bp, Homo sapiens; identical to SEQ ID NO: 108663
  misc_feature: GYAE6OF02IMNFG.16.38.D05.1.454.CMB.1.raw
  modified_base (256)..(258): a, c, t, g, unknown or other
  misc_feature (256)..(258): n is a, c, g, or t

SEQ ID NO: 108685 - DNA, 532 bp, Homo sapiens
  misc_feature: GYAE6OF02F9X7I.16.38.D05.1.454.CMB.1.raw
  modified_base (202)..(202): a, c, t, g, unknown or other
  misc_feature (202)..(202): n is a, c, g, or t
  modified_base (516)..(516): a, c, t, g, unknown or other
  misc_feature (516)..(516): n is a, c, g, or t
  modified_base (526)..(526): a, c, t, g, unknown or other
  misc_feature (526)..(526): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaancgccaccctctcctgcagggccagtcagagtgttgccaccaatttagcctggtaccagcaaaaacctggccaggctcccaggctcctcatctatggtgcatctaccagggccactgatgtcccaggccggttcagtggcagtggggtttgggacagacttcactctcaccatcagcaccctgcagtctgaggtattttgactaatttattatttgtacagtctagttataatttactcggtcccttaccgtactacgttttggccgtaggggaccaagtcgtaggagagtacaaacgtactgtggctgctaccntctgtcttcnttcccg

SEQ ID NO: 108686 - DNA, 555 bp, Homo sapiens
  misc_feature: GYAE6OF02F7M3M.16.38.D05.1.454.CMB.1.raw
  modified_base (346)..(346): a, c, t, g, unknown or other
  misc_feature (346)..(346): n is a, c, g, or t
  modified_base (469)..(469): a, c, t, g, unknown or other
  misc_feature (469)..(469): n is a, c, g, or t
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttgacagctatgccatgacctgggtccgccaggctccgaggggaaggggctggaatgggtctcaggtattactggtggtggttataccacatactacgcagactccgtgaagggccggttcaccatcnccagagacaattccaaagaacacactgtatctgcaaatgaacagcctgagagccgacgacacggccaatataattactagtgacgaaagcgaccgcagttagccaaccctatacctactttanacctacgtcgggacctacgggaccctcggtccaccgtctcctacacgcctcccgaccacgggcccacgccgttcctcccccgtcgg

SEQ ID NO: 108687 - DNA, 633 bp, Homo sapiens
  misc_feature: GYAE6OF02GV19X.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagcaaaacctggccaggctcccaggctcctcatctatggtgcatctaccgagggccactgatcgtcccaggccggttcagtggcgtgggttgggtacgacgacgttctactctcacctactcacgacacccgtctcgacgtctcggtaggtagtttagttcgtaactttaatttactttagttctacgtacgtacgttaattaacgtttaacttacggtccgttacccgttacgttaccgttttcgggttaccgtacgggtaaccggaaccgtacgtacggtaggtactaccgtaaacgtaaccgttcggtacggttacgtccgaccgtaccgtaacttcgttcgttacctttcttaccgtacctttcccccgg

SEQ ID NO: 108688 - DNA, 598 bp, Homo sapiens
  misc_feature: GYAE6OF02G6FQ7.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagcaaaaacctggccaggctcccaggctcctcatctatggtgcatcctaccgagggccactgatcgtcccaggtccggttcaggtggcaggtggggtttgggacagtacttcactctcaccatcagcaccctgcagtctggaggtattttgactaattttattagtttgtctagtctagtattaatttacgtcggtcccttaccgttacttacgttttcgggacccgtaagggggtaaccctaacggtccgtagggaacgtactaccgaaaccggtaacgtaggtacgggtacctcggacctacctacgttccgttgttaccttacgtacctttccccg

SEQ ID NO: 108689 - DNA, 613 bp, Homo sapiens
  misc_feature: GYAE6OF02H7N7Z.16.38.D05.1.454.CMB.1.raw
tcagtgtactactccacgaccggtgctcgattttagtatctgatagtttggggtttgggggggaggaactgcctcagttaggacccagacggaaccatggaagccccagcgcagcttctcttcctcctgctactctggctcccagtacacgactggagtaagtagtgatgtacgcagtctccagccaccctgtctgtgtctccgaggggaagcgccaccctctcctgcagggccagtcagagtgttgccacctaatttagcctggtaccagacaaaacctcggccaggctcccaggctcctcatctatggtgctactctaccgagggtccacttgatcgtcccgaggtccggttcaggtggcgtaggttggggtttcgggacagtacttcgactctcaccatcacgtccaccctgactagttctagtaggttattttgacttaatttattattcgttctagtactagttataattacgcgtccttaccgtactacgttttacggaccgtaagggtaccaagtcgtaggagtacgtaccgtaaacggtcgtagggtcggtacgtccgaccgtacccgtacgttaccgttggttacccttaccgtcgttaccccg

SEQ ID NO: 108690 - DNA, 511 bp, Homo sapiens
  misc_feature: GYAE6OF02FOG02.16.38.D05.1.454.CMB.1.raw
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctcccaggctcctcatctatggtgcatctaccagggccactgatgtcccaggccggttcagtggcaggtgggtttgggacagacttcactctcaccatcagcaccctgcagtctgaggatttgctaatttattattgtcagcagtataattactgtcctcgtactacttttggccaggggaccagctgagatcaaacgaactgtggctgacaccgatcctgtccttcattcccg

SEQ ID NO: 108691 - DNA, 537 bp, Homo sapiens
  misc_feature: GYAE6OF02FO0TY.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcaggagtgtcacttgatggagccaatacatacttcgcagactccgtgaagggccattcaccattccagagagaattccaaacaacacgctgcatctgccaaatgaccaccctgacgacctgacacacggctgtctattactgtgtgagtacttcttattgcgtttcgggtctttgacttacgtggggccagggactcccgtggtccaccggtctcctcacgcctaccgaccaacggcccagtccggtccttccccgtcg

SEQ ID NO: 108692 - DNA, 521 bp, Homo sapiens
  misc_feature: GYAE6OF02FSNCU.16.38.D05.1.454.CMB.1.raw
tcagtgtactactccacgaccggtgctcgatttagtatctgatagttgggtttggggctgggagacgagcccagcactggaagtcgccggtgtttccattcggtgatcagcactgaatacagaggactcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttccatgcactggatccgcaggctccaggcaggggactgggagtgggtggcagggagtgtcacttgatggagccaatacatactcgcagactccgtgaacgggccgattcaccatttccagagagaattccaacaacacgctgcatctgacaaatcggacacccgtagacgacctgacgacacgctgtctattacgtgtgtgagtacttcttattcgtcgttcggctttgacttacgg

SEQ ID NO: 108693 - DNA, 548 bp, Homo sapiens
  misc_feature: GYAE6OF02GJ8XX.16.38.D05.1.454.CMB.1.raw
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
tcagtgtactactccacgaccggtgctcgatttagtatctgatagttgggtttgggctgggagacgagcccagcactggaagtcgccggtgtttccattcggtgatcagcactgaatacagaggactcaccatggagtttgggctgagctgggttttcctcgttactcttttaagaggtgtccaatgtcaggtgcagttggtggagtctgggggagcgtggtccagcctggaaggtccctgagactctcgtgtgcagcgtctggattcatctttaatgttttccatgcactggatccgcaggctccaggcaggggctggagtgggtgcaggagtgtcacttgatgganccaatcatacttncagactcgtagaaggccattcaccattccgagacgagtaacttccaacaacacgctgcactctagacaaactcggacacccgtagacgaccttgaccgacgaccgcttacgtcttacgttacgtggtagtacgacgtaccgttacgtttacgttcgtccggtttccgggtcttttcggacttaccgg

SEQ ID NO: 108694 - DNA, 802 bp, Homo sapiens
  misc_feature: GYAE6OF02H215B.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaancgccacctctcctgcagggccagtcagagtgtgccactatttagcctggtaccagacaaaacctggaccaggcctcccgaggcctcctcatctatcggtgctatactaccgacggccacgtgatcgtacccgacgggtccggttcgaggttcggacgtaggttgggggtttacgggacgtacggtaccgtttactaaccgttccgtacctaacccgaattccgaacgtaccctaaccccgttagacccgtacggttaccgttacggtaacgggtttatttttacggaacgtttaaacttttagttttaacgtttacggttaccgttaacgtacgttaaaggtttaaacttaaacgtttaaccgttaccgggttaccccgtttacccgttaaccgtttacccgttttttaccggggacccggttaaaccgggggaacccgtaaacggtaccggttacgggtaacggttaaccgttaaacccggtaaaccggtaacggttaacgggttacgggtaacccgttacggtaacccggttaacccgttaaccggtttcccgtttaaccggtttacccgttttacccgttaacttttaccccccgg

SEQ ID NO: 108695 - DNA, 616 bp, Homo sapiens
  misc_feature: GYAE6OF02F7ASD.16.38.D05.1.454.CMB.1.raw
  modified_base (202)..(202): a, c, t, g, unknown or other
  misc_feature (202)..(202): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaancgccaccctctcctgcagggccagtcagagtgttgccaccaatttagcctggtaccagacaaaaacctggccaggctcccaggctcctcatctatggtgcatctaccagggccactgatcgtcccgaggccggttcagtggctaggtggggtttgggactagacttcactctcaccatcacgccacctgactagtctgtaggtattttgacttaagtttattatttacgtctagtactagttaattaacgtttaccgtcggtacccttaccggttaccgtttaccgtttttcgggacccgtaacggggtaaccctaaggtccgtagggtaagtacgtaacgaaaccggtaacgttaggttacgggccgttacggacctacctacgttccttagttcctttactactttaccccg

SEQ ID NO: 108696 - DNA, 601 bp, Homo sapiens
  misc_feature: GYAE6OF02F8FEN.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcattctttaatagtttttcctatgcactggactccgccaggctccgaggcgaggggactggagtgggtggcaggagtgtcacttgatggagccaatacatacttcgcagactccgtagaacgggccattcacctattccagagagaattccaaacaacacgctgacatctgacaaagtcggaccaccctgaacgacctagaaccgacgacggctcgtacttattactgttgtgactacttcttattggtccgtttcgggtcttttcgaccgttacggtcgggccgtaagggtccgtcccgttcggtcctacccggttccgtccctcgaccgtcccgtacccgaaccgaccggtacccctacgttcccggttcccttcccccgtcccgg

SEQ ID NO: 108697 - DNA, 797 bp, Homo sapiens
  misc_feature: GYAE6OF02GQ7T9.16.38.D05.1.454.CMB.1.raw
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgggaaggacgccgaccctcctcctcgcgacgggccgacgtacgtacgagtcggttcgtccgacctaactttaagtccgtcggttaccgaacgacgaaaaacctaacggccgacgacgtccccacggacgtccctacctactacttacgttggtcgacactacctacccgacgggccgacttacggtatacgtcccgacggaccgggttcgagtggcgtaggttggggtttgggacgtacgtaacgtttcaccgtcttacgaacccactacgtacacccgtacctccggtctacggttcgtcgtaaggttacgttttgtaccgttaaattttaattttacgtttagttcgtaacgtacgttaacttaatttaacgtttaaaccgtttccgggtacccgtttacccgtttaccgtttaaaccgttttttcggggtaacccggaacgggggttaaccgaaacggtttacggtacgggtaacggtaactttaaccggtaaaaccggtaaaccgggtttaacggttcggggtaacctacccggttacgtaaccctaacggtttctttaccggttaccggtttactttacccgtcccggtttacccccg

SEQ ID NO: 108698 - DNA, 556 bp, Homo sapiens
  misc_feature: GYAE6OF02F208K.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctggggggaggcgtggtccagcctggaaggtccctgagactctcgtgtgcagcgtctggattcatctttaatagttttcctatgcactggatccgccaggctccaggcaggggactggagtgggtggcaggagtgtcacttgatggagccaatacatacttcgcagactccgtgaacgggccgattcacctatttccagagagaattccaaacaacacgctgcatctgacaaatcgacaccctgacgacctgacgacacggctgtctattactgtgtgacgactcttattgtcggtttcggtctttgacttacgtcgggccgagggtacttcccgtggtccaccgtcctcctcacgtccctacccaccgaaccggcccacgtcccggtcccttcccccgtccgg

SEQ ID NO: 108699 - DNA, 231 bp, Homo sapiens
  misc_feature: GYAE6OF02F9GKL.16.38.D05.1.454.CMB.1.raw
  modified_base (230)..(231): a, c, t, g, unknown or other
  misc_feature (230)..(231): n is a, c, g, or t
tcagtgtactactccacgaccggtgctcgatttagtatctgatagttgggtttggggcagagctctggggaggaactgctcagttaggacccagacggaaccatggaagccccagcgcagcttctcttcctcctgctactctggctcccaggaactgtggctgcaccatctgtcttcatcttcccgccatctgagagtagtacactgagcgggctggcaaggcgcatagnn

SEQ ID NO: 108700 - DNA, 867 bp, Homo sapiens
  misc_feature: GYAE6OF02HVPDF.16.38.D05.1.454.CMB.1.raw
tcagtgtactactccacgaccggtgctcgattttagtatctgatagttggggtttgggggcttcaactcgtcttgtctcaccatcggagttgggctcgagctgggtttccgtcgttactcgttttaacgagggtctcctaatgtcctagggtcgtcaggttcggtgggacgttccgtggggggacggtcggttggtcccaggcctgggaacggtccctgacgacttccttccgtgtcgcgtaggccgtcgtggatttcaattcgttttaagttacgtttttacctaacttgcctaccgttgggaactacccgaccaacggccgtaccgaaacgggccccaaaggggggtctagggtaggttagggttaggccggaagggtgttacgtaccgaccgtttcggaagtcggggttactacctaaacgtactacttaccgttcggctacgtaccgttccggtaggaacggacccgtacgttccaaccgtacttaccgaaggtcgaacgtaacggttaccccaaaacgaacggtaccggtacgtacgacgtacggtacgttaacggtaaccttaaaggtcggtaaccctacccgttaggaaacgtacccggtagggtaacccggtaacggtaaccggtcctttacggttaccgttaacgtttcggttacgggttacgtaccggggacgttaacccgttacttaaggttccggtaccgggtttcccgggtgtttacggaccgttacggtccggggactacgggtccctcccggttcgggtaccctaccgttccgttcccgtaccaccgttccccgtaccgtaaccggtacccgggttacctcccggttcgggttcccccgttcccgtaccggg

SEQ ID NO: 108701 - DNA, 869 bp, Homo sapiens
  misc_feature: GYAE6OF02H2F5P.16.38.D05.1.454.CMB.1.raw
  modified_base (205)..(205): a, c, t, g, unknown or other
  misc_feature (205)..(205): n is a, c, g, or t
  modified_base (260)..(260): a, c, t, g, unknown or other
  misc_feature (260)..(260): n is a, c, g, or t
  modified_base (290)..(290): a, c, t, g, unknown or other
  misc_feature (290)..(290): n is a, c, g, or t
tcagtgtactactccacgaccggtgctcgatttagtatctgatagttgggtttgggggaggaactgctcagttaggacccagacggaaccatggaacgccccagcgcagcttctcttcctcctgctactctggctcccagacacgactggagaagtagtgatgacgcagtctccagccaccctgtctgtgtctccgaggggaacncgccaccctctcctgcagggccagtcagagtgttgccacaatttagcctgtaccngacaaaactggacaggctccgagctcctcntactagtgtgcatctaccgaggccacgtagactcgacccgtagggtcccggttagaggttcggacgtagggttcggggttttacggggacctacgggttacctttcgaaccgttccgtaaccgtaacccgtaagttcccgaacgggtcccctacccgttaggtaccgtaacggtttccgttaacggtaacgggtttaacttttttacgggacctttaaacgttttttagtttttaaacgtttcggttacgtaaacggttacttaacggttttaaacgtttaaacgttttacccggttacgggttaaccccgttttaccccgggttttaaacgtttttaaaccccgggtttttttttcggggaaaccccggtttaacggggggtaaaaccccccgtttaaagggttaaccgttaacggggggtaacgtttaaaccggtttaacccgggttaaaaaccgggttaaaccggtttcggggtttaaccggggtaccgtttaaccggtccccgttaaacccgtttacggttacccggttttaacgggtttaccctttacccggttaaccgtttttaccccccggg

SEQ ID NO: 108702 - DNA, 537 bp, Homo sapiens
  misc_feature: GYAE6OF02FQ5CH.16.38.D05.1.454.CMB.1.raw
  modified_base (507)..(507): a, c, t, g, unknown or other
  misc_feature (507)..(507): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaacctggccaggctcccaggctcctcatctatggtgcatctaccagggccactgatgtcccaggccggttcagtggcaggtggggtttgggacagacttcactctcaccatcagccaccctgcagtctgaggtattttgctaatttattattgtctagctagttataattctggtcctccgttactacgttttcggccgtaggggacctaaggctagggatatacgaaacgtactaggtcggntcgcacctattcctgttcttactcttcccg

SEQ ID NO: 108703 - DNA, 645 bp, Homo sapiens
  misc_feature: GYAE6OF02IWYHR.16.38.D05.1.454.CMB.1.raw
tcagtgtactactccacgaccggtgctcgatttagtatctgatagttgggtttggggctgggagacgagcccagcactggaagtcgccggtgtttccattcggtgatcagcactgaatacagaggactcaccatggagtttgggctgagctgggttttcctcgttactcttttaagaggtgtccaatgtcaggtgcagttggtggagtcgtgggggagcgtggtccagcctgggaaggtccctgagactctcgtgtgcagcgtctggattcatctttaatagttttcctatgcactggactccgccaggcctccgagggcgaggggactgggagtggggtggcgaggagtgtcactttgatggacgccaatacagtaccttcgacctagacctccggtagaacgggccgtacttaccaacctacgtttccaaggtaagtacgtaacttaccgaaaccaaacgaccgactacgactagtacctgacaaagtcggaaccacccgtagaacgtacccgtacgaaccgaccgaaccggtacttacgttaccttaacgtttacgtggttacgtaggtaacgttccgtttacgttttaacgtttcgggttaccggtttacgggttaccgttttacggacgtttaacccggg

SEQ ID NO: 108704 - DNA, 777 bp, Homo sapiens
  misc_feature: GYAE6OF02J1QW8.16.38.D05.1.454.CMB.1.raw
  modified_base (208)..(208): a, c, t, g, unknown or other
  misc_feature (208)..(208): n is a, c, g, or t
  modified_base (326)..(326): a, c, t, g, unknown or other
  misc_feature (326)..(326): n is a, c, g, or t
  modified_base (375)..(375): a, c, t, g, unknown or other
  misc_feature (375)..(375): n is a, c, g, or t
tcagtgtactactccacgaccggtgctcgatttagtatctgatagttgggtttgggggtagggaacgtgctcagttaggaccagacggaaccatggaacgcccagcgcagcttctcttcctctgctactctggctccagacacgactggagagtagtgatgacgctagtctccagcccaccctgtctgtcgtctaccgaaggggaacnccgcccacccttctcctgcagggccaggtccaagtcggtgttcgaccacctaatttacgcctggtaccagacaaaacctcggaccacggcctccacggctcctcgactctagtggtcnctatcctaccgacggacctacgtcgacttcggtcccgacggtccggttnacggttcggcgtaggggttcggggtttaggacgtacggtacttacgtaaccgttcgtaaccgacctactaccgacgtaccctaccgtacgtacgacgttacgtacggtacggttattttcgaacctttaaggttttacttagttacgttacgtacgtacgttaagttaacttaacgttaccgttacggtaccgttttaacccgtaaccgttttacgggtttaccgggtaccggttaaaccgggggtaaccctaacggttaccggttacggggaactttaacgtaaccgggtaaaccggttaaaccgggtttggtaacccgggttacggttaccggtaccttaacccgttaacggttccgttttaacgggtttaacccctttcgttaaacccggtttccccgg

SEQ ID NO: 108705 - DNA, 231 bp, Homo sapiens
  misc_feature: GYAE6OF02FSE4A.16.38.D05.1.454.CMB.1.raw
  modified_base (229)..(231): a, c, t, g, unknown or other
  misc_feature (229)..(231): n is a, c, g, or t
tcagtgtactactccacgaccggtgctcgatttagtatctgatagttgggtttggggcagagctctggggaggaactgctcagttaggacccagacggaaccatggaagccccagcgcagcttctcttcctcctgctactctggctcccaggactgtggctgcaccatctgtcttcatcttcccgccatctgagagtagtacactgagcgggctggcaaggcgcatagnnn

SEQ ID NO: 108706 - DNA, 560 bp, Homo sapiens
  misc_feature: GYAE6OF02G3AQU.16.38.D05.1.454.CMB.1.raw
  modified_base (360)..(360): a, c, t, g, unknown or other
  misc_feature (360)..(360): n is a, c, g, or t
tcagtgtactactccacgaccggtgctcgatttagtatctgatagttgggtttggggctgggagacgagcccagcactggaagtcgccggtgtttccattcggtgatcagcactgaatacagaggactcaccatggagtttgggctgagctgggttttcctcgttactcttttaagaggtgtccaatgtcaggtgcagttggtggagtcgtgggggagcgtggtccagcctggaaggtccctgagactctcgtgtgcagcgtctggattcattctttaatgttttcctatgcactggactccgcgaggctcgaggcaggggactgggagtgggtggcaggagtgtcacgttgagtggganccaatcattacgttcgcagtcctcggtaggaacgggccgactacacctacttaccgagagagaacttaccaacaacacgctagcatctagacaatacgaccaccgtacgaacgtacctacgaccgacgacgcgtacgtactattacgtgtcgtagacgtacttattacgttcgttacggttcggttcttcgtacgtacgg

SEQ ID NO: 108707 - DNA, 599 bp, Homo sapiens
  misc_feature: GYAE6OF02GR0A9.16.38.D05.1.454.CMB.1.raw
  modified_base (202)..(202): a, c, t, g, unknown or other
  misc_feature (202)..(202): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaancgccaccctctcctgcagggccagtcagagtgttgccacctaatttacgcctggtaccagacaaaaacctggccaggctcccaggctcctcatctatggtgcatctaccagggccactgatcgtcccagggtccggttcgagtggctaggtggggtttggacagtacttcactctcaccatcacgccacctgactagtctgaggtattttgacttaattttattatttcgtctagtctaagttaataatttacgtggtacccttccgttacgttacgttttcgggacccgttacggggaacctaacggtcgtagggtaactacgtaccgaaacggtacgttaggtcggacttacgaccgtaccgtacgttccgtcgttccttacctatttacccccg

SEQ ID NO: 108708 - DNA, 781 bp, Homo sapiens
  misc_feature: GYAE6OF02G5FME.16.38.D05.1.454.CMB.1.raw
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagcccaccctgtctgtgtctccgaggggaaagccgccaccctctcctgcagggccagtcagagtgttcgccactaatttacgcctggtaccagacaaaaaccgtggaccaggcctacccgacggtcctcctacgatctagtggtcgctatccgtaccgacgggccacgtgactcgtacccgacgggtccgttcgaggtcggtcgtagggttggggtttacgggacgtacggtaccttacgacttccgtaccgacctaactaccacgccctacccgtagacccgtaggttacgtagggtaaggttacttttacgaactttaaatttttacgtttacgtttacgttacgtaacgttacgttaacgtttaaactttaaacgttttaccgttaccgggttaaccccgtttaccccggtttaacgttttacccgggtttttaccgggacccggttaaacgggggtaaaccctaggttacccggtaagggtacgttaaacgtaaccgtaaaaccggttaacggttacgggtaacgggtcccgttaacggaacccttaacccgttaacttcccggttttacctttaaccgtttcccgttaaccgttttcccccgg

SEQ ID NO: 108709 - DNA, 654 bp, Homo sapiens
  misc_feature: GYAE6OF02H6MVX.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcattctttaatagttttcctatgcactggatccgcagctccgaggcaggggctggagtgggtgcagggagtgtcacttgagtggagacccaagtactattaaccgttcgacaagaccttcccggtagaaacggggccgtaattccgaacctatttcccagagacgtaaattcccgaaacaaacacgctgactattcctaggacctaaagttcggaacctaccccgttaggaaccgtaccgtacggaacggaccgtaccgggcttacgttaccttaacgtttaacgtcggttgtagtaacgtacttctttagttcggtacgtttcggtcgtttagaccgttacggttcgggacagggtccttccgtggtacctaccgttctccctcgaccgtccgtaccctaccgaacggccctacgtcccggttacccttccccgtaccgg

SEQ ID NO: 108710 - DNA, 597 bp, Homo sapiens
  misc_feature: GYAE6OF02IULL6.16.38.D05.1.454.CMB.1.raw
  modified_base (322)..(322): a, c, t, g, unknown or other
  misc_feature (322)..(322): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggcccagtcagagtgttgcccaccaatttgcctggtaccagacaaaaacctggccaggctcccaggcctcctcatctatggtgcatctaccagggccactnatcgtcccaggccgtcagtggctagtgggtttggactagacttcactctcaccatcagtaccaccctgacctagtctaggaggtattttcgacttaatttattattggtcagtctaagttaattaaacttactcggtaccttacccggttactacgttttcggaccgaaggggtaaccagtcgtaggaacggtactacggtaaaaccgtaacttaggtacgggtactaggacctaaccgtacgttaccgtaggttccctttacgaacttcccccg

SEQ ID NO: 108711 - DNA, 640 bp, Homo sapiens
  misc_feature: GYAE6OF02HSMN3.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccacctctcctgcagggccagtcagagtgttgccaccaatttagcctggtaccagacaaaaacctggccaggctcccaggctcctcatctatggtgcatctaccagggccactgatcgtcccaggtccggttcaggtggcgtaggttggggtttgggactaggtacttcactctcaccatcagccaccctgcagtctgagtatttgactaatttattagttgtctagtactaagttaattaaattttaccgtacggtacccttaccgtttaacttaccgtttttcgggacccgtaacgggggtaaccctaaaggtacccggttagggaacgtacgtaaccggtaaaaaccggtaacgttcggtaacgggtccctacggtaccctaaccgtacgttcccgtttaccgtttaccttttcccgtaacgtttcccccgg

SEQ ID NO: 108712 - DNA, 539 bp, Homo sapiens
  misc_feature: GYAE6OF02GCQ4N.16.38.D05.1.454.CMB.1.raw
  modified_base (433)..(433): a, c, t, g, unknown or other
  misc_feature (433)..(433): n is a, c, g, or t
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagtttttcctatgcactggatccgccaggctccgaggcaggggactggagtgggtggcaggagtgtcacttgatggagccaatacatacttcgcagactccgtgaacgggccattcaccatttccagagagaattccaacaacacgctgcatctgacaaatcggacaccctgagacctgacgacacgctgtctattactgtgtgagactnttattgcgttcgggtctttgacttacgtgggccagggtactccgtggtccaccggtctcctcacgtccctaccgaccgacggcccatccggttccttcccctccgg

SEQ ID NO: 108713 - DNA, 830 bp, Homo sapiens
  misc_feature: GYAE6OF02HQRX2.16.38.D05.1.454.CMB.1.raw
  modified_base (202)..(202): a, c, t, g, unknown or other
  misc_feature (202)..(202): n is a, c, g, or t
  modified_base (306)..(306): a, c, t, g, unknown or other
  misc_feature (306)..(306): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgagggaancgccaccctctcctgcagggccagtcagagtgttgaccaccaatttagcctggtaccagaccaaaaactcggaccaggcctccgaggctcctcatctatggtcnctatccgtaccgacgggcctaacgtgtacgtcgtccccgtagggtcccggttcgtaacgggtcggaccgttaggggtttagggggttttacggggacgtacggtaaccctttccgtaccgttaccttaccgaaccctaacgttccgacggtacccctacccgtacgtacccgtacgttccgttagggtaacggtttacgtttttacggtaactttaaagttttttaagttttacgtttcggttacgtaacggtaacgttaaagtttaaaacgtttaaacgtttaaccgttaccgggttaccccgttttacccggttaacccggttttaacgttttttccggggtaaccccggttaaaccggggggttaaacccgtaacgggtaccggttaagggtaaacggtaacgttaaacccggtaaaaaccgggttaacgttaccggggttacggggtacccttacggaacccgttaaccctacggttaccgtttaccggtttaccctttacccgtacgttttccccccgg

SEQ ID NO: 108714 - DNA, 626 bp, Homo sapiens
  misc_feature: GYAE6OF02H9TH0.16.38.D05.1.454.CMB.1.raw
  modified_base (281)..(281): a, c, t, g, unknown or other
  misc_feature (281)..(281): n is a, c, g, or t
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtcgtgggggaggcgtggtccagcctggaaggtccctgagactctcgtgtgcagcgtctggattcatctttaatagttttcctatgctactggatccgcaggcctcaggcaggggactggagtggggtggngagggagtgtcacgttggagttggagccaattacgatacttcgcagactcccggtggaaggccgtattccgacctacgtttaccaggtagacgtaaacttaccgaaaccaaacctacgcgtcgactaactccgagacaaagtcgaacctaccctaggaacgtacccgtcgaacgaccgacggtactcgtactaacttcgtagtgtacgactactactttagttcgtacggtttcggtctttcgtacttcggtcgggccgtaggtaccgtccgtcggtccgtaccgtcgtcctacgaccgtccctacccgaccggacggcccacgttcccgtcccttccccgtccg

SEQ ID NO: 108715 - DNA, 812 bp, Homo sapiens
  misc_feature: GYAE6OF02JB6ON.16.38.D05.1.454.CMB.1.raw
tcagtgtactactccacgaccggtgctcgatttagtatctgatagttgggtttgggcgtcaactctcttgtctcaccatggagtttgggctgagctgggtttcctcgttactcttttaagaggtgtccaatgtcaggtgcagttggtggagtcgtgggggaggcgtggtccagcctggaaggtccctgagactctcgtgtgcgagcgtctggtattcattcttttaaagtagtttttaccattcgctacgtggactccgccgaggcctaccgaggccgagggacgtagggaggtcgggtgggcgaggtacggtgtacgtacgttgacgtgggaacgaccgtaaagtaacctaacttaccgttccggacgtaacgtaacccgttccggtaacggaaaccggggtccggaacgtttaccgaaccttacgtttacccgaaaggttacgaaacgtaaacgttaacccaaaacgaacgaaaccgctacgacgacttcgtacgaccgtaaagtccggaaccgtaacccgtacgaaccgtaaccgtacgtaacccggaaccgacccgggtaccgtacgttaccttaattaccgttagtcggtacgtaacgtacgttacgtttacgtacggttaccggtttccgggtttcgtttacggtaccgtttaaccgggttcgggtaccggttaacccgggtaacgttcccgggttaccggtaccgttaccccggttacctacccgtttccgaacccgtccccgtaaccgaccccgtaaccggacccctaccggtttcccggtaccccgtttcccccgtaacccgg

SEQ ID NO: 108716 - DNA, 546 bp, Homo sapiens
  misc_feature: GYAE6OF02GHMJF.16.38.D05.1.454.CMB.1.raw
  modified_base (214)..(214): a, c, t, g, unknown or other
  misc_feature (214)..(214): n is a, c, g, or t
  modified_base (383)..(383): a, c, t, g, unknown or other
  misc_feature (383)..(383): n is a, c, g, or t
  modified_base (397)..(397): a, c, t, g, unknown or other
  misc_feature (397)..(397): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctcncctgccagggccagtccagagtgttgccaccaattttacgcctggtaccagcaaaaccctggccaggctcccaggctcctcatctatgtgcatctaccaggcactgatgtcccagtccggttcagtggcagtggttgggacagcttcgactctcaccatcagcaccctncacgtctgacggtntttgacctaagtttattattgtcagcagtataacttacgtgtccctcgtactacgtttacggaccgtaggggacctaaggctagggacgactacaaccgtaactcggtacggcttcgcctaccagtccttacggtcttaccattccccg

SEQ ID NO: 108717 - DNA, 232 bp, Homo sapiens
  misc_feature: GYAE6OF02GTFNB.16.38.D05.1.454.CMB.1.raw
  modified_base (230)..(232): a, c, t, g, unknown or other
  misc_feature (230)..(232): n is a, c, g, or t
tcagtgtactactccacgaccggtgctcgatttagtatctgatagttgggtttggggcagagctctggggaggaactgctcagttaggacccagacggaaccatggaagccccagcgcagcttctcttcctcctgctactctggctcccaggaactgtggctgcaccatctgtcttcatcttcccgccatctgagagtagtacactgagcgggctggcaaggcgcatagnnn

SEQ ID NO: 108718 - DNA, 716 bp, Homo sapiens
  misc_feature: GYAE6OF02H7C34.16.38.D05.1.454.CMB.1.raw
  modified_base (205)..(205): a, c, t, g, unknown or other
  misc_feature (205)..(205): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaacncgccaccctctcctgcagggccagtcagagtgtgccactaatttgcctggtaccagacaaaacctggaccaggctcccgaggctcctcatctagtggtgcatcctacgaggcctagtgatcgtcccgacgggtccggttcaggtcggcgtagggttggggtttcgggacaggtacttcgactcgtacaaccgatccgacgtcctacccgtgacgtacgtctaggtagttacgttttacgacttaattttatttagttcgtacgtagtacgtaagtttaacttaaacgtttaccgtcggttaccccttaccgtttaccgttacgtttttccgggaacccgggttaaccggggtaaaccctaaacggttaccgggttaagggtaaccgttaaccgttaaaccggtaaaaccggtacggtttacgggttacgggtaccgttaaccggacccgttaaccgttacgttttaccccgttacggttttacccgtttaccgtacccgttttccccccgg

SEQ ID NO: 108719 - DNA, 714 bp, Homo sapiens
  misc_feature: GYAE6OF02IYERO.16.38.D05.1.454.CMB.1.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaancaccaccctctcctgcagggccagtcagagtgttgccactaatttgcctgtaccagacaaaacctggaccaggctccaggctcctcatctatggtncatctaccgagggccacgtcgactcggtcccgagggtccggttcgaggttcggacgtagggttggggttttacgggactacggtaccttacgtaaccttcctaccaaccctacttaccgacgtccctaacccgtgaccgtaacggttctagggtacggttattttcgacctttaaagtttttagtttacgtttgttacgtaagttaccgtagtttaacttaacgtttacggtacggttacccttaccggtttaaccgttaccgtttttacggacccgggtaacgggtaaccgtaacggtacgtagggaacgttacgtaaccgtaaacggtaaccggttacggtacgggtaccgtacgtaccgttacccgtaactttccggttaccggtttaccttcccgttaccgtttaccccg

SEQ ID NO: 108720 - DNA, 561 bp, Homo sapiens
  misc_feature: GYAE6OF02HRKLR.16.38.D05.1.454.CMB.1.raw
  modified_base (203)..(203): a, c, t, g, unknown or other
  misc_feature (203)..(203): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgcccaccctctcctgcagggccagtcagagtgttgccacaatttagcctggtaccagcaaaaacctggccaggctcccaggctcctcatctatggtgcatctaccgagggccactgactcgtcccagggccggttcaggtggctaggtggggtttgggacagacttcactctcaccatcagcacctgcagtctgagtntttgntaatttattattgtcagtctagttaataattacgtcggtccttaccgttactacgttttcggaccgtaaggggtaccaaggtcgtagggaagtatacgaaacggtaacgtgtcggactcgacctacgtactccgttggtaccttcaccttcccg

SEQ ID NO: 108721 - DNA, 620 bp, Homo sapiens
  misc_feature: GYAE6OF02I7H3M.16.38.D05.1.454.CMB.1.raw
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtntctccaggggaancgccaccctctcctgcagggccagtcagagtgttgccacatttacgcctggtaccagcaaaaacctggccaggctcccaggcctctcatctactggtgcatctacgagggccactgatcgtcccaggtccggttcagtcggcctaggtggggttttcgggacaggtactcacgtctcaccatcagcctaccngcngtctaggagtatttcgattaactttattattgttcagtctattaagtacttacgttacgtcccttacgttactacgtttttccgggccggtaacggggtaaaccctaaggtaccgttagggaacgttacgtaaccgtaaaaccggtaacttagggtacggtactacggtacccgtaccctaacggtttacccgtggtttaccctttccgtaattttcccccgg

SEQ ID NO: 108722 - DNA, 602 bp, Homo sapiens
  misc_feature: GYAE6OF02IM6UR.16.38.D05.1.454.CMB.1.raw
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagacaaaaacctggccaggcctcccaggctcctcatctatggtcgcatctaccgagggccactgatcgtccgacggtccggttcaggtggcgtagggttggggtttgggactagtacttcactctcaccatcagccaccgtgcagtctagtaggtatttgacttaattttattagtttgtactagcgttaagttaattaaacgtttacgtggtacccttaccgttaaccttacgttttcgggaccgtaacggggtaaccgtaaggtcgtaggaagtacgtaaccgaaacgtacgttcggtagtcgtacgaccgtacacttcgttcgttcttcctacttccccg

SEQ ID NO: 108723 - DNA, 694 bp, Homo sapiens
  misc_feature: GYAE6OF02H9UJ4.16.38.D05.1.454.CMB.1.raw
  modified_base (207)..(207): a, c, t, g, unknown or other
  misc_feature (207)..(207): n is a, c, g, or t
  modified_base (320)..(320): a, c, t, g, unknown or other
  misc_feature (320)..(320): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactgggagaagtagtgatgacgcagtctccagcccaccctgtctgtgtctccgaaggggaaanccgcccacctctcctgcagggccagtcagagtgttcgccaactaatttacgccttaggtaccagaccaaaaaaccgtggaccacggcctccgaggtcctcctcatctatggtnctactcgtaaccgaggaccaacgtgtacgtccgtacccgagggtccggttacgacggtcggacgtagggtttggggtttgggacctaaggtacgttcaacttcctacaccctagtcacgcccaccgtagactacgttcgtggaacgttattttgaaccgttaattttatttagttacgttccgtagtacctaagttaattaaacgtttacgttcggtacccgtttaccgttacttaaccggtttttacgggaccgttaaccggggaacctacggacgttacgggaagtaccgtaacgtaaaaccgtacgtacggtcggtccgttacgacccttacctatttaccgttacgtttactttaccgtatttacccccg

SEQ ID NO: 108724 - DNA, 579 bp, Homo sapiens
  misc_feature: GYAE6OF02F1VHP.16.38.D05.1.454.CMB.1.raw
  modified_base (552)..(552): a, c, t, g, unknown or other
  misc_feature (552)..(552): n is a, c, g, or t
tcagtgtactactccacgaccggtgctcgatttagtatctgatagttgggtttgggctcaactctcttgtctcaccatgggagtttgggctgagctgggttttcctcgttactcttttaagaggtgtccaatgtcaggtgcagttggtggagtctgggggaggcgtggtccagcctggaaggtccctgagactctcgtgtgcagcgtctggattcattctttaatagtttttcctatgctactggactccgccaggcctccgaggcgagggggactggagtgggtggcaggagtgtcacttgatggagccaatacatacttcgacagtactccgtgaacgggccgtattccacctatttccagagacgaattccaaacaacacgctgcatctgacaatggacaccgtgacgactgacgacacggctgtacttacttactgtgtgacgtacttcttattgcggttcgggtctttgacgttacgtcgggaccgtagggacttcccgtgtcctaccgtcctccgtccaccgtccctacccgaccgacggtacccncgttccggttcccttccccgtacccgg

SEQ ID NO: 108725 - DNA, 543 bp, Homo sapiens
  misc_feature: GYAE6OF02FH7CP.16.38.D05.1.454.CMB.1.raw
  modified_base (364)..(364): a, c, t, g, unknown or other
  misc_feature (364)..(364): n is a, c, g, or t
  modified_base (500)..(500): a, c, t, g, unknown or other
  misc_feature (500)..(500): n is a, c, g, or t
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtggggtggcaggagtgtcacttgatggagcaatacatacttcgcagactccgtgaaggccattcacattcagagagacttccaacaacacgcngacatctgacaaatcggaccacctgacgacctgacgacgacggactcgtacttattacgtgttgtgagtacttcttattcggtcgttcggtctttgacttcgtgggccgaggctccgtggtccaccgtcctcctcncgtccctccgaccgacggccctatccggttcccttccccgtcg

SEQ ID NO: 108726 - DNA, 583 bp, Homo sapiens
  misc_feature: GYAE6OF02IE07N.16.38.D05.1.454.CMB.1.raw
  modified_base (394)..(394): a, c, t, g, unknown or other
  misc_feature (394)..(394): n is a, c, g, or t
  modified_base (517)..(517): a, c, t, g, unknown or other
  misc_feature (517)..(517): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccagggaaacgcgccaccctctcctgcagggccagtcagagtgttgccacaatttacgcctggtaccagaccaaaaacgtcgaccaggctcccaggctcctcatctatggtgctatcctaccagggccactgacgtcgtcccgaggtccggttcagtggctagggttgggtttcggggacacgtacttcacttctcaacctntccagcctaccctgctacgtcgtggacgttattttgacttaatttattattgttacagctaagttaattatacgtggtaccttacggtacttacgtttcgacgtacgggacctagcgtagganacgtaacgaaacgcgttagtcggatacgtccaccgtacttaccgttcgtacttacctcttaccccg

SEQ ID NO: 108727 - DNA, 603 bp, Homo sapiens
  misc_feature: GYAE6OF02F0XF3.16.38.D05.1.454.CMB.1.raw
  modified_base (204)..(204): a, c, t, g, unknown or other
  misc_feature (204)..(204): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaancgccaccctctcctgcgagggccagtcagagtgttcgccacctaatttacgcctggtaccagacaaaaaccgtggccaggctccgtaggcctcctcactctatgggtcgcatcctaccgagggcccactgactcgtcccagggtcccggttcgacggtcggcgtagggtgggggttttagggacgagtacttcactcctacaccatcacgccaccctgacagtctggtaggtatttgacttaattttattatttgtactagtactagtaattaattacgtcggtaccttccgtacttacgttttcggaccgaaggggtacccagtccgtagggatactagaaaccgtacggtgtacggacgttcgacctaccgtacttcgtcgttcttacacttccccg

SEQ ID NO: 108728 - DNA, 781 bp, Homo sapiens
  misc_feature: GYAE6OF02HAOWX.16.38.D05.1.454.CMB.1.raw
  modified_base (208)..(208): a, c, t, g, unknown or other
  misc_feature (208)..(208): n is a, c, g, or t
  modified_base (323)..(323): a, c, t, g, unknown or other
  misc_feature (323)..(323): n is a, c, g, or t
tcagtgtactactccacgaccggtgctcgatttagtatctgatagttgggtttgggggtaggaacgtgctcagttaggacccagacggaaccatggaagccccagcgcagcttctcttcctcctgctactctggctcccagacacgactggagaagtagtgatgacgcagtctccagcccaccctgtctgtgtctccgaaggggaacncgccctacctctcctgcagggccagtcagagtgtcgccactaatttgcctggaccagacaaaactgaccagcctccaggctcctcacgtctagtggtcgtcgactcgtaacccgngggtacccacgtcgtacgtcgttcccggaaccgggtcccggtttacggacggttacgggccggtaaggggtttcgggggtttaggggacctaacgggttaaccttacgtaaccgttcccttaaccgaaccctaacgttacccgaacgtcccgtaaccccgttaggacctaaccgggttcgttacgggtaaagggtttcgtttttaaacggtacctttaaaagtttttacgttaaacgtttttcggtacgtacggttaactaaagggttttaactttaaaacgttttaccgtccgggttaacccgttaacccgtttacggtttaccgtttttaacgggaccccgtaaggggtaacccctaaaggtcggtaggtaacgtactaacccgtaaaacggtacgttacggtcgtacgtacgacctacgtacgttccgttgtaccgttacctactttacccccgg

SEQ ID NO: 108729 - DNA, 332 bp, Homo sapiens
  misc_feature: GYAE6OF02GMGBK.16.38.D05.1.454.CMB.1.raw
  modified_base (286)..(332): a, c, t, g, unknown or other
  misc_feature (286)..(332): n is a, c, g, or t
tcagtgtactactccacgaccggtgctcgatttagtatctgatagttgggtttggggcagagctctggggaggaactgctcagttaggacccagacggaaccatgggaagcccccagcgcagctttctcttcctcctgctactctggccctccgagactggtgctgaccacctatcgtcgttcttactacttcccgttcccccgacctacttcgtaggaaggtaggttaacgtacctagtaggacggggtccgggtcgtacgggaacgaacgggccgaataagtgnnnnnnnnnnnnnnnnnnnnnnnnnnnnnnnnnnnnnnnnnnnnnnn

SEQ ID NO: 108730 - DNA, 585 bp, Homo sapiens
  misc_feature: GYAE6OF02HF6XH.16.38.D05.1.454.CMB.1.raw
  modified_base (225)..(225): a, c, t, g, unknown or other
  misc_feature (225)..(225): n is a, c, g, or t
tcagtgtactactccacgaccggtgctcgatttagtatctgatagttgggtttgggctcaactctcttgtctcaccatgggagtttgggctgagctgggttttcctcgttactcttttaagaggtgtccaatgtcaggtgcagttggtggagtctgggggagcgtggtccagcctggaaggtccctgagactctcgtgtgcagcgtctggattcaatctttaaanagttttcctatgcactggatccgcaggctcaggcaggggactggagtgggtggcaggagtgtcacttgatggagccaatacatacttcgcagactccgtgaaggccgattcaccatttccagagagaattccaaacaacacgactgcaatctgacaaatggacaccctgagactgacgacacggctgtacgtattactgtgtacgataccgtctttaagtcgtcggtttcgggtctttgtaccgttaacgtggggtaccgaagggtactcccgtacggtcgtacccgttcctccctctacgccctaccgacccgtaaaccgggccctaacgttaccggttcccgtttcccccgtacccgg

SEQ ID NO: 108731 - DNA, 690 bp, Homo sapiens
  misc_feature: GYAE6OF02II1G4.16.38.D05.1.454.CMB.1.raw
  modified_base (203)..(203): a, c, t, g, unknown or other
  misc_feature (203)..(203): n is a, c, g, or t
  modified_base (656)..(656): a, c, t, g, unknown or other
  misc_feature (656)..(656): n is a, c, g, or t
tcagtgtactactccacgaccggtgctcgatttagtatctgatagttgggtttgggggaggaactgctcagttaggacccagacggaaccatggaagccccagcgcagcttctcttcctctgctactctggctcccagacacgactggagaagtagtgatgacgcagtctccagccaccctgtctgtgtctccgaggggaaanccgcccacccttctcctgcgagggccagtcagtagtgtcgccaccaatttcgcctaggtaccacgaaccaaaaaccgtggaccgacggcctacccgaggcctccctcactctagtggtcgactactacctaccgacgggacctacgtgtactcggtacccgacgggtccggttacgacgggtaggcggtacggttgggggttttacgggacgtacgttacttccgtacgtccgtaccgaacctaacttccacgtaccctacccgtgtaccgtacggttctaggtacggttatttttacgaactttaatttttaacttgtttacgtcgtaagtaccgtaattaacttaacgttacttcgggtaccctttacgtacccgtttacgttttccggaccgttacggggaccgtaacgtcggttagagtacaacgtaaccgtaagtcggtagtcgtacnccgtactgttcctacgtttcttctactttccccg

SEQ ID NO: 108732 - DNA, 711 bp, Homo sapiens
  misc_feature: GYAE6OF02HCX8X.16.38.D05.1.454.CMB.1.raw
  modified_base (202)..(202): a, c, t, g, unknown or other
  misc_feature (202)..(202): n is a, c, g, or t
  modified_base (313)..(313): a, c, t, g, unknown or other
  misc_feature (313)..(313): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctcgaggggaancgccaccctctcctgcacgggccagtcagagtgttcgcctaacctaagttttacgccttaggtaaccacgaccaaaaaaccgtggaccgtacggcctcccgaggccttccncgtactcgtagtcggtcgctactaccgtaccgacgggcctacgtacgtactcggtcccgacgggtccggttacgacggtggcgtagggttggggtttacgggactagtaccgttcgacttcgtaccaaccgtactaccgaacgtaccacccgtggacctaggtcgtacggtaaggttacttttcgtaactttaaagttttacgttacgtttcgtactacggttactaaggtttaaacttaacgtttaccgtcggttacccgttacccgttacgtttaccgtttacgggacccggtacggggtaacctaacggtcgtaacgggatactaacgtaaccggtaagtcggtacggtacttacgaccgtactacgttccgtagtttcccttactacttccccg

SEQ ID NO: 108733 - DNA, 699 bp, Homo sapiens
  misc_feature: GYAE6OF02IWHG7.16.38.D05.1.454.CMB.1.raw
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaagcgccaccctctcctgcagggccagtcagagtgtcgccactaatttacgcctggaccagacaaaacctggaccaggcctcccgagcctcctcatctagtggtgcatcctaccgacgggcccacgtgacgtcgtcccgagggtccggttcgaggttcggccgtagggttgggggtttcgggacgtagtacctttcgacttctaccaccatccacgcccgtacccgtgaccgtacgttcgtaggtacggttattttgactttaattttatttagtttcgttactagtacttaagttaacttaagtttaccgtcgggttacctacccggtttaacccgttacgttttccggaccggtaacggggtaccgtaacggtaccggttaacgggacgttaccgtaacgtaaaccgggtaaccggttacgggttacgggtacccgttccgaaccgtacccgtacgttccgtttacccggttacctttacctaccgtttcccccgg

SEQ ID NO: 108734 - DNA, 791 bp, Homo sapiens
  misc_feature: GYAE6OF02G3W35.16.38.D05.1.454.CMB.1.raw
  modified_base (204)..(204): a, c, t, g, unknown or other
  misc_feature (204)..(204): n is a, c, g, or t
  modified_base (315)..(315): a, c, t, g, unknown or other
  misc_feature (315)..(315): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaaggggaanccgccaccctctcctgcgagggccagtcagtagtgttcgaccacctaatttacgcctggtaccagaccaaaaccgtggaccaggcctcccaggcctcctcatctagtggtnctactctaccgagggccacgtagacgttcgtcccgagggtcccggttcgaggtcggacgtaggggttcggggtttagggactacggtactttacacgttcctaccgaacctactccgaacgcctacccgtggacctacggttcgtagggtaacgggttacgttttcgtaactttaaagtttttaacttttagttttacggttacgtaacggtaacgttaaacgtttaaactttaaacgttttaaccggttcgggttaccccgtttacccggttaaccgttttaaccgtttttccgggaacccggttaacggggggtaaaccctaaacgggtaccgttacggggaacgttacgttaaacccggtaaaacggttaaccggtttacgggttacgggtaccgtttaccggtaacccgttaacccgttacgtttacccggtttacggtttaccctttaccggttacccgttttacccccgg

SEQ ID NO: 108735 - DNA, 627 bp, Homo sapiens
  misc_feature: GYAE6OF02FPXTO.16.38.D05.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (356)..(356): a, c, t, g, unknown or other
  misc_feature (356)..(356): n is a, c, g, or t
tcagtgtactactccacgaccggtgctcgatttagtatctgatagttggggtttggggggaggaactgctcagttaggacccagacggaaccatggaagccccagcgcagcttctcttcctcctgctactctggctcccagacacgactggagaagtagtgatgacgcagtctccagccaccctgtctgtgtctcgaggggaancgccaccctntcctgcacgggccagtcagtgtgttcgccactaatttacgccttacggtaccagaccaaaaacctggccaggcctcccgaggtctcctcacttctatggtgctatctaccgagggccatgatcgtcccgacgggtccggttnacggtggacctaggggttcgggggtttggaacgtaggtacttcgactctaccacctatccacgaccctacctcgactcgtcgtacggtaggttagttttacgacttaattttattagtttgtctagtcttaagttaattaagttaccgttcgtaccttaccgttactttaccgtttcggaccgtagggtaaccgagtctagggtacgtactaacgaacgtctgggtcgactacggactaccgtagttaccgtagtcgttactacgttcccg

SEQ ID NO: 108736 - DNA, 618 bp, Homo sapiens
  misc_feature: GYAE6OF02F146P.16.38.D05.1.454.CMB.1.raw
tcagtgtactactccacgaccggtgctcgatttagtatctgatagttgggtttgggggaggaactgctcagttaggacccagacggaaccatggaagccccagcgcagcttctcttcctcctgctactctggctcccagacacgactgtagaagtagtgatgacgcagtctccagccatcctgtctgtgtctccaggggaaagcgccaccctctcctgcagggccagtcagagtgttgccacctaatttagcctggtaccagacaaaacctggccaggctcccgaggctcctcatctatggtgcatctaccgagggccacgtgatcgtcccgacggtccggttcaggtggctagggttggggtttgggacaggtacttcactcctcaccatcacgccaccctgctacgtcgtggtaggtattttcgacttaagtttatttagttcgtactagtactagttaattaactttaccgtcggtacccttacccgttaacgttaccggtttttcgggacccggtaacggggtaacccgtaaggtccgtaggacgtacgtacggaaaacgtacgttcggtacggtccgtacgctaaccgtagttcgtcgttaccttactacccg

SEQ ID NO: 108737 - DNA, 678 bp, Homo sapiens
  misc_feature: GYAE6OF02H6KNJ.16.38.D05.1.454.CMB.1.raw
  modified_base (204)..(204): a, c, t, g, unknown or other
  misc_feature (204)..(204): n is a, c, g, or t
tcagtgtactactccacgaccggtgctcgatttagtatctgatagttgggtttgggggaggaactgctcagttaggaccagacggaaccatggaagccccagcgcagcttctcttcctcctgctactctggctcccagacacgactggagaagtagtgatgacgcagtctccagccaccctgtctgtcgtctccgaggggaacnccgccacctccgtctcgcgacgggccaggtcagagttgttcgaccaactaatttacgcctaggtaccagaacaaaaccgtcggaccaaggcctaccgacggtctcctacacttactacgtggtacgactacgtctaaccgacggtaccacgtacgtacgtccgtaccgacggtccgttacgtaggtcggcgtaggggttggggtttacgggacgtacgtaccgttactacccttcgtaccctaccgtataccgacgaccctaccgtcgacgtacgtcgttaggtacggttatttacgactttaactttagtttaactttcgacttagtacgtaaatttataacgttacgtacgtccgttaccgttacttacgttcggtacccggtaagggtaccaaacggtcgaggtacgtactaccgaacgtagttggtacgcgttacgaccttcgtactcgttagtcttaccgtattccccg

SEQ ID NO: 108738 - DNA, 665 bp, Homo sapiens
  misc_feature: GYAE6OF02GQ08F.16.38.D05.1.454.CMB.1.raw
  modified_base (205)..(205): a, c, t, g, unknown or other
  misc_feature (205)..(205): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagcccaccctgtctgtgtctccgaggggaaanccgccaccctctcctgcagggccagtcagagtgtgccactaatttagcctggtaccagacaaaacctgccaggcctccaggcctcctcatctagtggtcgcatcctaccgagggccactgatcgtcccgacgggtccggttcgaggtcggacgtaggttggggtttgggactaggtacttcaccttctcgacctaactccgacgcctaccccgtgctacgtcgtaggtacgttattttcgactttaaagtttactttagtttcgtatacgtctaagttaattaacgtttaccgtcggtcccgttaccgttacgttttaccgttttcgggaccgtaaccgggggtaacctaacggtcgtagggtaacctagtaacccgaaaacggtacgtaggttaccggtccgttaacgcccgtaacccgtacgttccgttacgttactttaccctacgtttacccccgg

SEQ ID NO: 108739 - DNA, 260 bp, Homo sapiens
  misc_feature: GYAE6OF02HZ3QQ.16.38.D05.1.454.CMB.1.raw
  modified_base (254)..(260): a, c, t, g, unknown or other
  misc_feature (254)..(260): n is a, c, g, or t
tcagtgtactactccacgaccggtgctcgatttagtatctgatagttgggtttgggacagacttcactctcaccatcagcaccctgcagtctgaggatttgcaatttattattgtcagcagtataattactggcctccgtacacttttggccaggggaccaagctggagatcaaacgaactgtggctgcaccatctgtcttcatcttcccgcatctgagagtagtacactgagcgggctggcaaggcgcatagnnnnnnn

SEQ ID NO: 108740 - DNA, 744 bp, Homo sapiens
  misc_feature: GYAE6OF02G2B0U.16.38.D05.1.454.CMB.1.raw
  modified_base (202)..(202): a, c, t, g, unknown or other
  misc_feature (202)..(202): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctcgaggggaancgccaccctctcctgcgagggccagtcagagtgttgccaccaatttacgcctcggtaaccagacaaaaacctggaccgaggtcctacccacggtcctccctcactactagttggtcgctataccgtacccgacgggaccctaacgtacgacttccggtaccccgtacgggtcccggttacctacgggttcggacggtacgggttggggggtttacggggaacgtacggtaccttccgtaaccttcctaccgaacctaacgtacccgtagacccctacccgtcgtacctacggttccttagggtacggtttaagttttcggtaacttaaactttttaatttacgtttgttaccgtagttaccgttaagttaactttaaacttcggttaccggttaccgttaccgtttaaccgttacgttttacggacccggttaacggggtaaccctaggacgttacggtaacgtacgtaacggtaaaacgtccgttaggtacggacgtacgaccgtaacctacttaccgttcgttacttactacttaccccg

SEQ ID NO: 108741 - DNA, 586 bp, Homo sapiens
  misc_feature: GYAE6OF02GAAFM.16.38.D05.1.454.CMB.1.raw
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctcccaggctcctcatctagtggtgcatctaccacgggccacgtgatcgtcccgagggtccggttcaggtggcgtaggtggggtttgggactaggacttcgactaccctaccactcgacgtccaccctcgacgacgtctcgtaggtattttgtacgtaatttatttattgttctagtctaagtaattatttaactcgtccgttaccttacgtactttcggtaccgtacgggaaccaaggtacgtagtacgatactaaacgacgtgtacggctggacacgtactcgttctcttaccgtactccgttcccc

SEQ ID NO: 108742 - DNA, 532 bp, Homo sapiens
  misc_feature: GYAE6OF02G96O5.16.38.D05.1.454.CMB.1.raw
  modified_base (422)..(422): a, c, t, g, unknown or other
  misc_feature (422)..(422): n is a, c, g, or t
  modified_base (485)..(485): a, c, t, g, unknown or other
  misc_feature (485)..(485): n is a, c, g, or t
  modified_base (524)..(524): a, c, t, g, unknown or other
  misc_feature (524)..(524): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctccaggctcctcatctatggtgcatctaccagggccactgatgtcccaggtccggttcagtggctaggtgggtttgggacagtacttcactctcaaccatcagcacctgacagtctgaggtatttgactaatttattattgtanagcagttaataattacgtgtcctaccgtatacgtttcggccgtaagggacctaagcgtagganactacaaacgtactgtacgctagacacattctgtccttntacttccc

SEQ ID NO: 108743 - DNA, 873 bp, Homo sapiens
  misc_feature: GYAE6OF02JATAT.16.38.D05.1.454.CMB.1.raw
tcagtgtactactccacgaccggtgctcgatttagtatctgatagttgggtttgggctcaactctcttgtctcaccatggagttttgggctgagctgggtttttcctcgttactcttttaagaggtgtccaatgtcaggtgcagttggtggagtctgggggaggcgtggtccagcctggaaggtccctgagactctcgtgtgcagcgtctggattcatctttaatagttttccatgcactggactccgccaggctccgaggcgaggggctgggacggtgggtggcgagggtagtcggtctaacgttggagtgggacgacccgaaatactaacttaccgtttcggactaacggtaccgttcccggtaagggtaaacgggggccccgttaacttacccgaaacccttactttttaaccccgaaggtaaacggtaaacggtaaacctttacccccgaaaacgtaaaccgacgtaccgttacgacctaaacttcccgtagtaaacctaaaaggtaccgggaacccttaaacccgtacggaaaccgggtaccccgttaacggaacccggaaaccgtaccgggttaccttacggttaacctttaacgttttaaccggtcggtttaggtacgggttaacgttacccgtttacgttttacgggtttacgggttcccgggtttacgggtttaccttttacgggttaaccctttaacgggggttcccgggggtaccccggtaagggttacgtttccccgtacgggttcccgttacccggttcccggtacccgttaccgaacccgtccccgtaaccccggaacccggttaacccgggcccccttaacggtttcccccggttcccctttacccccggtcccccgg

SEQ ID NO: 108744 - DNA, 812 bp, Homo sapiens
  misc_feature: GYAE6OF02JVZCX.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtcgtgggggaggcgtggtccagcctggaaggtccctgagactcgtcgtgtgcagcgtctggattcatctttaatacgttttccatgcactggactccgcaggctcgaggcgaggggctggagtggtgcgaggtagtgtcacttggagtcggaacgaccaaagtactaagttccttcggactaggtaccgttccgggtaggaaaaccgggggtccttaacttcccgaaccgttaacgttttcccgaaaggacggtaaacgttaaaccgttaaaccccaaaacgtaaacccgaccggtccgtacgtacccgtaaatcccttaacggaactaaacgttaccggaaccgtaacccgtacggaacgtacccgtaacggaacccgtacggtaccgtacgtacttacgttaacgttacgtacggttaggtacgtaccgttaattaccgttttagttaccggggttaccggttttccggggttacttttccggtaaccggttagggttaacccgggggtacgtaacggggttacttacccccgggtggttaccccgttaccggttcccttacccggtaccgtacccgttaccccggtaaccccgaaccccgggttaccgggtaccccccttaagggttacccccgttcccccggttacccccgtcccgg

SEQ ID NO: 108745 - DNA, 800 bp, Homo sapiens
  misc_feature: GYAE6OF02GSVGI.16.38.D05.1.454.CMB.1.raw
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaaagccgccacccttctcctgcacgggccagtcagagtgttcgacctacctaagtttacgcctacggtaccaacgaaccaaaaaccgtggccaacgggcctacccgacggcctccctacgtacttccgttagtcggtcgacctacttacccgttaaccggacgggtaccctacgttacggtactccggttaccccgacggggtcccggttcgtaaggtcggacgtaggggttggggtttacgggacgtacgtacctttacgacgttacctaccacctacgtccgacgtacctacccgtcgaccgtacgttcgtacggtaacggttacgttttacgtaacgtttaaattttacgtttagtttccggttaactacggttacttaaaggtttaacttttaaacgtttccggttaaccggttacccgtttacccgtttaaccgttttacgtttttacccggggacccggttaacccggggtaaacctacggtccgttaagggtaaccgttacgttaacggtaaaacccggttagtaccggttacggacttaccggaaccttaccgtacgttcgtttccgtaacctttcgttacctttaccccgg

SEQ ID NO: 108746 - DNA, 871 bp, Homo sapiens
  misc_feature: GYAE6OF02IGK8K.16.38.D05.1.454.CMB.1.raw
  modified_base (202)..(202): a, c, t, g, unknown or other
  misc_feature (202)..(202): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctccagacacgactggagaagtagtgatgacgcagtctccagccacctgtctgtgtctccgaggggaacnccgccaccctctcctgcaggccagtcagagtgtcgccacctaattgcctggtaccagacctaaaacctggaccaggcctcccgaggtacctcctacgatcctagtggtcgtctacttccgtaaccgacgggaccctacgtacgtacgttacggtccccgtaacgggtcccggtttcgtacggtcgggacgtagggtttagggggttcgggaacgacggttactttacgacgttcctaccgaaccctagttaccgacggtccctacccgttacggcctacggttcgttagggtaacgggtttacggtttttacggtaacgtttaaatttttaaccggtttaagttttccggttacgttaacgtccgtttaaaacggttaacgtttaaaccgtttaaccggtttacgggttaccccgttttaccggtttaaaccgttttaccgggttttttacccggggaaccccgggttaaacgggggttaccccgtaaaagggttccccggttaaaggggtaacggttaacccgttaaaccggaaaacccggtttaaaccggttcggggttaaccgggtaaccgtttacccggaaccccgtttaacccgtaaccggttttcccgtttaacccgggttttaccccttttaacccgggttaccctttttaacccccccggg

SEQ ID NO: 108747 - DNA, 778 bp, Homo sapiens
  misc_feature: GYAE6OF02JTQO8.16.38.D05.1.454.CMB.1.raw
  modified_base (167)..(167): a, c, t, g, unknown or other
  misc_feature (167)..(167): n is a, c, g, or t
  modified_base (202)..(202): a, c, t, g, unknown or other
  misc_feature (202)..(202): n is a, c, g, or t
  modified_base (766)..(766): a, c, t, g, unknown or other
  misc_feature (766)..(766): n is a, c, g, or t
tcagtgtactactccacgaccggtgctcgatttagtatctgatagttgggtttgggggaggaactgctcagtttaggacccagacggaaccatggaagccccagcgcagcttctcttcctcctgctactctggctcccagacacgactggagaagtagtgatgacgnagtctccagccacctgtctgtgtctcgaggggaancgccacctctcctgcagggccagtcagagtgttcgacctaccaatttacgccttacggtaccagaccaaaaacctcggaccgaaggcctcccgaggtcctaccctcactcctatcggtgccgtactcctaccggcgggtaccactagcttcgtccgacgggtccgttcgaggttcggaccgtagggttacggggttttcggggaactacgggttaccgttacgtaccgttacccgtctaacccgtagttacccgaaacggtcccgtacctaaccggggtcctaaaccggttcccgttagggtaacggggtttaactttttaccgggtaaccttttaaggtttttaaacctttaaggttttacggttacgtaacgtacgttaaaacgttacgtttaaacgtttaaccggttccgtaaccggtttacccgttaccgttaaccgtttttcggaacccggttacgggtaacctaagggtacctacgggtaagtactacgtaaaacgttccggtagtcggttacctacgggtaactaccttacggttacccgttagtttccggtttaancccgttttcccg

SEQ ID NO: 108748 - DNA, 275 bp, Homo sapiens
  misc_feature: GYAE6OF02GUHOJ.16.38.D05.1.454.CMB.1.raw
  modified_base (257)..(275): a, c, t, g, unknown or other
  misc_feature (257)..(275): n is a, c, g, or t
tcagtgtactactccacgaccggtgctcgatttagtatctgatagttgggtttgggacagacttcactctcaccatcagcaccctgcagtctgaggattttgcaatttattattgtcagcagtataattactggcctccgtacacttttggccaggggaccaagctggagatcaaacgaactgtggctgcaccatctgtctcatcctccgcatctgagagtagacactgagcgggctggacgaaggcgacagtagcnnnnnnnnnnnnnnnnnnn

SEQ ID NO: 108749 - DNA, 746 bp, Homo sapiens
  misc_feature: GYAE6OF02H29QK.16.38.D05.1.454.CMB.1.raw
tcagtgtactactccacgaccggtgctcgatttagtatctgatagttgggtttggggctgggagacgagcccagcactggaagtcgccggtgtttccattcggtgatcagcactgaatacagaggactcaccatggagtttgggctgagcttgggttttcctcgttactcttttaagaggtgtccaatgtcaggtgcagttggtggagtcgtggggggagcgtggtccagcctggaacggtccctgagactctcgtgtgcagcgtcgtggtattcgattactttaattacgttttccaagtcgaccgtacgttcggaccttcccggaccgtaggtcctaccggagggccggaagggggtacctggggaacgggttggggttacggggttaagggtacggttcgtaccgttaacgtttggacgttcgggaacgtaccctaaagtacctaagttaccgttcgactagaccgttccgggtaggaacgggccctaactttacccgaaccttacgttttacccgaaagtacggaacgttaaacttaacccgaaactaaccgacgtcgtagacctaacgttccgtaagacctaaaaggttccgaaccctacccgtaggaccgtaaccgtacggaccgaaccgtacggtaccttcgtttaacttacgtttactggttaacggtcgtacgtactttacgtttacgttcggttccggtttccggttcgtttaccgtaccggttaccggtacgggg

SEQ ID NO: 108750 - DNA, 598 bp, Homo sapiens
  misc_feature: GYAE6OF02HNY6M.16.38.D05.1.454.CMB.1.raw
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtcgtgggggagcgtggtccagcctggaaggtccctgagactctcgtgtgcagcgtctggattcattctttaatagttttcatgcactggactccgcaggctcgaggcgagggactggagtgggtgcgaggagtgtcacgttgatggacgaccaatacgaatacgttcggcaagacctccggtagaacgggctagttccaccgtatttccgagagaagacttaccaaacaacgacgctagaccagtcacgactaaagtggaaccaccctgaaccgactagacgacacgctgtactattacgtgtgtgacgtatacttacgtgtacggttacggtctttagtacctagtcgggctagggacttcccgtaggtccgtaaccggtcctacccgtcgacctccctacccgacctaaccgggcctacgttcccggtcccttccccgtacccgg

SEQ ID NO: 108751 - DNA, 661 bp, Homo sapiens
  misc_feature: GYAE6OF02IIIBG.16.38.D05.1.454.CMB.1.raw
  modified_base (203)..(203): a, c, t, g, unknown or other
  misc_feature (203)..(203): n is a, c, g, or t
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (291)..(291): a, c, t, g, unknown or other
  misc_feature (291)..(291): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaancgccacctctcctgcagggccagtcagacgtgtgccacatttagcctggtaccngacaaaactgcngctccagctcctcatctatgtncatctaccgaggccacgtagtactcgtcccgacggtcccgttacgacggtcggcctagggttcggggtttcgggactacggtactttacgacgttccttaccaccgaacttccgaagtcccgtacccgtgtaccaacggttccgttacggacggttagttttacgacgttaatttagttagttcgtactagtactagtaacttaacgttacgttcggtaccttaccgtaccgtacgttttccggaccggttagggaacccgtaagcccgttaaggtacgtacgttaccgaaaccggtacgttacggtacggtaccgttaccggtacctacccgtagttccgttacggtttccttactaccgtttaccccg

SEQ ID NO: 108752 - DNA, 693 bp, Homo sapiens
  misc_feature: GYAE6OF02IILXX.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaancgccaccctctcctgcagggccagtcagagtgttgccaccaatttagcctggtaccagacaaaaacctggaccaggctcccgaggctcctcatctatgtcgctatctaccgaggccactgagtcgtcccgacggtccggttgtacgtggcgtaggttgggtttggacgtaggtacttcacttctccacctactacacgcctaccctgctaacgtcgtaggtaggttagttttacgacgttaaattttagtttaagtttacgttaccgtaaggtacttaaaggttttaaactaaacgttttaccgttacgggtacccctttaccggttaccgtttaaccgtttttcgggaaccccgttaacggggggtaaccctaaagggtcccgttaggggaacgtacgtaaccgtaaaccggtaacgttgggtaccgtaccggttacgaccgtacctaccgtttaccgttaccggtttaccttacccgtactttccccg

SEQ ID NO: 108753 - DNA, 847 bp, Homo sapiens
  misc_feature: GYAE6OF02HE1HP.16.38.D05.1.454.CMB.1.raw
  modified_base (211)..(211): a, c, t, g, unknown or other
  misc_feature (211)..(211): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagcccaccctgtctgtcgtcctaccggaaggggaaacnccgacccaccctctccgtgaccgagggccctaggtcgaagtaggttcgttacgaccctaacctaagttttacgaccgtacggttaaccaacgtaaccgtaaaaaacccgtcggacccgtaacggtacccttaccccgaacggtcccttaccctaccgaacgttctaacggttcgggtacgtaccttacgtaccgttaacccggaacggggtacccctacggtagtaccgttccgggtaccccgtaacgggtcccggttacggtaacggtcggtacggttacggggtttacgggggtttaccgggtaacgtaacgtttacccgttaccgtaccgttccctaaccgaacctacgtaaccgtacgtaccctacccgtagaccgtagtttccgtagggttaagtttacgttttaacgaacgtttaattttaagtttaacgttacgttaacgagtttaaccgaaagtttaaacttaaaccgtttcggtacgttaccccgttacgttacccgttaacgttttaccggaacgtaaccgggtaacgtacgacggtagaacgtactaacggaaacggttcgaggttacgacgtacgtaaccggtacttacggttccttacgtttacttaccttaccgttaccccg

SEQ ID NO: 108754 - DNA, 747 bp, Homo sapiens
  misc_feature: GYAE6OF02HBXKU.16.38.D05.1.454.CMB.1.raw
tcagtgtactactccacgaccggtgctcgatttagtatctgatagttgggtttgggctcaactctcttgtctcaccatggagtttgggctgagctgggttttcctgttactcttttaagaggtgtccaatgtcaggtgcagttggtggagtcgtgggggagcgtggtccagcctggaaggtccctgagactctcgtgtgcagcgtctggattcattctttaatacgttttccatgcacgtggatcccgcaggcctccgaggcgaggggtactgggaggtgggtggcagggtagttcgactacgttggatcgggaacacccaaagttcctaagttaccgttccggctaaacggtccgttcccgggttaggaacgggtcccgtaagtttcccaaccgtactttaccgaagtaagaaacgtaacttacccgaaaccaacgccgtactaacgctaatccgtaagaccaaacgttcggaccctaccgtagactaccgtacgacgtaaccgacggcttacgtacgttaacgttacgttgttacgacgtacgttacgttatttacgttcggttaccggtttcggttctttaccggacgtttaacgggtccgggtaccggtacgggccgttacccgttcgggttacccgtacccgggttcccttaccgtccgtaacccgtcccctaacccgaacccggttaacccggacccgttaacccggtttccccgggttaccccttccccccggtacccgg

SEQ ID NO: 108755 - DNA, 744 bp, Homo sapiens
  misc_feature: GYAE6OF02INJFH.16.38.D05.1.454.CMB.1.raw
  modified_base (205)..(205): a, c, t, g, unknown or other
  misc_feature (205)..(205): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctaccgaggggaacncgcccaccctctcctgcgaggccagtcagattggtcgcctactaattcgccgtaggtaccagtaaccaaaaccgtggaccgagccgtacccgacggtcctaccgtactactaccgtacgtggtcgactacgtaccgtaccgacggtccctacgtgtacgtccgtacccgtacgggtccggttagacggtcggtcgtaggggttacgggtttcgggaacgtcgttaccttctaccttccgtaccacgtacttaccgacgtaccctacccggtacgaccgtacgtccgtaaggtacggtttaacgtttcgaagtttaacttttattacgtttacgtacgtagtaacgttaagttaacgttaacttcggtacgttcccttaaccggtttaccgttaccggtttacgggacccggtacgggttaaacccgtaggtaccggtaaggtaaccgttacgtaacgtaaaccggtaccggttacggtcggtcttaccgaaccgttaccttacgggttaccttcccgttattacccgtactttcccccg

SEQ ID NO: 108756 - DNA, 677 bp, Homo sapiens
  misc_feature: GYAE6OF02I5LF4.16.38.D05.1.454.CMB.1.raw
  modified_base (200)..(200): a, c, t, g, unknown or other
  misc_feature (200)..(200): n is a, c, g, or t
  modified_base (314)..(314): a, c, t, g, unknown or other
  misc_feature (314)..(314): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccacctgtctgtctctcgagggaancgccacctctcctgcagggccagtcagtagtgtcgccaacctaatttacgcctaggtacccagacaaaaacctggaccaggcctaccgaggcctccgtcactccgtatcggtcnctactcctaccgacgggcctacgtgaacgtcgtacccgacgggtccggtcgtaggtcggacgtagggttggggtttacgggaactaacggtacgttcctaaccgttcgtacctaacctcgtactacgacctacccgtgacgtacggtcctaggtagttagtttcgaacgttaacgtttaattacgtttcgtacgtagtacgttaagttaactttaacgtaccggttccgtacctttaaccgtttacttaccgtttacgggccggtaacgggttaaccaagtccggttggaacgtacgtaactaacggtacgtaggtcggactacgacgtacgtacgttacctggtttccttagtaccttcccg

SEQ ID NO: 108757 - DNA, 961 bp, Homo sapiens
  misc_feature: GYAE6OF02GSMA5.16.38.D05.1.454.CMB.1.raw
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtgtgatgacgcagtctccagccaccctgtctgtgtctccgaggggaacgcgcccaccctctcctgccagggccagtcaggagtgttgccaacctaagtttcgccgtggtaccacgacaaaaaccgtcggaccaggcctcccgacggtcctacccgtctacttacctagtgggtacgacgtaaccttcccgttaacccggacgggtaccccgtaacggttacggtaacgtccggttaccccggtaaccggggtccccggggtttaccgtaacgggttcgggggtaccgtttacgggggtttacgggggtttttacgggggaaaccgttaacggttaccgtttacccggtaccgttttacccctacccgtaaaccccttaaccgtacccgtaacccggtacccctaaccccgtacgggtaacccgttaacggtttaccggttacgggttaacggggttttaaacgttttttacgggtaaacctttttaaacgtttttaacgttttaacgtttttaggttacccgttaaagtttaccggttaaaggttttaaactttaaaacgttttaaccgggttacccggtttaacccgggtttacccgtttaaaccggttttacccgggtttttaacggggttaaccccgggaaaaccggggggtttaaaccctaacgggttaccgggttaacggttaaaccgggtaacgtaccggttaaaaacggtaccggttaacggtacggggttaccttaacggttacccaacgttacggtttaccgtttcgtttaaccgtttacccgtacgtttacccccgg

SEQ ID NO: 108758 - DNA, 734 bp, Homo sapiens
  misc_feature: GYAE6OF02GYWLC.16.38.D05.1.454.CMB.1.raw
  modified_base (205)..(205): a, c, t, g, unknown or other
  misc_feature (205)..(205): n is a, c, g, or t
  modified_base (319)..(319): a, c, t, g, unknown or other
  misc_feature (319)..(319): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggcctcccagacacgactggagaagtagtgatgacgcagtctccagcccaccctgtctgtgtctccgaggggaanccgccaccctctcctgcgacgggccagtcaggtacgtggttcgccactaattacgcctaggtaccagacctaaaaccgtggaccaggcctccgaggcctcctcatctagtggcncactcctacggacggccacgtgtacgtcgtcccggtacggtcccggttacgacggtcggtacgtaggggttcgggggttacgggaacctacgtacttacaccgttccgtaccaccgtactccgaccgccctacccgtcgaccgtacgttacgtacggtaacggtttagtttcgtaacgtttaaacttttacgttacgtttacggtactagtaacgttaacgttaacttaacgtttccggtaccgttacccgttaaccgtttaccgtttacggtttaccgggaccggtaaccggggtaacctacggtaccggtaggtaacgtacgttaaccgaaaccggtaggttacggtaccggtacgtaccgaccgtacccgttacgtccggtttacctacctttaccgtaccctttaccccgg

SEQ ID NO: 108759 - DNA, 677 bp, Homo sapiens
  misc_feature: GYAE6OF02GJC2E.16.38.D05.1.454.CMB.1.raw
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctcagccacctgtctgtgtctccgaggggaancgcaccctctcctgcngggccagtcagagtgttgccacaatttagctgtaccagcaaaacctgcagctccagctctcatctatggtgcatctaccgagggccactgatcgtcccaggtccggttcagtcggcgtaggttgggggtttacggacgtaggtacttcgacgtactcgaaccattcgagtacctaccctgacctaggtactggtaggttacttttacgtactttaaattttacgttagtttacggtacctaggtaccttaaggttaaacttaaagttttaaccgtaccgggttccttacccggttaacgtttacgtttttccggggaccgtaacgggggtaacctaacgggtactaggggtaacacgttaacgtaaacccgtaacggttacggttaccgggcgtttaacggtaccccgttacgtaaccgttcccggtttagtacccgttttaccgtacgtttaacccccg

SEQ ID NO: 108760 - DNA, 753 bp, Homo sapiens
  misc_feature: GYAE6OF02HYVHY.16.38.D05.1.454.CMB.1.raw
  modified_base (151)..(151): a, c, t, g, unknown or other
  misc_feature (151)..(151): n is a, c, g, or t
  modified_base (200)..(200): a, c, t, g, unknown or other
  misc_feature (200)..(200): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactgganaagtagtgatgacgcagtctccagccacctgtctgtgctacgagggaanccgccaccctctcctgcagggcctagtacagtagttcgttacgacctaactaaagtttcgccgtacgtaaccgaagaacctaaaaacgtcggaccgacggtaccctacccgtaaggcccttacccgtactaacgttacttaaggtcgggtacacgtaaccgttaccgtaaccgggacggtaccctacgtcggtacgttacccggtaccgacgggttacccgggttacgacgggttcggacgttacgggtttggggtttacgggaactacgttaaccttcgaaccttaccgtacacccgtaacttaccgaacgtcccgtacccgtagacgtacgtcgtaggtacgttatttacggaacttaagttttattaattcggtactagtactagttaattaacgtaccgtacggttaccctacgttaaccgtttaccgtttcggaacccgtacggtaaccgtaacgttaccgtagggtactacgttaacgaaacgtagtacggtcgtaacgtcgtaactaccgttacgttccgttacggtaccttactaccgttacccg

SEQ ID NO: 108761 - DNA, 824 bp, Homo sapiens
  misc_feature: GYAE6OF02GP5QA.16.38.D05.1.454.CMB.1.raw
  modified_base (189)..(189): a, c, t, g, unknown or other
  misc_feature (189)..(189): n is a, c, g, or t
  modified_base (204)..(204): a, c, t, g, unknown or other
  misc_feature (204)..(204): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtntctccgaggggaacncgccaccctctcctgcacgggccagtcagtagtgttacgccctaactaatttacgcctacggtaccagaccaaaaaccgtcggaccaggtcctccgacggctcctcattctagtggtcgtcatccgtaccgacgggacctacgtcgtactcgtcccgacgggtccggttacgtaggtcggacggtagggttcggggtttagggaccgtaacggtaccttccgtaacttccgttaaccaccctactaccgtaaccggtccctaacccgtcggtaccgtacggtttccgtagggtaacggttttacgttttacgtaacctttaaagtttttacgttttaacgttttaggttaacgtacggttacgtttaacgttaaacgttttaacgttaaccggttacccggtttacccgtttaaccccggttttaacggtttacccggtttttaccggggaacccggtaacggggggttaaaccctaacgggtaccggttaacggggaacgttaaccgtaaacccggtaaacggttaaccgttcgggtaccgggtaccgttaccggacccttaccggttaacggttacccgtttacgggtttaccctttaccttaccggttttcccccgg

SEQ ID NO: 108762 - DNA, 793 bp, Homo sapiens
  misc_feature: GYAE6OF02GNJAB.16.38.D05.1.454.CMB.1.raw
  modified_base (205)..(205): a, c, t, g, unknown or other
  misc_feature (205)..(205): n is a, c, g, or t
tcagtgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtcgtgggggaggcgtggtccagcctggaacggtccctgagactctcggtgtgcngcgtctggattcattctttaaatagtttttcctatcgcactggactccgccaggtcctccgagggccgagggggacgtggtaggtgggtggcgaggtagtgtctacttggagtggagacccgtaatactaactaccgttcgactaacgaccgtccggtaaggtaacggggccgtaacttaccgaacctactttaccgaaggtaagaaggtaaaccttacccaaaacgaaccgtacggactacgtactacgttactacggtaactaaagtccggaaaccctaccccgtacggaaccggtaccgtacggaaaccggaccgtaaccgggtaccgttccggttacttaacgtttaagacggtttagtcgtaacgttactttcgtttacgttcgggtccggttttccgggttcgtttaccggtaaccggttaccggtaccggggtacccggtaacggggttacccgtcccggttacgtcccggtacccggttcccttcccggtaccgtacccgttaccctacccggaaaccccggtaccggtaccccgttaaccggtttaccccggttacccccgtttaccccgtacccccgg

SEQ ID NO: 108763 - DNA, 654 bp, Homo sapiens
  misc_feature: GYAE6OF02FTT6E.16.38.D05.1.454.CMB.1.raw
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (292)..(292): a, c, t, g, unknown or other
  misc_feature (292)..(292): n is a, c, g, or t
  modified_base (432)..(432): a, c, t, g, unknown or other
  misc_feature (432)..(432): n is a, c, g, or t
  modified_base (470)..(470): a, c, t, g, unknown or other
  misc_feature (470)..(470): n is a, c, g, or t
tcagtgtactactccacgaccggtgctcgatttagtatctgatagttgggtttgggggagggaacgtgctcagttaggaccagacggaaccatggaagcccagcgcagcttctcttcctcctgctactctggctcccagaccacgactggagaagtagtgatgacgcagtcgtccagccaccctgtctgtgtctcgagggaacncgaccaccgtntcctgcacgggccagtcagacgtgtgcctaacattagcctggtaccaggcaaaacctggccacggctccgagtaccnctcactctagtagtctcgatccgtaccacggcactgtatcggtcccgaggtccggttactaggtcggacgtacggttggggtacggtacgtataccgttctacggtcctccaactacactacggacctacccgtcgacgnttcgtggtacgttagtttcgacgttaacgtttaacttnttttacggcttacgacgttaattagtttaacttacgtacgttccgtacctacgtttacgttcggtaaccgtaccgggtaactaccgtaacggtcggtaagacttaacgaaacggttaaccggtacgtacggttcaacggttcccgacttaacgttccttaagtcccgtttacaccgtttccccg

SEQ ID NO: 108764 - DNA, 639 bp, Homo sapiens
  misc_feature: GYAE6OF02I7DXO.16.38.D05.1.454.CMB.1.raw
  modified_base (158)..(158): a, c, t, g, unknown or other
  misc_feature (158)..(158): n is a, c, g, or t
  modified_base (211)..(211): a, c, t, g, unknown or other
  misc_feature (211)..(211): n is a, c, g, or t
  modified_base (467)..(467): a, c, t, g, unknown or other
  misc_feature (467)..(467): n is a, c, g, or t
  modified_base (481)..(481): a, c, t, g, unknown or other
  misc_feature (481)..(481): n is a, c, g, or t
  modified_base (507)..(507): a, c, t, g, unknown or other
  misc_feature (507)..(507): n is a, c, g, or t
tcagtgtactactccacgaccggtgctcgatttagtatctgatagttgggtttgggctgggagacgagcccagcactggaagtcgccggtgtttccattcggtgatcagcactgaatacagaggactcaccatggagtttgggctgagcgtggtttcncgttacgtcttttaagaggttgtccaagtgtcaggtgctagttggtggagtgngggggagcggttggccgagccgttacgggaacggtcccgtagacgactcgtcgtgtcgccagtccgtcgtggtattacagttactttaattgttttccatcgcctagtgactccgacacggtctcgagcgagggtctgggagtgggtcgacgtagaggttcgaccgtattggaagtacgggactaccaagttactattaccgtacgcaaacgtccgtacggtaacgggacggtctagtccacgttactacgagtanacgtaactccaaanacctacggactacgctactacggtanacgtaaacgtcgaacctacgagacgacggtacaacgaccgagtccttagtcttacgttatgggtaatcgtaacgttacgttcgtttaacggtcgttaccgggtaaccgtttcttacgggacctttaccgggg

SEQ ID NO: 108765 - DNA, 673 bp, Homo sapiens
  misc_feature: GYAE6OF02IBO9E.16.38.D05.1.454.CMB.1.raw
  modified_base (205)..(205): a, c, t, g, unknown or other
  misc_feature (205)..(205): n is a, c, g, or t
  modified_base (318)..(318): a, c, t, g, unknown or other
  misc_feature (318)..(318): n is a, c, g, or t
  modified_base (364)..(364): a, c, t, g, unknown or other
  misc_feature (364)..(364): n is a, c, g, or t
  modified_base (654)..(654): a, c, t, g, unknown or other
  misc_feature (654)..(654): n is a, c, g, or t
tcagtgtactactccacgaccggtgctcgatttagtatctgatagttggggtttgggggaggaactgctcagttaggacccagacggaaccatggaagccccagcgcagcttctcttcctcctgctactctggctcccagacacgactggagaagtagtgatgacgcagtctccagcccaccctgtctgtgtctccgaggggaancgcccaccctctcctgcgagggccagtcagagttgtgaccaactaatttacgccttggtaccagaaccaaaaaccgtcggccaggcctcccaggcctcctacatctatggtanctatcctaccgagggccctagtgctcggtacccgaggtccggttcnggtcggtacgtagggttggggtttacggacgtacggttacttaccgacttaccgacctaaccgtactacgacgtacccacccgtacgacgtaccgttcgtcggtaagggtttacttttaggaactttaaaattttagttttattacggttactagtactaagttacttaacgtttacgtcggtaccgttaccttacgttaccgttttcggaccgtaacggggtaactacgcgtagtacgtacgaacgtaacgtaacgttggccggtataccaccgtacttcgttaccgtnttaccttacctcttacccg

SEQ ID NO: 108766 - DNA, 874 bp, Homo sapiens
  misc_feature: GYAE6OF02FI8A4.16.38.D05.1.454.CMB.1.raw
  modified_base (225)..(225): a, c, t, g, unknown or other
  misc_feature (225)..(225): n is a, c, g, or t
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
tcagtgtactactccacgaccggtgctcgatttagtatctgatagttgggtttggggcgagagctctggggaggaactgctcagttaggacccagacggaaccatggaagccccagcgcagcgttcctcttcctcctgctactcgtggctacccaggaactgtggctgcaccatctgacttcatccttcccgcagtctgacgtagtagtacacgtgaggccgggntagggcctaaagggccgcaaattgancgtatacgtnatgactgacgacncgacganaactccggattaccgatcaggtagtaaccttacgattcctaggacgtacctagaaggtccaacggtaacttgggaccaggtttaaccggcttaaaccgttacgtaaggaatcccgggtttaaaacacggtttaaccgtacgtacggtaaacgtctaaaccggtaaccgaaggtttaccctaacggtaacccgttacgggtaacgtaacggttaccggtaacgtaacggttaaccgttaacggtaacccgttacgggttaaacccgtttaacgtaaaccgggttacggttaaacgttaccccggttaaacgttaaccgggtaacggtacggtttaaacccgggttacggtaaaccggttttacccgtaaacgggttacccgttaaaccggggtaaccgggtttaacggtaaaccgtttacggggtaaacccgggttttaaccggaacccggttaccgggttttaaaaaccggttaacccgggtttaaaccggtttaaacccggtaacccgggtttaacccggttaaccggtttacccggttaaacgtttaacccgggtacgggttttaccttaaccccggtaggtttaaccccg

SEQ ID NO: 108767 - DNA, 663 bp, Homo sapiens
  misc_feature: GYAE6OF02IN583.16.38.D05.1.454.CMB.1.raw
  modified_base (139)..(139): a, c, t, g, unknown or other
  misc_feature (139)..(139): n is a, c, g, or t
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
  modified_base (310)..(311): a, c, t, g, unknown or other
  misc_feature (310)..(311): n is a, c, g, or t
  modified_base (333)..(333): a, c, t, g, unknown or other
  misc_feature (333)..(333): n is a, c, g, or t
tcagtgtactactccacgaccggtgctcgatttagtatctgatagttgggtttgggggaggaactgctcagttaggacccagacggaaccatggaagccccagcgcagctttctcttcctcctgctactctggctcccngacacgactggagaagtagtgatgacgcagtctcagccaccctgtctgtgtcnccgaggggaaancgacccacctctcctgcaggccagtcagtatgttgccaacattagccttacggaccagactaaaaaccgtcgaccgacggctacccgagtcctctacatctatggnngactcctacgacggaccacgtnatcgtccgacggtcggtcacgtgcgtacggtagggttaggacggacgtcgttacactcgtaccaaccgtaatcgaaccgtccgacccgttagccgtaacggttcgtacggtaaggttacttttacgaactttaaacgttttaatttagttactttacggaaagtacgttaaagttaaccttaaattacgtccgtaccgttaccgttaacttttaccgtttacggaaccgtacgggtaaccgtacgtagtaacggacgtaacgcgtaaaacgtcgttacgtaggtctacggacttaacctacgttccttcgtacgtttactaaccttcccg

SEQ ID NO: 108768 - DNA, 818 bp, Homo sapiens
  misc_feature: GYAE6OF02JB3ES.16.38.D05.1.454.CMB.1.raw
  modified_base (171)..(171): a, c, t, g, unknown or other
  misc_feature (171)..(171): n is a, c, g, or t
  modified_base (188)..(188): a, c, t, g, unknown or other
  misc_feature (188)..(188): n is a, c, g, or t
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtcncacgccacctgtctgtntccgtccgaggggaacnccgcccacctcncccgtgcgacgggcctagtcgagagttcgtcgtaccaaccgtaatttcgcctacgggtaacccacgaaccgtaaaaacccgcggtacccgacggtaccctaccccgtaagggtcccttccccgttaccgaacttaccgttagtaccgggttcgacgttacctaccctaaccggtaccgggcctaacgtcgtacgtccgtacccgacgggttaccgtacgacggtcggtcggtaacggttggggtttaacgggacgttacggtaccttacgtaccttaccgtacctaaccgtactacgttacccgaccgtacccgtacgtacccggtatacggttacgggtacgtttacgttacgtttaacgtttaacgttttatttaaccgttcggttaacgtaccggttaaacttaacggtttaacgttaacggttccgttaaccggttaccgttacccgtttaacggtttaacccgtttaacggggacccggttaaacggactaacgggttacacgggtaactacgtaaccgtaacggttacgtaccggttacgtccgtaacgtaccgtaccgttacttccgttacgtcgttaccgcctttaaccccgg

SEQ ID NO: 108769 - DNA, 611 bp, Homo sapiens
  misc_feature: GYAE6OF02F38U9.16.38.D05.1.454.CMB.1.raw
  modified_base (203)..(203): a, c, t, g, unknown or other
  misc_feature (203)..(203): n is a, c, g, or t
  modified_base (422)..(422): a, c, t, g, unknown or other
  misc_feature (422)..(422): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccgaggggaancgccaccctctcctgcagggccagtcagagtgttgccacctaatttacgcctggtaccagacaaaaccgtgccaggctcccgaggctcctacatcctagtggtgcactctaaccagggccatagactcgtcccgaggtccggttcagtggcagggttggtttagggacagtacttcactcgtacacaatcacgccaccgtagctagtcgtggaaggttnttttgtaccttaattttaacgttattcgtactagtacgtaagttaattaagtttacctcggttaccctaccggttacttacgttttcggacgtaacggggtaacaacggcgttaggagtactaacggtaaactaacggtagtacgggtcttagaccgaccgttactcgttagttaccttctagttcccc

SEQ ID NO: 108770 - DNA, 669 bp, Homo sapiens
  misc_feature: GYAE6OF02I7VU9.16.38.D05.1.454.CMB.1.raw
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
tcagtgtactactccacgaccggtgctcgatttagtatctgatagttgggtttgggggaggaactgctcagttaggacccagacggaaccatgggaagccccagcgcagcttctcttcctcctgctactctggctcccagacacgactggagaagtagtgatgacgcagtctccagccaccctgtctgtgtcctccgaggggaaanccgcccaccctctcctgcngggccagtcagtagtnttcgccacctaatttgcctggtaccagacaaaaacctggccagctaccaggcctctcatctatggtcgcactcaccgacggccactcgatcggtacccgaggtcccggttacgaggtcggacgtagggttgggggtttacgggaccgtaggttaaccgttcctacgttcctacgaccctacgttccgacgtcccgtacccgtagaccgtacggtccgtaggtaacggttatttcgaacgttaaattttacgttagttcgtacgtagtacgttagtaactttacgttacgtcgttccgttaccgtaccgttacgtttcggaccgtaacgggtacctaaggtccgttagtacgtactaaccgaacggtacgttaggtccggtataccggacctaaccgtgttaccttacggtccttacctcgttaccccg

SEQ ID NO: 108771 - DNA, 732 bp, Homo sapiens
  misc_feature: GYAE6OF02I7W0X.16.38.D05.1.454.CMB.1.raw
  modified_base (150)..(150): a, c, t, g, unknown or other
  misc_feature (150)..(150): n is a, c, g, or t
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (344)..(344): a, c, t, g, unknown or other
  misc_feature (344)..(344): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctccagacacgactgganaagtagtgatgacgcaggtctcagccaccctgtctgtgtcctcgaggggaacncggaccctaccctctcctgcgaggccagtcagagttntcgacctactatttacgcctggtaaccagacaaaaccgtgaccgacggacctccacggtcctcctcattctagtcgtcgctagtaccgtaccgacggtcctacncgtacgttccggtacccctacgggttccggttacgagggtcggcgttaacgggggttggggtttaccgggaacgtacgtacccgtttcgtaaccgttctaacctacccgaactccgaaacctcctacccgtcgtaccgtaaccgttacgaggttaccgggttaagttttaccgtaacgttttaacttttagttttaacgttaaccggttacttaggtaacttaaaggttaaactttaacttaccgttacggtcccttacccgtacgtttaccgttacggtacgtacgggtaaccacggtagtcgaagtactaacggaaccgtagttacggtcgtaccgtacgaccgtacccgtagttcccgttcggttaccttacgtacccctttccg

SEQ ID NO: 108772 - DNA, 854 bp, Homo sapiens
  misc_feature: GYAE6OF02HEIPP.16.38.D05.1.454.CMB.1.raw
tcagtgtactactccacgaccggtgctcgatttagtatctgatagttgggtttgggggaggaactgctcagttaggacccagacggaaccatggaagccccagcgcagcttctcttcctcctgctactctggcctcccagacacgactggagaagtagtgatgcgcagtctcagccacctgtctgtcgtctaccgaggggaacgccgcccaccctcctccgtgccgacgggcccagtcaggtagtgttcgaccctacctaatttacgtccgtacggtaccacgtaaccaaaaaccgtcggacccgagggaccctcccgacgggtcccttaccctcgtaccttactaacggttcggggttactaacccgtaccgttaacccgtaacccgggaacggggtaccctaaccggttacggaaccttcgggtaccccgggtcgggtacccgggtttccgtaacgggtcggtccggttaggggttacggggttcgggaactacggtacgtttacgaccgttcctaccgaaccctacgtcctaccgtccctacccgtacgtcggtacggttacgtacgggtacggtttagtttaccgactttttaagtttaaccgtttattacggttaaccaggttaaccttaaggttaaactttaacggttaccgtttccggtaaccccgttacggtttaccgtttacccggtttaccgggttaaccggtaacccggggtaactaacggttacggtacgggtaatacccggtaaccggtaaaccggtcggttacgggtaccgtaccgtttacggaaccttaccgtaccgtttacgttccgtaacccgttttcccgtaaccgtttcccccgg

SEQ ID NO: 108773 - DNA, 855 bp, Homo sapiens
  misc_feature: GYAE6OF02FG4T4.16.38.D05.1.454.CMB.1.raw
  modified_base (160)..(160): a, c, t, g, unknown or other
  misc_feature (160)..(160): n is a, c, g, or t
tcagtgtactactccacgaccggtgctcgatttagtatctgatagttgggtttgggctgggagacgagcccagcactggaagtcgccggtgtttccattcggtgatcagcactgaatacagaggactcaccatggagtttgggctgagctgggttttccncgttactcttttaagagtgtccaatgtcaggtgcagttggtggagtcgtgggggagcgtggtccagcctggacgtcctgagctgtcgtgtgcagcgtcgtggattcgattcgttttaagtacgtttttccaagtcggtacctaacgttcggactcccgggtaccgtaacggtccctaccggaacgggtccgaacggggggtaccgttaggggaacgggtttcgggggttacggacccgggtaagggtacggttacggtaccgtaacgtttcgggaacgttacggggaaccgtaacccgttaaacgttaaccgtaacgtttaaccgttccgggaaccgtaaccggtaacccgtttcccggggttaacgggaaacggggtaccccgtaacgttttacccgaaacccgtttaacgtttacccgaaagggtaaaccggtacgtaaaaccgttaccccgaaaacgaaacccgtcccggttaactacggtaaccttacggtaaccgtacgtaaaccgtaaacgggttacccggaaaccgtaccccggtaacggaaccgttaaccccgttaagggaccccgttaaaccggtcgggtacccttacgggttaccttaacgttcggttacggtacggtaacgtacgtacccttgtttaacgttcgggtcccggtttacggtcttttaccggaccgttaaccgggg

SEQ ID NO: 108774 - DNA, 752 bp, Homo sapiens
  misc_feature: GYAE6OF02JATNM.16.38.D05.1.454.CMB.1.raw
  modified_base (105)..(105): a, c, t, g, unknown or other
  misc_feature (105)..(105): n is a, c, g, or t
  modified_base (270)..(270): a, c, t, g, unknown or other
  misc_feature (270)..(270): n is a, c, g, or t
tcagtgtactactccacgaccggtgctcgatttagtatctgatagttgggtttggggctgggagacgagcccagcactggaagtcgccggtgtttccattcggtnatcagcactgaatacagaggactcaccatggagtttgggctgagcgtgggttttcctcgttactcttttaaggaggtgtccaatgtcaggtgcgagttggtggagtcggtgggggaggtcggtcggtccaggccgtgggacggtccctgagcctcgtcgtgtgcnggtcgtcgtggtattctattacttttaaagtttcgttttcctattcgtctaacgttcgggacttccggacctcgggaccttaccggaagggccggaaggggtacgtgggtagggtcggggtacggccgaggggtagtcgtcgtacgttggatgggaactacgatactatctcgacacgtaccgtccggtaggaaccggtctacgttacccgtaccttacgtaccgaagtaacggaaacgtaccgttaacccaaacgtaaccgaccacgttacaccgtagttacccggtaacaacgtaacgtaccggaaccctaacccggtagaaccctaaccggtacggaaacccgttacgggaaccgttaccggtcgtttaacccgtttcgttacggtacggtttacggtaacggtaaccttttacggttcctttaagggtttccgggttaccggtttaaggggttcccggtttagtaccccggttacggg

SEQ ID NO: 108775 - DNA, 783 bp, Homo sapiens
  misc_feature: GYAE6OF02F5H44.16.38.D05.1.454.CMB.1.raw
  modified_base (206)..(206): a, c, t, g, unknown or other
  misc_feature (206)..(206): n is a, c, g, or t
  modified_base (271)..(271): a, c, t, g, unknown or other
  misc_feature (271)..(271): n is a, c, g, or t
  modified_base (373)..(373): a, c, t, g, unknown or other
  misc_feature (373)..(373): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtcgtctccgaggggaaacncgccctaccctctcctgcacgggccagtcagtaggtgttcaccacctatttacgcctggtaccanacaaaacctcggaccaggcctccacggtctcctcactctatggtcacattccgaccgtacggccacgtgattccgtcccgaggtccccggttagacggtcgnggtacgggttcggggtttacgggaccgtagtacctttcaccttacgtacccgactaccgtacacgacccgtacccgtacggaccgtacgttacggacggttaaagggtttacgttttaacgtaacccggtttaaatttttaaccggtttagtttccggtaaacgtacggttaaccgttaagtttaaacgtttaaaccgttttacggtaccggtttaccccggttaaccggtttaaccgttttaccgggtttttacggggaacccggtaaaccggggggaacccttaaacgggcggtttaggaacggtacgtaaaccggaaaccggttaaccgttagggttacccggtcgttaaccgtaccgtaacctttcggtaccgtttacgtttaccgttacttacccgtttaccccg

SEQ ID NO: 108776 - DNA, 917 bp, Homo sapiens
  misc_feature: GYAE6OF02F33RM.16.38.D05.1.454.CMB.1.raw
  modified_base (114)..(114): a, c, t, g, unknown or other
  misc_feature (114)..(114): n is a, c, g, or t
  modified_base (182)..(182): a, c, t, g, unknown or other
  misc_feature (182)..(182): n is a, c, g, or t
  modified_base (202)..(202): a, c, t, g, unknown or other
  misc_feature (202)..(202): n is a, c, g, or t
  modified_base (368)..(368): a, c, t, g, unknown or other
  misc_feature (368)..(368): n is a, c, g, or t
  modified_base (900)..(900): a, c, t, g, unknown or other
  misc_feature (900)..(900): n is a, c, g, or t
tcagtgtactactccacgaccggtgctcgatttagtatctgatagttgggtttggggggaggaactgctcagttaggacccagacggaaccatggaagccccagcgcagcttcncttcctcctgctactctggctcccagacacgactggagaagtagtgatgacgcagtctccagccaccngtctgtgtctccaggggaanccgccaccctctcctgccacggggccagtcagagtggttcgccaacctaagttttcgacccttcggtaaccctaacggaaccaaaaaacccgttcggggacccaacggggccccgttccccaacgggcccttaccctacgtacttccttaacgtttcggggttacncttaaacttccgttaaacccggaacgggggacccctaaccggtacggtaaacgttcccggttaacccccggtacgggttccccggggttttactaacgggttcggtaccggttaaccgggttcgggggggtttttacgggaaccggtaaggtaccccgttttaacctaaccgttacccgtaacctaaccgtaccttaaccgtaacgggtaccccgtaaccccgttcggtacgacgtttacgttacggggtaaacgtttcgttttacgtaacgttttaaagttttaaccttttaagtttccggtaaccgttaagtaccggttaacgttaaactttaacgtttaacccggtcgtaacccgtttacccgttaacgtttaaccgggttttaccgggtaaccggtaacggggtaacccttaacgggtacgttaacgggtaacgttaaccgacgtaaaaccgggtaacggttaccgggttaccgggtaaccttacggttacctaaccggtacgtttcgttaccggtttaacccggttnttaccccgttaccccgg

SEQ ID NO: 108777 - DNA, 758 bp, Homo sapiens
  misc_feature: GYAE6OF02HVBDU.16.38.D05.1.454.CMB.1.raw
  modified_base (154)..(154): a, c, t, g, unknown or other
  misc_feature (154)..(154): n is a, c, g, or t
  modified_base (198)..(198): a, c, t, g, unknown or other
  misc_feature (198)..(198): n is a, c, g, or t
  modified_base (508)..(508): a, c, t, g, unknown or other
  misc_feature (508)..(508): n is a, c, g, or t
  modified_base (578)..(578): a, c, t, g, unknown or other
  misc_feature (578)..(578): n is a, c, g, or t
tcagtgtactactccacgaccggtgctcgatttagtatctgatagttgggtttgggggaggaactgctcagttaggacccagacgggaaccatggaagccccagcgcagcttctcttcctcctgctactctggctcccagacgacgactggganaggtagtgactgaccgacagtcctcacggcctaccctgtctgtntcgaccgaaggggtaacgccgcccacccttctccgtgccgacgggtccaacgtccgaagtacgtggtaccgacctaaccgttaaagttacgcccggttacggaccagtaacctaaaaccgtcggaccacggtacccgtacccgacggtcctccgtacgtacttacggtatcgggtacacctactccgtaaccgacggcccgtatcgtaacgtcggtaccgtacggtcggtacaggtggccgttaggggttggttacggactacgtaccttacgtactcgtacctaacgtcgtacccaacgtccgtacccngggtacctaggttccgtagtacggtttatttaacggtctttaaaagttacctttagttactaccggttanagttaaacgtcgtttaacggtaccgtttacgggtaccctttacggtacgtttaccggtttaggacccggttaggggtaaaccacggtttacggacgtttaacgacgttaaaccgtacgtaacggttagtacggtcgtacaccgtgtaccttcgtaaccggtttcactcccgttaaacccg

SEQ ID NO: 108778 - DNA, 677 bp, Homo sapiens
  misc_feature: GYAE6OF02FQHRH.16.38.D05.1.454.CMB.1.raw
  modified_base (151)..(151): a, c, t, g, unknown or other
  misc_feature (151)..(151): n is a, c, g, or t
  modified_base (166)..(166): a, c, t, g, unknown or other
  misc_feature (166)..(166): n is a, c, g, or t
  modified_base (191)..(191): a, c, t, g, unknown or other
  misc_feature (191)..(191): n is a, c, g, or t
  modified_base (221)..(221): a, c, t, g, unknown or other
  misc_feature (221)..(221): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactgganaagtagtgatgaccncagtctccgagcctacctgtctgtntctccgaaggggaacccgccacctctccgngcgtacggcctagtcgagtacggttcgtcgacctactaattccgcgtacggtaccacgacctaaacgtcgaccgacggtcctaccgacgtcctaccgtactactacgtacgtcggcgtacacgtaccgtacgaccggacctcgtcgtaccgtcgaccgtcgtacgtacgtgtacgagtacggttggtagcgtactctcgacgtctactacgcgactcgactacgtcgtacgtacgtcgtacgtacgttacgtacgtacttacgttactacgttacgttacgttacgttacgtaacgttacttaacgtaccgtacgtacccgtaccgttacttaccgggttacgtacggtacggtaccgtacggtacggtaacgtaagtaccgttaaccggtacggtaacgtccggtactacgtaccgtagtacctcggttacgtaccctacgttacctaccgtccg

SEQ ID NO: 108779 - DNA, 707 bp, Homo sapiens
  misc_feature: GYAE6OF02F7ZOU.16.38.D05.1.454.CMB.1.raw
  modified_base (203)..(203): a, c, t, g, unknown or other
  misc_feature (203)..(203): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccacctgtctgtgtctccgaggggaacnccgccacccgtctcctggcacgggccagtcagagtgtcgaccactaatttacgcctcggtaaccacgaccaaaaaccgtcggaccacggacctacccgaacggtccctcctacgacttctagtggtcgcatccgtaccgacgggcctaacgtcgaacgttcgtcccgtacgggtccggttacgtacgggtcggtacgtaggggttggggtttacgggactacgtaccttaccgtacttaccgtaccacccgtactacgaaccgtccctacccgtgaccgtacggttcgtacggtacgtttagtttacgtactttaattttacgttagttacgtactagtacgttaagttatttaaacttacggtccgttaaccgttccgttaactttaccggttacggaccggtaacgggtaaccgaaggtcgtaacgagtaactaaccggtaaacgtcgtacggtacgtaccgtacgtacctacgtacttcgttcgtacttcgtaccttcccg

SEQ ID NO: 108780 - DNA, 801 bp, Homo sapiens
  misc_feature: GYAE6OF02FV9A6.16.38.D05.1.454.CMB.1.raw
  modified_base (106)..(106): a, c, t, g, unknown or other
  misc_feature (106)..(106): n is a, c, g, or t
  modified_base (149)..(149): a, c, t, g, unknown or other
  misc_feature (149)..(149): n is a, c, g, or t
  modified_base (278)..(278): a, c, t, g, unknown or other
  misc_feature (278)..(278): n is a, c, g, or t
tcagtgtactactccacgaccggtgctcgatttagtatctgatagttgggtttgggctcaactctcttgtctcaccatggagtttgggctgagcgtgggttttccncgttactcttttaagaggtgtccaatgtcaggtgcaggttggngagtcgtgggggagcgtggtccagcctggaacggtccctgagactcgtcgtgtgcagcgttcgtggattcattacttttaattcgttttccagtcgcacgtggactccgcgagcctcgaggcgaggacnggtagtggtggcgaggagtcgtctacgttggagttcggacgaccctaaatacgtatttaccgtcggcgaacggtaccgttcccgtagggacgggtacccgtattaccgaccgtactttaccgaagtacggtaactaaacgtttacccgaaaccgaactaccggacttacgacctagttaccgttacggaaccgtaaaacgtcgaccctaacccgtggtaacccgaccgtacgtaaccgaaccggaccggttaccttaggttaccgttaagttaccgttagggttacgtaaccgggacgtttacgtttaccgtttaaggttccgggttaccgggtttacgggtttccgtttaacgttaccgggttaccgggtaccgggtaccgaaggggttaccccgttcggttccggttacccgtacccgggttacccttcccggtaccgtacccgttacccgttaacccggaacccggtacccggttaccccgtaccggtttccccggttaccccgttccccggtaccccgg

SEQ ID NO: 108781 - DNA, 623 bp, Homo sapiens
  misc_feature: GYAE6OF02JX5A0.16.38.D05.1.454.CMB.1.raw
  modified_base (196)..(196): a, c, t, g, unknown or other
  misc_feature (196)..(196): n is a, c, g, or t
  modified_base (238)..(238): a, c, t, g, unknown or other
  misc_feature (238)..(238): n is a, c, g, or t
  modified_base (345)..(345): a, c, t, g, unknown or other
  misc_feature (345)..(345): n is a, c, g, or t
  modified_base (615)..(615): a, c, t, g, unknown or other
  misc_feature (615)..(615): n is a, c, g, or t
tcagtgtactactccacgaccggtgctcgatttagtatctgatagttgggtttgggggaggaactgctcagttaggacccagacggaaccatggaagccccagcgcagcttctcttcctcctgctactcgtggctacccagacacgacttggagaagtgtgatgacgctagtcctacagccacctgtctgtacttnaccaggggaaccgcctcctctcaggcgtacggcagtcaggtnttcgtcacctaacaagttcaccgttcggaccacgtaccaaacgtcgcgacggcctccgacgtctactctactcgtacgtcgtactactactacgtacgacgactacncgtacgtcgtacgtcggtacgtacgcgtcggcgttaggtcggtcgtacgagtacgtcgtacctcgcgacactcacgtactccgtgtacgtacgtactaacggtacgttacgttacgttacttacgtttaatacgtacgtacgttacgtactaacgttaattacgtacgttcggtcttaccgtacgtttcgttacggacggtacgttacgacgtcgtaagagtacgtaacacgtaacgtggtactcgtcgaactcgtcgtctcgtcttacncgttaccg

SEQ ID NO: 108782 - DNA, 786 bp, Homo sapiens
  misc_feature: GYAE6OF02HS8PG.16.38.D05.1.454.CMB.1.raw
tcagtgtactactccacgaccggtgctcgatttagtatctgatagttgggtttggggctgggagacgagcccagcactggaagtcgccggtgtttccattcggtgatcagcactgaatacagaggactcaccatggagtttgggctgagctgggttttcctcgttactcttttaagaggtgtccaatgtcaggtgcaggttggtggagtcgtgggggagcgtggtccagtccgtaggaacggtccctgacgacttcgtcgtgtgacacggtcgtctggtactttcgtaattccttttaaagttacgtttttccctagttcgactacgtgggaccttcccgcccgtaggccttccggagggaccggaggggtacctaggggtacgggttcggggtcggacgtaggggtacgttcggtcctaggtttcgagtacggacgtaacctaaatacgtacttacgtcgaacgtagtacccgttcggaggaaccgggtccgtaattcccgtaacgttacgtttaccgaaggtacgtaaacgtaacctaacccgaaaccgtaaaccgtaccggtcgtaccgtaacttaccgtaacgttcgaaaccgttaaacgtcccggaaacccgtacccgtacgaaccgtaaccgtacggaacccggaaccggtaccgttaccgttacgtttaccgttactttaccggttggttaacgtacggtaacgtttacccgtacgttttacggttacccggttcgggttttaccgggtttactttaccgggtaccgtttaaccggggg

SEQ ID NO: 108783 - DNA, 697 bp, Homo sapiens
  misc_feature: GYAE6OF02H81BG.16.38.D05.1.454.CMB.1.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
tcagtgtactactccacgaccggtgctcgatttagtatctgatagttgggtttgggctgggagacgagccccagcactggaagtcgccggtgtttccattcggtgatcagcactgaatacagaggactcaccatggagtttgggctgagctgggttttcctcgttactctttaagaggtgtaccaatgtcaggtgcagttggnggagtcgtgggggagcgtggtccagccgtaggaacggtccctaggaggactcgtcgtggngcaggcgtacgtggacttacgattacttttaattacgtttttaccagttcgctacgttcggacttccgcccgtaggcctccggaagggtacgacggggacgttgggaggttcggggtaggacgaagggtgtacgtacgtaccgtagacggtacggacgactaaacgtactaagtaaccttcggactaacggtcctacggtagaaccggggtctaccgttcaacccgttacgtttcgaaggtaacgtaacgtaacgttaccaaacaacgtaccgaccgtcgaactattacgagaacgtaacgtcgaacctaccgtacggacgtacccgtagaaccgaccgaacgtcttacgtaccttacgtcgtgttaggacgtaccgttacgttacgttacgttcggtaccggtttcggtttaacttaccggtacgttaccggg

SEQ ID NO: 108784 - DNA, 588 bp, Homo sapiens
  misc_feature: GYAE6OF01DWU94.41.84.H07.1.454.CMB.1.raw
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
tcagtctatactatcacgaccggtgctcgatttagcagacgtctgtcgcgggggggattcccagctgtttctgcttgctgatcaggactgcacacagagaactcaccatggagtttgggctgagctgggttttccttgttgcttattttaaaaggtgtccagtgtgaggtgcaggtgatggaagtttgggggacgccgtaggttcgggccggggggcccctaagactctcctgtctcgtctctgaaccctacctttagcagctactggatgcacgtgggccacaagctaccgaggaaagggcctagagtggtgggtctcgtacgtaattaaaccgaccgagtgggactatctactggttacacgagacgccgtaggaacggcctattcatcatcncaganacaatgtacgaaacacggtataattaactaatagaactagtactaagagtacgaggacacgctgtactatattgtgtagtagtacttactgttactttcgagttggggtattagttccggttacggacccgtacgacggtacgggaccgtacgggtaaccgttcggtcgtcgtcctcctcgagtcccg

SEQ ID NO: 108785 - DNA, 862 bp, Homo sapiens
  misc_feature: GYAE6OF01CJX95.41.84.H07.1.454.CMB.1.raw
tcagtctatactatcacgaccggtgctcgatttagcagacgtctgtcgcggggggattcccagctgtttctgcttgctgatcaggactgcacacagagaactcaccatggagttggctgagtcttgggttttccttgttgtacttaagttttaaaaggtcgtaccgtagtgtagagggtgcgtaggtgagtaggtaaggtttcgggggaccgtccgttacgggttccggggcccggggggtaccccctaaggacctccgttccgtgtcctccggtctacgtacgtaacccctacgtttagctagtccgtacgtggatcgccgtacggttcgggtccctaccgaagtccgtaccgaaggggtaacggtccgttaggaacgttcgggttcgggtaccttaccgaacgtttaactaaacccgaccggtaagtacgggtaactcgtacgtacgtacgtttaaccacgtacggaccggtccggtaggtaaccgggaccttacgtcgtaactacgtacttcgaccgtaagaacgtacgtaaagacggttaaaccgaaaccgttaccgggttaacgtttaaaacgtttaagaaacgttaaccgtaaacgtaacgtttaacggaaacgtacggttacgggaacgtaaccgtaccgggtactttacggtaaccttaaggtttagtttggtacgtaccgttaacggtaacctttaggttagttaacgtttacggtacggttaggggttaactttccgttacgggttacccggaccgtaaccggtagggtacccggggtacccggttaacgggttaacccgtttcgggttcccttacggttccgtccccgttacggtacccgttaacccccgg

SEQ ID NO: 108786 - DNA, 167 bp, Homo sapiens
  misc_feature: GYAE6OF01DQ897.12.26.C04.1.454.CMB.1.raw
  modified_base (167)..(167): a, c, t, g, unknown or other
  misc_feature (167)..(167): n is a, c, g, or t
tcagatacgacgtacacgaccggtgctcgatttagtctagcgactttggttgggaagaggaagactgacggtcccaggagttcaggtgctgggcacagcggccctgggctgcctggtcaaggactacttcctacgtcgtatctgagcgggctggcaaggcgcatagn

SEQ ID NO: 108787 - DNA, 170 bp, Homo sapiens
  misc_feature: GYAE6OF01EA2II.12.26.C04.1.454.CMB.1.raw
  modified_base (169)..(170): a, c, t, g, unknown or other
  misc_feature (169)..(170): n is a, c, g, or t
tcagatacgacgtacacgaccggtgctcgatttagtctagcgactttgggttgggaagaggaagactgacggtccccaggagttcaggtgctgggcacagcggccctgggctgcctggtcaaggactacttcctacgtcgtatctgagcgggctggcaaggcgcatagnn

SEQ ID NO: 108788 - DNA, 171 bp, Homo sapiens
  misc_feature: GYAE6OF01DUJ3H.12.26.C04.1.454.CMB.1.raw
  modified_base (170)..(171): a, c, t, g, unknown or other
  misc_feature (170)..(171): n is a, c, g, or t
tcagatacgacgtacacgaccggtgctcgatttagtctagcgactttgggtttggggaagaggaagactgacggtccccaggagttcaggtgctgggcacagcggccctgggctgcctggtcaaggactacttcctacgtcgtatctgagcggctggcaaggcgcatagnn

SEQ ID NO: 108789 - DNA, 172 bp, Homo sapiens
  misc_feature: GYAE6OF01EFBJT.12.26.C04.1.454.CMB.1.raw
  modified_base (171)..(172): a, c, t, g, unknown or other
  misc_feature (171)..(172): n is a, c, g, or t
tcagatacgacgtacacgaccggtgctcgatttagtctagcgactttgggtttggggaagaggaagactgacggtccccaggagttcaggtgctgggcacagcggccctgggctgcctggtcaaggactacttcctacgtcgtatctgagcgggctggcaaggcgcatagnn

SEQ ID NO: 108790 - DNA, 175 bp, Homo sapiens
  misc_feature: GYAE6OF01CRJ01.12.26.C04.1.454.CMB.1.raw
  modified_base (173)..(175): a, c, t, g, unknown or other
  misc_feature (173)..(175): n is a, c, g, or t
tcagatacgacgtacacgaccggtgctcgatttagtctagcgactttgggtttgggggaagaggaagactgacggtcccccaggagttcaggtgctgggcacagcggccctgggctgcctggtcaaggactacttcctacgtcgtatctgagcgggctggcaaggcgcatagnnn

SEQ ID NO: 108791 - DNA, 497 bp, Homo sapiens
  misc_feature: GYAE6OF01B9Y9B.12.26.C04.1.454.CMB.1.raw
  modified_base (401)..(401): a, c, t, g, unknown or other
  misc_feature (401)..(401): n is a, c, g, or t
  modified_base (494)..(494): a, c, t, g, unknown or other
  misc_feature (494)..(494): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggaaatcgtgatgacccagtctccagactccctggctgtgtctctgggcgagagggccaccatcaactgcaagtccagccagagtgttttatcaactccaacaatgagaactacttagcttggtaccagcagaaaccaggacagccgccaagttgctcatttactggcatctaccgggaatccgggtcctgaccgattcagtggcagcggtctgagacagattcactctcacatcagcagcctgcaggccgaagntgtgctagtttattttgtcagctaatattatacatactcgtctcacgtttcggcggaggaccaaggtggagatcaaacgactgtgctgcacgntcg

SEQ ID NO: 108792 - DNA, 172 bp, Homo sapiens
  misc_feature: GYAE6OF01DJA4U.12.26.C04.1.454.CMB.1.raw
tcagatacgacgtacacgaccggtgctcgatttagtctagcgactttgggtttgggggaagaggaagactgacggtcccccaggagttcaggtgctgggcacagcggccctgggctgcctggtcaaggactacttcctacgtcgtatctgagcgggctggcaaggcgcatag

SEQ ID NO: 108793 - DNA, 173 bp, Homo sapiens
  misc_feature: GYAE6OF01D9Z5W.12.26.C04.1.454.CMB.1.raw
  modified_base (173)..(173): a, c, t, g, unknown or other
  misc_feature (173)..(173): n is a, c, g, or t
tcagatacgacgtacacgaccggtgctcgatttagtctagcgactttgggtttgggggaagaggaagactgacggtcccccaggagttcaggtgctgggcacagcggccctgggctgcctggtcaaggactacttcctacgtcgtatctgagcgggctggcaaggcgcatagn

SEQ ID NO: 108794 - DNA, 511 bp, Homo sapiens
  misc_feature: GYAE6OF01BM3WL.12.26.C04.1.454.CMB.1.raw
  modified_base (309)..(309): a, c, t, g, unknown or other
  misc_feature (309)..(309): n is a, c, g, or t
tcagatacgacgtacacgaccggtgctcgatttagtctagcgactttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatcaactccaacaatgagaactacttagcttggtaccagcagaaaccaggacagccgccaagttgctcatttacnggcatctaccggatccgggcctgaccgatcagtgcagcggtctgagacagatttcactctcaccatcagcagcctgcaggccaagatgtggctagtttattttgcagtcaatattatcatactccgctctactttcggcgtaagggaccaagggtggaagtacgtacgaaaacgaacgtcggtaggactacgcctacgtacg

SEQ ID NO: 108795 - DNA, 508 bp, Homo sapiens
  misc_feature: GYAE6OF01C2EXT.12.26.C04.1.454.CMB.1.raw
  modified_base (503)..(503): a, c, t, g, unknown or other
  misc_feature (503)..(503): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggaaatcgtgatgacccagtctccagactccctggctgtgtctctgggcgagagggccaccatcaactgcaagtccagccagagtgttttatcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggctagttttattttgtcagtcaatattatctatactccgctcactttcggacgagggaccaaggtgagatacaaacgactgtcggctgcncatcg

SEQ ID NO: 108796 - DNA, 174 bp, Homo sapiens
  misc_feature: GYAE6OF01CMOR2.12.26.C04.1.454.CMB.1.raw
  modified_base (173)..(174): a, c, t, g, unknown or other
  misc_feature (173)..(174): n is a, c, g, or t
tcagatacgacgtacacgaccggtgctcgatttagtctagcgactttgggtttgggggaagaggaagactgacggtcccccaggagttcaggtgctgggcacagcggccctgggctgcctggtcaaggactacttcctacgtcgtatctgagcgggctggcaaggcgcatagnn

SEQ ID NO: 108797 - DNA, 184 bp, Homo sapiens
  misc_feature: GYAE6OF01ER3P2.12.26.C04.1.454.CMB.1.raw
  modified_base (180)..(184): a, c, t, g, unknown or other
  misc_feature (180)..(184): n is a, c, g, or t
tcagatacgacgtacacgaccggtgctcgatttagtctagcgactttgggtttgggggaagaggaagactgacggtcccccaggagttcaggtgctgggcacagcggccctgggctgcctggtcaaggactacttcctacgtcgtactctgaggcggcgtggacgaaggcgacaagtagnnnnn

SEQ ID NO: 108798 - DNA, 506 bp, Homo sapiens
  misc_feature: GYAE6OF01BA03P.12.26.C04.1.454.CMB.1.raw
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggctagtttattttgcagcaatattatcatactccgctcactttcggcgagggaccgaaggtggagatacaaacgactgtggactgcacctag

SEQ ID NO: 108799 - DNA, 500 bp, Homo sapiens
  misc_feature: GYAE6OF01EVYFH.12.26.C04.1.454.CMB.1.raw
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (471)..(471): a, c, t, g, unknown or other
  misc_feature (471)..(471): n is a, c, g, or t
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
tcagatacgacgtacacgaccggtgctcgatttagtctagcgactttgggtttggggagctacaacgaggcagcagggcagcaagatggtgttgccagacccaggtccttcatttctctgttgctctggatctcctggtgcctacgggacatcgtgatgacccagtctccagactcctggctgtgtctctgggcgagaggccaccatcaactgcaagtccagccagagtgttttatcaactccaacaatgagaactactagctggtaccagtcagaaaccaggacagccgccaagttgcctcatttactggcatctaccgggaatccgggtcctgacgattcagtgctagtcggtctgagacagatttcactctcaccatcagcagcctagcagccaagatgngctagtttatttgntanctaatgttatctatactccgtctcactttcggcgacggtaccgaggtgagntacgaaacgacgtgtacgntcgcnccgta

SEQ ID NO: 108800 - DNA, 175 bp, Homo sapiens; identical to SEQ ID NO: 108790
  misc_feature: GYAE6OF01BRQ7S.12.26.C04.1.454.CMB.1.raw
  modified_base (173)..(175): a, c, t, g, unknown or other
  misc_feature (173)..(175): n is a, c, g, or t

SEQ ID NO: 108801 - DNA, 173 bp, Homo sapiens; identical to SEQ ID NO: 108793
  misc_feature: GYAE6OF01EMBUN.12.26.C04.1.454.CMB.1.raw
  modified_base (173)..(173): a, c, t, g, unknown or other
  misc_feature (173)..(173): n is a, c, g, or t

SEQ ID NO: 108802 - DNA, 505 bp, Homo sapiens
  misc_feature: GYAE6OF01CFS8S.12.26.C04.1.454.CMB.1.raw
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatcaactccaacaatgagaactacttagcttggtaccagcagaaaccaggacagccgccaagttgctcattactggcatctacccgggaatccggggtccctgaccgattcagtggcagcggtctgagacagatttcactctcaccatcagcagctgcaggccgaagatgtgctagtttattttgcagctaatatatacatactccgtctctactttcggacggtacggacgtaaggtggagtagtacaaagactgtagatgcactacg

SEQ ID NO: 108803 - DNA, 174 bp, Homo sapiens; identical to SEQ ID NO: 108796
  misc_feature: GYAE6OF01CF3IS.12.26.C04.1.454.CMB.1.raw
  modified_base (173)..(174): a, c, t, g, unknown or other
  misc_feature (173)..(174): n is a, c, g, or t

SEQ ID NO: 108804 - DNA, 174 bp, Homo sapiens; identical to SEQ ID NO: 108796
  misc_feature: GYAE6OF01DCIT3.12.26.C04.1.454.CMB.1.raw
  modified_base (173)..(174): a, c, t, g, unknown or other
  misc_feature (173)..(174): n is a, c, g, or t

SEQ ID NO: 108805 - DNA, 172 bp, Homo sapiens
  misc_feature: GYAE6OF01DIFR3.12.26.C04.1.454.CMB.1.raw
  modified_base (172)..(172): a, c, t, g, unknown or other
  misc_feature (172)..(172): n is a, c, g, or t
tcagatacgacgtacacgaccggtgctcgatttagtctagcgactttgggtttgggggaagaggaagactgacggtcccccaggagttcaggtgctgggcacagcggccctgggctgcctggtcaaggactacttcctacgtcgtatctgagcggctggcaaggcgcatagn

SEQ ID NO: 108806 - DNA, 171 bp, Homo sapiens
  misc_feature: GYAE6OF01A5XUA.12.26.C04.1.454.CMB.1.raw
  modified_base (171)..(171): a, c, t, g, unknown or other
  misc_feature (171)..(171): n is a, c, g, or t
tcagatacgacgtacacgaccggtgctcgatttagtctagcgactttgggtttggggaagaggaagactgacggtccccaggagttcaggtgctgggcacagcggccctgggctgcctggtcaaggactacttcctacgtcgtatctgagcgggctggcaaggcgcatagn

SEQ ID NO: 108807 - DNA, 522 bp, Homo sapiens
  misc_feature: GYAE6OF01E024N.12.26.C04.1.454.CMB.1.raw
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggctaggttttattttgctagctaattattatcattactccgcttctacgtttcggcggtaagggacccgaaggtggagatacgaaaacgacgtggtaggctgccactacg

SEQ ID NO: 108808 - DNA, 544 bp, Homo sapiens
  misc_feature: GYAE6OF01BFCEE.12.26.C04.1.454.CMB.1.raw
  modified_base (312)..(312): a, c, t, g, unknown or other
  misc_feature (312)..(312): n is a, c, g, or t
  modified_base (367)..(367): a, c, t, g, unknown or other
  misc_feature (367)..(367): n is a, c, g, or t
  modified_base (380)..(380): a, c, t, g, unknown or other
  misc_feature (380)..(380): n is a, c, g, or t
  modified_base (401)..(401): a, c, t, g, unknown or other
  misc_feature (401)..(401): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatcaactccaaacatgagaactacttagcttggtaccagcaagaaaccaggacagccgccaagttgctcatttacnggcatctacccgggatccgggtcctgaccgattcagtgcagcggtctgagacagnttcactctcaccntcagcagcctgcagccgaagntgtgctagttttatttgcagctaattattatcattactccgtcttaccgtacgtttcggaccggtaagggtacccgtaaagggttcggaagtacgtaaccgtaaaacggtacgttggtacggaccttcggacctaccgtaacg

SEQ ID NO: 108809 - DNA, 599 bp, Homo sapiens
  misc_feature: GYAE6OF01BNGD5.12.26.C04.1.454.CMB.1.raw
  modified_base (432)..(432): a, c, t, g, unknown or other
  misc_feature (432)..(432): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccagagttgtttattcaactccaaacatgagaactactagcttggtaccagcaagaaaccaggacacgccgaccaagttgctctatttactgggctacgtcgtacccgggaatcccggggtcctggaccgtagttcagtcggcaggcgggtctgacgactagtatttcactctacaccatcagcacgtctcgacgaggaccgaagtntggtgtacttagttttattttgacctagtactaaagttattacgtactacttaccgtaccgtccttacgtacgttttccgggacgggtaacgggaacccgttaaggggtaggaacgtacgtaccgtaaaacgacgttacggtacggacgttacggacctaccgtacg

SEQ ID NO: 108810 - DNA, 175 bp, Homo sapiens
  misc_feature: GYAE6OF01CDJ83.12.26.C04.1.454.CMB.1.raw
  modified_base (174)..(175): a, c, t, g, unknown or other
  misc_feature (174)..(175): n is a, c, g, or t
tcagatacgacgtacacgaccggtgctcgatttagtctagcgactttgggtttggggggaagaggaagactgacggtcccccaggagttcaggtgctgggcacagcggccctgggctgcctggtcaaggactacttcctacgtcgtatctgagcgggctggcaaggcgcatagnn

SEQ ID NO: 108811 - DNA, 525 bp, Homo sapiens
  misc_feature: GYAE6OF01C2IGG.12.26.C04.1.454.CMB.1.raw
tcagatacgacgtacacgaccggtgctcgatttagtctagcgactttgggtttggggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatcaactccaacaatgagaactacttagcttggtaccagcagaaaccaggacagccgcccaaagttcgctcatttactgggcatcgtacccgggaatccggggtccctgaccgattcagtggcagcgggtctgagacagatttcactctcaacctatcagcagcctgcaggccgaagatggtgctagttttattttgcagactaattattatcattactccgctctacgtttcgggcggagggacctaagggtggagatacgaaagactcggtacgctgccgtctacg

SEQ ID NO: 108812 - DNA, 574 bp, Homo sapiens
  misc_feature: GYAE6OF01C4PDS.12.26.C04.1.454.CMB.1.raw
  modified_base (232)..(232): a, c, t, g, unknown or other
  misc_feature (232)..(232): n is a, c, g, or t
  modified_base (434)..(434): a, c, t, g, unknown or other
  misc_feature (434)..(434): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtnttttatcaactcaacaatgagaactactagcttggtaccagcagaaacaggacagccgccaagtgctcatttactggcatccgtaacccgggaatcccggggtccctgacccgtattaccgaggtcggcaggcgggttctagagactagtactttcactctcaccatcagcacgcctgcaggccgaagatgtgctagttttnttttgctagtactaattaatttactctaacttaccgtcccgtactccgttaccgtttcgggacgggtacggaccgtaaggggtggaacgtacgtaccgtaaaacggtacgttcggtacggtcttacggcctaaccgtacg

SEQ ID NO: 108813 - DNA, 174 bp, Homo sapiens; identical to SEQ ID NO: 108796
  misc_feature: GYAE6OF01CGMXB.12.26.C04.1.454.CMB.1.raw
  modified_base (173)..(174): a, c, t, g, unknown or other
  misc_feature (173)..(174): n is a, c, g, or t

SEQ ID NO: 108814 - DNA, 703 bp, Homo sapiens
  misc_feature: GYAE6OF01EXPPI.12.26.C04.1.454.CMB.1.raw
  modified_base (352)..(352): a, c, t, g, unknown or other
  misc_feature (352)..(352): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggacgggccacatcaactgacaagtccagccagtagttgttttataccaactaccaaacaagtgaacgtaacttaacttagtccgttaggtaaccagacaagaaaccgaggacacggccccgaccgtaagttcgaccttactagtttacgngggactacgtacccggtaacccgggtaacgttccccggggtaccctagaccgtattacgaggtcggacgtacggccgggtctaggaagtaccgtagttactttccgaacctcgtaccaccgtatccgacgcctaacgtcccgagaccgacgggtaccgaagtgttacggtcgtacgtttagttttttacgtttgacctaaggtacttaaagttctttaacctacctaagtttacccctccgttataacccggttacggtttaccggggaaccgggaacgggttaaccggtaaggggttacgaacgtaactaaaccggtaaacgacgttggtacgacttcggacctacgtag

SEQ ID NO: 108815 - DNA, 504 bp, Homo sapiens
  misc_feature: GYAE6OF01AQVHI.12.26.C04.1.454.CMB.1.raw
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatcaactccaacaatgagaactacttagcttggtaccagcagaaaccaggacagccgcccaagttgctcatttactgggcatctacccgggaatccggggtcctgaccgattcagtggcagcggtctgagacagattcactctcaccatcagcagcctgcaggccgaagatgtgctagtttattttgcagctaatattatcactctccgctctacttcggcggaggaccgaggtgagatacgaaacgacgtggtacgntcgcnctacg

SEQ ID NO: 108816 - DNA, 697 bp, Homo sapiens
  misc_feature: GYAE6OF01D08CI.12.26.C04.1.454.CMB.1.raw
  modified_base (534)..(534): a, c, t, g, unknown or other
  misc_feature (534)..(534): n is a, c, g, or t
  modified_base (559)..(559): a, c, t, g, unknown or other
  misc_feature (559)..(559): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgccgtacggggaatcgtgatcgacccagtctcagctcctggctgtgtctcgtgggcgaggacggccacatacaacgtgaccaacgtccaagccagtagtttgttttactacaaccttaccaataatagaacgtaaccttacgttacgtacgttacggtaaccacgtacaaacgaaccgaaggaccaccggtaccccgaccgtaagttcgtacctacgttacgtttacgacgggacctaccgttacccggtaacccggggtaaccgttccccgggggttaccctacgggtaacccgttacgttaccggtaggtcgggtacgacgggtcgtacgtaggacgaagtacgttacttccaccttcaccgtactacgcgtacactcgccgtgacgccggtanaagtctaggtgtactttaggttttntttcggatacgtattaacgttatacgtctaacctttccgccgtcttaccggtcgggttaccggagggtacgacggtagggtccgaaagttaccaacgtaaccggacgtgggtccacgtaccggctaacctgtttcccg

SEQ ID NO: 108817 - DNA, 964 bp, Homo sapiens
  misc_feature: GYAE6OF01BZE64.12.26.C04.1.454.CMB.1.raw
  modified_base (328)..(328): a, c, t, g, unknown or other
  misc_feature (328)..(328): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctcagactccctggctgtgtctcgtgggcgagacgggccaccatcaactgcaagtccagccagagttgttttatcaactcaacaatgaagaactacttagcttagtaccagacaacgaaaccaggacacgacccgacctaagttcgcctactattttaccgngggactacgttaccgtaacccgggaacgttcccggggtccctaggacccgtattaccgaggttcggacgtacgggtccgggttcgtaggacgaccgtaaggttacttttacccgaacctttaccgtaccctaacccgtacttacccgaacgtccgtaaccggtaccccgttacgggaccggtaaccggggaaccccgtaaagggtacggttaccggggttacgggttaccgtttttaaacgggtttttttttaacggttttttacccggtaaccgtttaaacggttaacctttaaaaacgtttttaaccgtttttaaaccggttaaacccttaacccgttttaaaccccggtttacccccgggttaacccccgttttaacccgggtttaaccccggggtttttttaaccccggggggggaaacccgggggtttaaaaaccccgggggggttaaaccccggggtttaaaaacggggggggtttaaccgggggttaaaacccggggttaaaacccggtttaaaaaccccggtaaaaaaacccgggggtttaaaccccggtttaaccgggggtttacccgggggtaaaccccgttttaacccggggaaacccccgtttaaacccccggttttaacccgg

SEQ ID NO: 108818 - DNA, 578 bp, Homo sapiens
  misc_feature: GYAE6OF01ABWZS.12.26.C04.1.454.CMB.1.raw
  modified_base (263)..(263): a, c, t, g, unknown or other
  misc_feature (263)..(263): n is a, c, g, or t
  modified_base (314)..(314): a, c, t, g, unknown or other
  misc_feature (314)..(314): n is a, c, g, or t
  modified_base (415)..(415): a, c, t, g, unknown or other
  misc_feature (415)..(415): n is a, c, g, or t
  modified_base (572)..(572): a, c, t, g, unknown or other
  misc_feature (572)..(572): n is a, c, g, or t
tcagatacgacgtacacgaccggtgctcgatttagtctagcgactttgggtttggggaggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagcagagtgttttactcaactccaaacatgagaactacttancttggtaccagcagaaaccaggacaacgccgcccaagttgctcattttacngggcatctacccgggaatccggggtaccctgaccgattcagtgcagcgggtctgagaccagatttcgatctacacgatcagcagcctgcgtaggccgaagntaggtcgcttaacgttttatttttcggaccttaggacctaattatttactacgtaattacgttcccgtctaccgtacgttttccgggacggtaaccgggaaccgtaacgggttacggacggtctaccgaaacgtaaccgtggttacggctcggtacncttacg

SEQ ID NO: 108819 - DNA, 708 bp, Homo sapiens
  misc_feature: GYAE6OF01DLXHY.12.26.C04.1.454.CMB.1.raw
  modified_base (181)..(181): a, c, t, g, unknown or other
  misc_feature (181)..(181): n is a, c, g, or t
  modified_base (184)..(184): a, c, t, g, unknown or other
  misc_feature (184)..(184): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccccgngtntgtcgtctggtcggacgaggcgaccactctactacgcacgtaccgacgacgacgagtagttttactttactaactaccaaccaatagacgtaactaacttacgtacttcgttaccgtacgacaacgaaaccgaacggacgacgaccgacccgaacgttagtcgtactacttacgttcggcgtactacgtacccggtaacggtccggtcccggtacgaccgtacttcgtagtcggcacggtcggtcgtacgagacgagtacgtttacactcctacctaccgaatacgtacgacgacgacgtcgaccgtaacgggacgtaacgtagtcggttacggttacgtagttttttaacgtttttggtacaagtaactaaagttaattttaacgtacctacgttacctccccgtagtttacctaaccgggtttccgggtaacggggacgggtaaacccgtaaggggtacgtaaagtccgtaaaacgtaaacgtaacggttacggtcggtacgtacaaccgtccttaccgtgg

SEQ ID NO: 108820 - DNA, 651 bp, Homo sapiens
  misc_feature: GYAE6OF01DVG3G.12.26.C04.1.454.CMB.1.raw
  modified_base (503)..(503): a, c, t, g, unknown or other
  misc_feature (503)..(503): n is a, c, g, or t
  modified_base (641)..(641): a, c, t, g, unknown or other
  misc_feature (641)..(641): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaccatacaactgacaacgtccagccagtagttgtttatacactccaacaagtgaagtaactacttagtacttcgtaccagacaacgaaaccaggaccacgcccgaccgtaagttcgactacgtactttacgtggactagtccgtaacccgggtaacgtcccggggtccctagtaccgtagttcgacggtacggccgtacgggtcggtcacggacgtacgtacgtatttaccgaccttcctacctaccatccgagccgacgtccctggaaccacgggaccgagtagttgttacggnttttagggtttttactttcgacgtagtctaattactactcttacttacctccgtattcccgtacggtttcgggacgggtaagtaccgtaaggggtcgaacgtacgtaaaccgtaaacggtgtcgggtagtacccgtcncccgtatacg

SEQ ID NO: 108821 - DNA, 177 bp, Homo sapiens
  misc_feature: GYAE6OF01DTAC8.12.26.C04.1.454.CMB.1.raw
  modified_base (175)..(177): a, c, t, g, unknown or other
  misc_feature (175)..(177): n is a, c, g, or t
tcagatacgacgtacacgaccggtgctcgatttagtctagcgactttgggtttggggggaagaggaagactgacggtccccccaggagttcaggtgctgggcacagcggccctgggctgcctggtcaaggactacttcctacgtcgtatctgagcgggctggcaaggcgcatagnnn

SEQ ID NO: 108822 - DNA, 634 bp, Homo sapiens
  misc_feature: GYAE6OF01ARJ6P.12.26.C04.1.454.CMB.1.raw
  modified_base (356)..(356): a, c, t, g, unknown or other
  misc_feature (356)..(356): n is a, c, g, or t
  modified_base (623)..(623): a, c, t, g, unknown or other
  misc_feature (623)..(623): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccacatcaactgcaagtccagccagagttgttttactcaactaccaacaatgaagaactacttagcttaggtaccagacaagaaaccaggacacgcccgaccaagttcgctctatttacgtggcacgtaccgtaccgggactccggggtcccngaccgtatcgagtggcagcgggtctggagacagtattcactctaccactactcacgcgacgtcctcggacacgggaccgaaggtaccgtggtcgggtacgtttagtttttacgtttttcgacgttaagtaaccttaaatttacgtttaacttactaaccgtttaccttacccgtacttccgtaaccgtttccggggaacgggtaacggaaccggtaagggtggaacggtaacgtaaaccggtaaacacggtttaggcgtactaccgngtaaccctacg

SEQ ID NO: 108823 - DNA, 827 bp, Homo sapiens
  misc_feature: GYAE6OF01ALG6G.12.26.C04.1.454.CMB.1.raw
  modified_base (664)..(664): a, c, t, g, unknown or other
  misc_feature (664)..(664): n is a, c, g, or t
  modified_base (690)..(690): a, c, t, g, unknown or other
  misc_feature (690)..(690): n is a, c, g, or t
  modified_base (803)..(803): a, c, t, g, unknown or other
  misc_feature (803)..(803): n is a, c, g, or t
tcagatacgacgtacacgaccggtgctcgatttagtctagcgactttgggtttgggggagctacaacaggcaggcaggggcagcaagatggtgttgcagacccaggtcttctatttctctgttgctcgtggatctctggtcgccgtacgggacatcgtgatcgacccagtcctccagtacctcccgtggctgtcgtctcgtgggacgaggacggacccaccgtataccaacgtcgaccgtaacgtccgacgaccgtagtagttttcgttttaactacctaacctaccaaactaagtagaactaaccttacgttacggtcgtttacggaaccacggtaaccaaacgaaaccggaggaaccaccggaccccgtaacccgttaaggttccgtaccttaccgtaacgttttaccggtcggtaacctacccgttacccgggttaaaccccggggtaacccggttcccccggggttaccccgtaacggttacccggtaacgtttaccggcggttacgggacgtacggggtaccggttacgtaggaacgtaccgtaggtttacctttccgtacccttacgtcccaagtacctaccgtacgccgtacccgtacgtaccgggacccgaaacgggtacaggtttacggtcgttaggttacgttttttagttttnttacgaacggtacctaatttaacttntttaaccctacgtaacccgtccgttacccttcgttaccggttacccgggtcgggaaaccgggacgggttaacggtggtcgggtaaactacctaaacgggacgtcgggttacgngtaacctcccggactggttacccg

SEQ ID NO: 108824 - DNA, 626 bp, Homo sapiens
  misc_feature: GYAE6OF01BNEZ7.12.26.C04.1.454.CMB.1.raw
  modified_base (252)..(252): a, c, t, g, unknown or other
  misc_feature (252)..(252): n is a, c, g, or t
  modified_base (347)..(347): a, c, t, g, unknown or other
  misc_feature (347)..(347): n is a, c, g, or t
  modified_base (375)..(375): a, c, t, g, unknown or other
  misc_feature (375)..(375): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagtagttgttttatcaactccaanaatgagaactacttagcttggtaccagcaagaaaccaggacagccgaccaagttgctcattactggctagtcgacccgggtagtcccgggtaccngaccgtattcgagtcgcgaggccgggtntaggataccgagtactttccgacttctaccgaacctagtacacgcacgtcccgtagaccgaacggcccggtaaagtacgttcggtaggtaccgttaaggttttttacgtttttcgtacgtaacgtacctaaagtttactttataccttattaaccctccgtaccttccgtacggtttccgggaccgggtaacgggaccgtaagggtggaacggataccgaaacgtactggtacgacgtcgacctaacgtcg

SEQ ID NO: 108825 - DNA, 625 bp, Homo sapiens
  misc_feature: GYAE6OF01EZF2K.12.26.C04.1.454.CMB.1.raw
  modified_base (311)..(311): a, c, t, g, unknown or other
  misc_feature (311)..(311): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacgggcatcgtgatgacccagtctccagactccctggctgtgtctctgggcagagggccaccatccaactgcaagtccagccagtagtgttttatcaactccaacaatgagaactacttagcttggtaccagcagtaaaccaggacagccgcccaagtgctcatttacnggcatccgtacccgggatcccgggtccctgaccgtattccgagtggccaggcggtctaggagacgagtattaccacgttcctaccaccgatccgaagtcacggccttaggccaacgggtcccgaaaggtctggtacgggtcttaaggttttttacttttttacggtctaacggtcctaaaattcgtttaactacctacttaacccgtcccgacttaccgtaccgttttccgggacgggtaacgggtacccgtaaagggttggaacgtactaaccgaaaaccggtacgtagtccgggattacggccaacgtaacg

SEQ ID NO: 108826 - DNA, 735 bp, Homo sapiens
  misc_feature: GYAE6OF01EWYPH.12.26.C04.1.454.CMB.1.raw
tcagatacgacgtacacgaccggtgctcgatttagtctagcgactttgggtttgggggagctacaacaggcaggcaggggcagcaagatggtgttgcagacccaggtcttcatttctctgttgctctggatctctggtgccgtacggggacatcgtgatcgacccagtcctccagacctcccgtggctgtgtctcgtgggcgaggacgggccaccgatcaactgacaagtccagccagtagttgttttatccaactaccaacaatagaactaactacttagctttacggtaaccaggtacaaacgaaacccagggaaccacggacccgacccgtaaggttcgccttactaacgtttaccgtgggacctaacgtcccggttaacccgggaacggttcccccggggtaccctacggtaaccgtactttcggaggtcgggaccgacgggtcgggtactaggaacgtacgtagttacttacgaccttaccgtacctacgacttaccgacgaccgacgtcccgtagacccggtaggaacccgaagtcggttcgggtcgtacgttttagtttttacgtttcgaccgttaagtaccttaattacgttacgttaccaacttttaccgccgtaccgttacgtaccgggtttaccgggaccggtaacggggtaccgtaaaggggttggaaacttaccggtaaacgtacgtacgggttacggactacggaacctacgtacgttacg

SEQ ID NO: 108827 - DNA, 801 bp, Homo sapiens
  misc_feature: GYAE6OF01DOIZH.12.26.C04.1.454.CMB.1.raw
tcagatacgacgtacacgaccggtgctcgatttagtctagcgactttggggtttgggggagctacaacaggcaggcaggggcagcaagatggtgttgcagacccaggtcttcatttctctgttgctctggatctctggtcgccgtacggggacagtcgtgatcgaccagtcctaccagacctccctggctgtcgtctcgtgggcgaggacggccacatacaactgacaacgtccacgcctagtagtttagttttactaccaacctaccaaactaatacggaactaacttacgttagtcgttacggtaccaggacaaacgaaccgacggaccacggtacccgaccgtaagttcgaccttacgttacgtttacggtacggacctacgttacccggtaacccgggtacggggtccccgggtaccagtaccgtattacggacgggtcgaccggacggtccgggtacgtacggaacgtacgtaacgtttactttacccgacttccgtaccaaccgtactaccggacgtacacccggtcgacggacggtacgggaacctaggtacggttcggttaccgttattttacggttttttacgtcgtaccaagtttacttaacgttactttactaccttaaaccgttccgttaccccgttacgttacccgttaccggggttaccggggggaaaccgggttaccggggtaacggttaaacggggtacggtaaacggtaacccggttaaaacggaaacccgggtttacggtaacgggtttcggaaacccgttaccgaccgtttaaccgttccgg

SEQ ID NO: 108828 - DNA, 734 bp, Homo sapiens
  misc_feature: GYAE6OF01CMX4N.12.26.C04.1.454.CMB.1.raw
  modified_base (315)..(315): a, c, t, g, unknown or other
  misc_feature (315)..(315): n is a, c, g, or t
  modified_base (359)..(359): a, c, t, g, unknown or other
  misc_feature (359)..(359): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctgggtcgccgtaacggggacatcgtgatcgacccagtctccagacctccctggctgtgtctcgtgggcgagcggccaccatcaactgacaacgtccagccagtagttcgttttactacaactaccaaactatgaactaacttacgtacgtcgttacggtaaccagtacgaaacgaaaccgnggaccacggtacccgtacctaagttcgactactacgtttacggngcaacgttccggtaacccgggtacggtccccgggtacctacgtaacccgtgttaccgagggtccgggacgacggggttccggggtactacggaacgtactagttaccttaccgccttacctaccgaacctacgtccgaacggtccaacggttccgtcgaacggaccgggaacgtaggtacggttacggggttactacgtttttaggtttttagttcgaccgtaagtaacttaacgttagtttaacctaccgtaccttcccgtcccggttacttcccggttaccgggttacgggaaacgggtccggaaagtaacggggtagaaccttaacgtaaccggaaaggtcgtccgtaggtcccaccaacgttccgttaacg

SEQ ID NO: 108829 - DNA, 786 bp, Homo sapiens
  misc_feature: GYAE6OF01C0EXF.12.26.C04.1.454.CMB.1.raw
  modified_base (350)..(350): a, c, t, g, unknown or other
  misc_feature (350)..(350): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttcgctctggatctctggtgcctacgggacatcgtgatgacccagtcctccagactccctggctgtgtctctgggcgagacggccaccatcaactgcacgtccacgccagtagttgttttatccaactaccaacaatagtaagaacttaacttagtctttacggtaaccagacgaacgaaaaccaggaaccacggcccgaccctaagtcgtacctactaattttaccggngggactaacgttcccgtaacccgggtaacgtaccccggggttcccgacgtaacccgtatttaccggacggttacgggaccgtagggtcgggtacgtggaacgaccgtaaggttaccttttaccaaccctttcctacccgtaacccttaacgttcccaaacgggtcccaaacggtccccgttagggacccgaaacgggggtacccgaagttaaggttccgggttacggttaccgttttaagtttttttttaacgtttggaaccgttaagtaaccgtttaaatttaactttataccttaacgttacccttacccggttctaccgggtttaacctttccgggggaaaccggtacgggaaccccgttaagggggtccgaaacgttaacgtaaacccgaaacggtaactttgggggaccctagtccaccccgtaagtaccg

SEQ ID NO: 108830 - DNA, 565 bp, Homo sapiens
  misc_feature: GYAE6OF01DEOFB.12.26.C04.1.454.CMB.1.raw
  modified_base (232)..(232): a, c, t, g, unknown or other
  misc_feature (232)..(232): n is a, c, g, or t
  modified_base (297)..(297): a, c, t, g, unknown or other
  misc_feature (297)..(297): n is a, c, g, or t
  modified_base (354)..(354): a, c, t, g, unknown or other
  misc_feature (354)..(354): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtnttttatcaactcaacatgagaactactagcttggtaccagcagaaaccaggacagccgccaagtnctcatttactggcatcgaccggatccgggtcctgaccgattcagtgacagcgggtcngagacagatttcactctacacactcagcacgcctcgcacggcgaagagtgtgcttaggttttagttttgtcagtcaaattagttaactctaacttacctacccgtccttccgtaccgtttcgggaccgggtaacggggaccgaaacgggttaggaacggcgttaaccgaaaccggaaccttaggttacgggactttcgaccgaaccctacg

SEQ ID NO: 108831 - DNA, 826 bp, Homo sapiens
  misc_feature: GYAE6OF01CBQ1Q.12.26.C04.1.454.CMB.1.raw
  modified_base (203)..(203): a, c, t, g, unknown or other
  misc_feature (203)..(203): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtcgccgtacggggacatcgtgatgacccagtcctccagactccctggctgtgtctcgtgggcgagnggccaccatcaactgcaagtccagccagtgttgttttatcaacctccaaactaatgaacgtaactacttacgtcttacggtaccgagacaacgaaaaccgagggaaccacggaccccgtaccctaaacggtttcgaccttacgtaattttttacccggaggggtacctaccgttaaccccggttaaccccgggggtaacgttcccccggggggttaccccttaccggaaccccgttacgtttcccgtaagggttccggggacgtacggggtcccggggttacgtacggaagaccgtaacggttactttacccgaccttaccctccaaccccgtataacccgacggaccaacggtccccgtacggaccggaacggggtaacccgtaaagtacggttggttacgggtaccttttaagggttttttactttttcggactaacggtaaccgttaagttaacgtttaacgttcctaacgtttacccgtccgttacccgttacctttaccgggtttaccggggaccgggttaaaccggggtaaccgtaagggggttaggtaaccggtaagttaaccccgtaaacggtaacggttaggtccgggtacctaccgggacgtaccgttaccgg

SEQ ID NO: 108832 - DNA, 176 bp, Homo sapiens
  misc_feature: GYAE6OF01CGQT4.12.26.C04.1.454.CMB.1.raw
  modified_base (173)..(176): a, c, t, g, unknown or other
  misc_feature (173)..(176): n is a, c, g, or t
tcagatacgacgtacacgaccggtgctcgatttagtctagcgactttgggtttgggggaagaggaagactgacggtcccccaggagttcaggtgctgggcacagcggccctgggctgcctggtcaaggattacttcctacgtcgtatctgagcgggctggcaaggcgcatagnnnn

SEQ ID NO: 108833 - DNA, 712 bp, Homo sapiens
  misc_feature: GYAE6OF01AXHY5.12.26.C04.1.454.CMB.1.raw
  modified_base (708)..(708): a, c, t, g, unknown or other
  misc_feature (708)..(708): n is a, c, g, or t
tcagatacgacgtacacgaccggtgctcgatttagtctagcgactttgggtttgggggagctacaacaggcaggcaggggcagcaagatggtgttgcagacccaggtcttcatttctcttgttgctctggatctctggtgccgtacggggacatcgtgatcgacccagtctccagacctccgtgctgtcgtctcgtgggcgagacgggaccaccataccaactgacaacgtccaagccaagtagttgttttaactacaaacctaccaaacgtaattagaacgtaaccttaacgttagtcgttaggtaaccgaacgaacgaaacgaaaaccgaggaaccaaccggccccgaacccgtaaagttcgacctacgtaacttttacgcgggtacctaacgtacccggtaacccgggtaacgtcccgggtccctacggtaccgtacgttacgaggtcggacgtagggaccgggtcgtagaacgactagttacttaccgacctctaaccgaactagtccgacgacgtaaccgtccgtacgaacgaccgggaaaccgtaagtaggtcggttacggtaacttttaggttttattttcgattaactaacgttaattattacgtactacgttcctcctacgtcgtaaccgggttcgggacgggtaacgggacgtagggacggtataaactaacgaaacgacgtgtacgacctgaaccgntacg

SEQ ID NO: 108834 - DNA, 770 bp, Homo sapiens
  misc_feature: GYAE6OF01D5PQK.12.26.C04.1.454.CMB.1.raw
  modified_base (184)..(184): a, c, t, g, unknown or other
  misc_feature (184)..(184): n is a, c, g, or t
  modified_base (191)..(191): a, c, t, g, unknown or other
  misc_feature (191)..(191): n is a, c, g, or t
  modified_base (270)..(270): a, c, t, g, unknown or other
  misc_feature (270)..(270): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctcgtggtcgccgtacgggacagtcgtgatcgacccagtcctcagacctccgnggctgtntctagtggcgaggacggcccacactacgaactgacaacgtccacgacgaggtagtttcttttataccaacctaccaaanaagttacgaacgtaaccttacgttacggtaccgttaagtaacccagtaacaaacggaaaccgacggaacaaccggccccgtaacgtaaggtttccaccgttacgtaacgttttacgggacggtacctaaccggttaccccggtaaacccggggtacccggtttacccggggtaccctacggtaacccggtatttaccgggaagggtcccgggtaacgtacccggggttacggttacgtaggaaaccgttaacgtacgtttacgtttacccgaccttacggtaacctaacgtactacggacgtacaccggtctacggtctaaccgtaagtagttagttatttccgtagtttagtttaactcgtacgttacacgtacttaaagtactttaacgtaccgttgtacccagtaccggttcggtaaccggggtcgggaacgggtaacgtagtaggaacgttaacggaacaacggtacgttcggacgtaggccctaagccgttaacg

SEQ ID NO: 108835 - DNA, 792 bp, Homo sapiens
  misc_feature: GYAE6OF01CLH25.12.26.C04.1.454.CMB.1.raw
  modified_base (211)..(211): a, c, t, g, unknown or other
  misc_feature (211)..(211): n is a, c, g, or t
  modified_base (459)..(459): a, c, t, g, unknown or other
  misc_feature (459)..(459): n is a, c, g, or t
  modified_base (554)..(554): a, c, t, g, unknown or other
  misc_feature (554)..(554): n is a, c, g, or t
tcagatacgacgtacacgaccggtgctcgatttagtctagcgactttggggtttggggggagctacaacaggcaggcaggggcagcaagatggtgttgcagacccaggtcttcatttctctgttgctctggatctcgtggtcgccgtacggggactatcgtagatcgacccctagtcctccgacgtacctcccgtggctgtcgtcgtcggngggcgacggcgggaccaccatacaaccgtgaccacgtccacgccgtaagtacggtttacgttttactaccgaacctaccgtaaactaatagaacgtaaaccttacttacggtccggttacggtaaccagaacgaacgtaaaccgaggaccaccgtaccccgaaccggtaagtcgtacttacgtacgttacggtcggtccacgtacccggtaccgggtaccggtccggggtaccctacggtaccggttntaggtacggtcggcggtacggcggttcgtacggataacggtacttccttacgtaacctcgaccctaagtccttacggacgtaccacgtacccggngtaaccggacggaaccggtagtacggtgtacggttacgtttaagtttttcggtttaacgggtaagtactttaaaagtctttactaaccgttacttaccgtacccgttcgtacccggttaaccggggttcgggaaaccgggggttacccgtaaacggggtaacggttaacggtaactaaacgttaacccgaaaccggtaggtcgggttccgatttaacccgggactaaccgtttaccgg

SEQ ID NO: 108836 - DNA, 172 bp, Homo sapiens; identical to SEQ ID NO: 108789
  misc_feature: GYAE6OF02IFI3O.12.26.C04.1.454.CMB.1.raw
  modified_base (171)..(172): a, c, t, g, unknown or other
  misc_feature (171)..(172): n is a, c, g, or t

SEQ ID NO: 108837 - DNA, 171 bp, Homo sapiens; identical to SEQ ID NO: 108806
  misc_feature: GYAE6OF02IIQUK.12.26.C04.1.454.CMB.1.raw
  modified_base (171)..(171): a, c, t, g, unknown or other
  misc_feature (171)..(171): n is a, c, g, or t

SEQ ID NO: 108838 - DNA, 171 bp, Homo sapiens; identical to SEQ ID NO: 108806
  misc_feature: GYAE6OF02HEK2G.12.26.C04.1.454.CMB.1.raw
  modified_base (171)..(171): a, c, t, g, unknown or other
  misc_feature (171)..(171): n is a, c, g, or t

SEQ ID NO: 108839 - DNA, 173 bp, Homo sapiens; identical to SEQ ID NO: 108793
  misc_feature: GYAE6OF02I37ML.12.26.C04.1.454.CMB.1.raw
  modified_base (173)..(173): a, c, t, g, unknown or other
  misc_feature (173)..(173): n is a, c, g, or t

SEQ ID NO: 108840 - DNA, 173 bp, Homo sapiens; identical to SEQ ID NO: 108793
  misc_feature: GYAE6OF02GBGV9.12.26.C04.1.454.CMB.1.raw
  modified_base (173)..(173): a, c, t, g, unknown or other
  misc_feature (173)..(173): n is a, c, g, or t

SEQ ID NO: 108841 - DNA, 173 bp, Homo sapiens; identical to SEQ ID NO: 108793
  misc_feature: GYAE6OF02G0XT7.12.26.C04.1.454.CMB.1.raw
  modified_base (173)..(173): a, c, t, g, unknown or other
  misc_feature (173)..(173): n is a, c, g, or t

SEQ ID NO: 108842 - DNA, 174 bp, Homo sapiens; identical to SEQ ID NO: 108796
  misc_feature: GYAE6OF02I4U2T.12.26.C04.1.454.CMB.1.raw
  modified_base (173)..(174): a, c, t, g, unknown or other
  misc_feature (173)..(174): n is a, c, g, or t

SEQ ID NO: 108843 - DNA, 507 bp, Homo sapiens
  misc_feature: GYAE6OF02JWZGZ.12.26.C04.1.454.CMB.1.raw
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcagagggccaccatcaactgcaagtccagccagagtgtttatcaactccaacaatgagaactacttagcttggtaccagcagaaaccaggacagccgcccaagttgctcatttactgggcatctacccgggaatccggggtcctgaccgattcagtggcagcggtctgagacagatttcgactctcaccatcagcagcctgcaggccgaagactgtgctagtttattttgtccagctaatattatctatactccgctcatttcggcgaggaccaaggtgagactacgaacgtactgtacggctcgacactacg

SEQ ID NO: 108844 - DNA, 173 bp, Homo sapiens; identical to SEQ ID NO: 108793
  misc_feature: GYAE6OF02G0V25.12.26.C04.1.454.CMB.1.raw
  modified_base (173)..(173): a, c, t, g, unknown or other
  misc_feature (173)..(173): n is a, c, g, or t

SEQ ID NO: 108845 - DNA, 176 bp, Homo sapiens
  misc_feature: GYAE6OF02GQ0Y9.12.26.C04.1.454.CMB.1.raw
  modified_base (174)..(176): a, c, t, g, unknown or other
  misc_feature (174)..(176): n is a, c, g, or t
tcagatacgacgtacacgaccggtgctcgatttagtctagcgactttgggtttggggggaagaggaagactgacggtcccccaggagttcaggtgctgggcacagcggccctgggctgcctggtcaaggactacttcctacgtcgtatctgagcgggctggcaaggcgcatagnnn

SEQ ID NO: 108846 - DNA, 555 bp, Homo sapiens
  misc_feature: GYAE6OF02H0KAE.12.26.C04.1.454.CMB.1.raw
  modified_base (311)..(311): a, c, t, g, unknown or other
  misc_feature (311)..(311): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcagagggccaccatcaactgcaagtccagccagagtgttttatcaactccaacaatgagaactacttagcttggaccagcagaaaccaggacagcccgcccaagttgctcatttacngggcatctacccgggaatccggggtccctgaccgattcagtggcagcggtctgagacagatttcactctcaccatcagcacgcctgcaggccgaagattgtggctagttttatttgcagtcaattattatcattacctccgctccgtacgtttcggacgggacgggtaaccgaagggttcggaagtaactaaccgaaaaccggtaacgttgggtaccgggtactacggtaccaacccgttaacg

SEQ ID NO: 108847 - DNA, 507 bp, Homo sapiens
  misc_feature: GYAE6OF02FHP4P.12.26.C04.1.454.CMB.1.raw
  modified_base (447)..(447): a, c, t, g, unknown or other
  misc_feature (447)..(447): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcagagggccaccatcaactgcaagtccagccagagtgttttattcaactccaacaatgagaactacttagcttggtaccagcagaaaccaggacagccgcccaagttgctcattactgggcatctacccgggaatccgggggtcctgaccgattcagtggcagcgggtctgagacagatttcactctcacatcagcagcctgcaggccgaagatgtggctagtttatttttgtcagcaatattatcatactcnctcactttcggcgaggaccgtaaggtggaagatacgaaacgactgtcggctcgcacctac

SEQ ID NO: 108848 - DNA, 173 bp, Homo sapiens
  misc_feature: GYAE6OF02HSE2I.12.26.C04.1.454.CMB.1.raw
  modified_base (172)..(173): a, c, t, g, unknown or other
  misc_feature (172)..(173): n is a, c, g, or t
tcagatacgacgtacacgaccggtgctcgatttagtctagcgactttgggtttgggggaagaggaagactgacggtcccccaggagttcaggtgctgggcacagcggccctgggctgcctggtcaaggactacttcctacgtcgatctgagcgggctggcaaggcgcatagnn

SEQ ID NO: 108849 - DNA, 547 bp, Homo sapiens
  misc_feature: GYAE6OF02IF7DO.12.26.C04.1.454.CMB.1.raw
  modified_base (313)..(313): a, c, t, g, unknown or other
  misc_feature (313)..(313): n is a, c, g, or t
  modified_base (369)..(369): a, c, t, g, unknown or other
  misc_feature (369)..(369): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatcaaactccaacaatgagaactacttagcttggtaccagcagaaaccaggacagccgcccaagttgctcatttacngggcatctacccgggatccggggtcctgaccgattcagtgcagcggtctgagcagnttcactctcaccatcagcagcctgcaggcccgaagtactgtggctagttttattttgtcagctaattattatctatacctccgctactacgtttccggacggtacggtaccgaagggtacggtaagtaactaccgtaaaaccgtaacgttacggtcggtacgtacgacccgacctacg

SEQ ID NO: 108850 - DNA, 172 bp, Homo sapiens; identical to SEQ ID NO: 108792
  misc_feature: GYAE6OF02GZU7J.12.26.C04.1.454.CMB.1.raw

SEQ ID NO: 108851 - DNA, 513 bp, Homo sapiens
  misc_feature: GYAE6OF02FZP3J.12.26.C04.1.454.CMB.1.raw
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcagagggccaccatcaactgcaagtccagccagagtgttttatcaactccaacaatgagaactacttagcttggtaccagcagaaaccaggacagccgcccaagttgctcatttactgggcatctacccgggaatccggggtccctgaccgattcagtggcagcggtctgagacagatttcactctcaccatcagcagcctgcaggcccgaagatgtggcagtttattttgtcagtcaatattatcatactccgctcactttcggcggtagggaccgtaaggtggagactacgaaacgtactggtggctggcaccgtac

SEQ ID NO: 108852 - DNA, 577 bp, Homo sapiens
  misc_feature: GYAE6OF02J211D.12.26.C04.1.454.CMB.1.raw
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttatcaactcaacatgagaactacttagcttggtaccagcagaaccaggacagcccgcccaagttgctcatttacgtgggcacgtcgtaccccgggaatccccgggggtcctggaccgattccgagtcggcaggtcgggtctgagacagtactttcactctcacatcagccagcctgacgacggaccgaagtagtcgtggtcttagtttagttttcgtacgtagtactaattattatcctaattaccgtccgtactccttacgttccgggacggacggtaaccgaacggtggaacgtactaaccgtaacggtacttggtacggcctaggaccctacgttacg

SEQ ID NO: 108853 - DNA, 528 bp, Homo sapiens
  misc_feature: GYAE6OF02GGRXS.12.26.C04.1.454.CMB.1.raw
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatcaactccaacaatgagaactacttagcttggtaccagcagaaaccaggacagccgccaagttgctcatttactggcatctaccgggaatccggggtcctgaccgattcagtggcagcggtctgagacagatttcactctcaccatcagcagcctgcaggccgaagatgtgctagtttattttgctagctaatattatctattacctccgtctctacgtttcggcggtaggacccgaagggtgaaggtactacgaaacgtaacgttggtacggacgtcgacctaccgtacg

SEQ ID NO: 108854 - DNA, 183 bp, Homo sapiens
  misc_feature: GYAE6OF02FIW6A.12.26.C04.1.454.CMB.1.raw
  modified_base (175)..(183): a, c, t, g, unknown or other
  misc_feature (175)..(183): n is a, c, g, or t
tcagatacgacgtacacgaccggtgctcgatttagtctagcgactttgggtttggggggaagaggaagactgacggtccccccaggagttcaggtgctgggcacagcggccctgggctgcctggtcaaggactacttcctacgtcgtatctgagcgggctggcaaggcgcatagnnnnnnnnn

SEQ ID NO: 108855 - DNA, 545 bp, Homo sapiens
  misc_feature: GYAE6OF02GDJIK.12.26.C04.1.454.CMB.1.raw
  modified_base (315)..(315): a, c, t, g, unknown or other
  misc_feature (315)..(315): n is a, c, g, or t
  modified_base (451)..(451): a, c, t, g, unknown or other
  misc_feature (451)..(451): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatcaactccaacaatgagaactacttagcttggtaccagcagaaaccaggacagcccgacccaagttgctcatttacgngggcatccgtacccgggaatcccggggtccctgacccgattcagtggcaggcgggtctgacgactagtatttcactctacaccatcagcacgcctgcaggccgaagtatgtgactagtttattttgcagactaatnttatcatcctccgctctacgttccgggacggtacgggaccgtaaggtggacgaacttaacgaaaccgtacgtggttacggctagtaccacctac

SEQ ID NO: 108856 - DNA, 581 bp, Homo sapiens
  misc_feature: GYAE6OF02ILS51.12.26.C04.1.454.CMB.1.raw
  modified_base (139)..(139): a, c, t, g, unknown or other
  misc_feature (139)..(139): n is a, c, g, or t
  modified_base (292)..(292): a, c, t, g, unknown or other
  misc_feature (292)..(292): n is a, c, g, or t
  modified_base (326)..(326): a, c, t, g, unknown or other
  misc_feature (326)..(326): n is a, c, g, or t
  modified_base (434)..(434): a, c, t, g, unknown or other
  misc_feature (434)..(434): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
tcagatacgacgtacacgaccggtgctcgatttagtctagcgactttgggtttgggggaggcttacaacaggcaggcaggggcagcaaagatggtgttgcagacccaggtctttctatttctctgttgctctggatctntggtgcctacggggacatcgtgatgacccagtcctccagactccctggctgtgtctctgggcagagggtccaccatcaactgcaagtccagccagagttgttttatcaactccaacaagtgagaacttactagcttggtaccagcagaaaccnggacagccgaccctaagttgctctaattttacgngggcatcctaacccgggaacttcccggggtccctagaccgtattcgagtggcagcggtctgagacagtactttcactctacaccatccagcagcctgcaggccgaagngttcgaggacttagttttactttcgacngtactaagttnttanctaataccgtcgtactccgtacgtttccgggcgggaacggtaccgtaagggtcggtaagtactacgaaaacggtacgttggtaacggcgtacgccaaccgtacg

SEQ ID NO: 108857 - DNA, 558 bp, Homo sapiens
  misc_feature: GYAE6OF02GF0DX.12.26.C04.1.454.CMB.1.raw
  modified_base (313)..(313): a, c, t, g, unknown or other
  misc_feature (313)..(313): n is a, c, g, or t
  modified_base (372)..(372): a, c, t, g, unknown or other
  misc_feature (372)..(372): n is a, c, g, or t
  modified_base (427)..(427): a, c, t, g, unknown or other
  misc_feature (427)..(427): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacattcgtgatgacccagtctccagactccctggctgtgtctctgggcgagagggccaccatcaactgcaagtccagccagagtgttttatcaactccaacaatgagaactacttagcttggtaccagcagaaaccaggacagccgcccaagttgctcatttacnggcatctaccgggatccggggtcctgaccgattcgagtggcagcgggtctggagacagntttcactctcacatcagcagcctgcaggccgaagatgtggctagttttattttgntagactaattattatacgtattacctccgtcttaccgtacgtttccgggcgggaaggtacccgtaaggggtcggaacgtaacgttaaccgaaaaccggtacgttggtcggtacgtacgaccgaccgttacg

SEQ ID NO: 108858 - DNA, 562 bp, Homo sapiens
  misc_feature: GYAE6OF02ISVT6.12.26.C04.1.454.CMB.1.raw
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
  modified_base (395)..(395): a, c, t, g, unknown or other
  misc_feature (395)..(395): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttattcaactccaacatgagaactacttagcttggtaccagcaagaaaccnggacagcccgccaagttgctcatttacnggcatcgtacccgggagtccgggtccctgaccgtattccagtcggcgacgtcgggtctgagacagatttcactctcacatcancacgctgcgacggaccgaagagtggtgtactaggttttattttgactagactaattattactctaattcttcccgcttaccgtacgtttcgggacgggtaacggtacccggtaaggtcggaagtacgtaacgaaaccgtacgtcggtacggctacgtaccgactacg

SEQ ID NO: 108859 - DNA, 577 bp, Homo sapiens
  misc_feature: GYAE6OF02FR3GD.12.26.C04.1.454.CMB.1.raw
  modified_base (378)..(378): a, c, t, g, unknown or other
  misc_feature (378)..(378): n is a, c, g, or t
  modified_base (462)..(462): a, c, t, g, unknown or other
  misc_feature (462)..(462): n is a, c, g, or t
tcagatacgacgtacacgaccggtgctcgatttagtctagcgactttggggtttggggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatcaactcaacaatgagaactacttagcttggtaccagcagaaaccaggacagccgccaagttgctcattactggcatctacccgggaatccggggtcctggaccgattcagtggcagcgggtctgagacagattcactcncaccatcagcagcctgccgaggacccgaagacgttggtcgacttagtttttattttcggactaggtacctaagttacttaactntacttaccgtccgtcttacctacgttttccgggacgggtacgggtaaccgtaagggtcgggtaagtaacttaaccgaaacggtaacgtggtacggcctaggaccaacccgttacg

SEQ ID NO: 108860 - DNA, 610 bp, Homo sapiens
  misc_feature: GYAE6OF02GQZHH.12.26.C04.1.454.CMB.1.raw
  modified_base (315)..(315): a, c, t, g, unknown or other
  misc_feature (315)..(315): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatcaactccaacaatgagaactactagcttggtaccagcagaaaccaggacacgcccgcccaagttcgctctatttacngggcatccgtacccgggtaacgtccggggtccctcgaccgtattcgagtcggcacggcgggtctagagacagtactttcactctcactatcagcacgcctgcgacggaccgaagtagtggtggtcttagttttacttttagacgtagtactaagttatttactactaagttacctccgtctaccgttaccgtttccgggacgggtaacgggtaccggtaagggtacggtaacggtaacttaaccgaaaacggttaacgtcgggtacgggtaccgtacggtacctaacccgtaacg

SEQ ID NO: 108861 - DNA, 667 bp, Homo sapiens
  misc_feature: GYAE6OF02G9GD2.12.26.C04.1.454.CMB.1.raw
  modified_base (249)..(249): a, c, t, g, unknown or other
  misc_feature (249)..(249): n is a, c, g, or t
  modified_base (294)..(294): a, c, t, g, unknown or other
  misc_feature (294)..(294): n is a, c, g, or t
  modified_base (313)..(313): a, c, t, g, unknown or other
  misc_feature (313)..(313): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatccaactgcaagtccagccagagtgttttatcaactccaanaatgagaactacttagcttggtaccagcagaaaccaggcacgccncccaagttgctcatttacngggcatctacccgggatccggggtccctgaccgtattcgagtaggctagcggtctgagacagtatttcacgtctccgacctagtaccagcacgcccttggaccgtacgggacccgaaagtcgttaggtcggtacgtttaagtttttacgtttttacggtacgtaacgttactaagtttaacgtttaacctaccgttaacgttaaacccgttcccggtaacccttaccgttacccggttttccgggacgggtaaccggggtaaccggtaaacggggttcgggtaaactaaccggttaacctaaaaccgggtaccgtttagggtaccggtacgttccggaaccttacccgtaaccg

SEQ ID NO: 108862 - DNA, 726 bp, Homo sapiens
  misc_feature: GYAE6OF02IOBXE.12.26.C04.1.454.CMB.1.raw
  modified_base (253)..(253): a, c, t, g, unknown or other
  misc_feature (253)..(253): n is a, c, g, or t
tcagatacgacgtacacgaccggtgctcgatttagtctagcgactttgggtttggggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagtagttgttttatcaactccaanaatgagaactatagcgttagaccagacaacgaaaccgaggacacgcccgacccgaagttcgctactatttacgtgggactacgtacccgtaacccgggtaacgtccccgggggtcctcggaaccgtacttacgacggtcggcgagggtccgggtctaggacgacgtagttacgttccacttcctaccaacctagtaccgacggacacggtcctcggaccgacgggaccgaaaggtacgttcggtacggtacgttttaaggtttttagtttttacgggacttaaggtaaccttaaaagtttacgtttaactaaccgttaacctttacccgttacccgttacctttaaccgttaacccgggttttaccgggggaccgggtaaacggggtaacccggtaaaggggttaccgggaaagtaaccgttaaaccgaaacggttacgtacgggttccgaccgtacgacccgtaccgttacg

SEQ ID NO: 108863 - DNA, 717 bp, Homo sapiens
  misc_feature: GYAE6OF02GVRSR.12.26.C04.1.454.CMB.1.raw
tcagatacgacgtacacgaccggtgctcgatttagtctagcgactttggggtttggggggagctacaacaggcaggcagggggcagcaagatggtgttgcagacccaggtcttcatttctctgttgctctggatctctggtgcctacggggacatcgtgatgacccagtctccagactccctggctgtgtctcgtgggcgaggacgggccaaccatacaactgacaacggtccacggccaagtagttgttttaactaccaacctaccaaacaataggaacgaacttaacttaagtcgttacggtaaccagacaacgaaaccgaggacacggacccgacctaaggttcgaccttactatttacgtacgggactactacccggtaaccgggtaacgttccccgggggtcctacggaccggtacttcgaacgggtcggacgtacgggtccggtacgtaggaacgtaactaaggtactttccaccgttacctacacctaactacacgaccacggccgtacgacggaacggacccggtaaagacggttaggtacggttacgtttaagtttttacgttttacggtactaaggtaacctaaattaacgtttaactactaacttaccttacccgtacttacgtaccgtttacgggacgggtaacggtacggaaggtcggaataactaaccgaaacgtacgtaggtacggactacgaccgactacg

SEQ ID NO: 108864 - DNA, 729 bp, Homo sapiens
  misc_feature: GYAE6OF02HBZG7.12.26.C04.1.454.CMB.1.raw
  modified_base (326)..(326): a, c, t, g, unknown or other
  misc_feature (326)..(326): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccgatcaactgctaagtccagccagtagttgttttatcaacgtcaacgatgatactactagcttgtaccagcaacaaaccgaggacacgcccgaccgaagttcgactactatttacgngggactacgtcccgtaacccgggaacgttccccggggtccctcggaccgtattaccgaggtcggaccgagggtccggtacgtaggaacgacgtaacggtactttaccgacccgtttacctacccgtaaccgtaccgttacgaacggtcccgtaacgggtcccgtaccggaaccgggaccggggaaacccggtaaagggtacgttacggggttaaccggtaccggttttaaaggttttttaccggtttttacggaaccgtaagtacccgttaaagtttactttactacgttacgttaacccgttccgtacttaccgtaccggtttacggaccgggtacggtaccgggtaaggtacgaacgtaccaacgtaaacgtacgtacggtcgtacgtacgactacgtacg

SEQ ID NO: 108865 - DNA, 873 bp, Homo sapiens
  misc_feature: GYAE6OF02JBKV6.12.26.C04.1.454.CMB.1.raw
tcagatacgacgtacacgaccggtgctcgatttagtctagcgactttgggtttgggggagctacaacaggcaggcaggggcagcaagatggtgttgcagacccaggtcttcatttctctgttgctctggatctctggtgccgtacggggacatcgtgatcgacccagtctccagacctccctggctgtcgtctcgtgggcgaggacgggcccaccatacaacgtgacaacgtccacgccagtagttcgttttactcaacctaccaacaactagaactaacttacttagtacgttacggtaaccgaacgacgtaaacgaaaccgacggtaaccaccggacccgaaccccgtaaggttacgaccttacgttaacgtttacgcgggtacctaacgttacccggtaaccccgggtaacggttccccgggggttacccctacgggacccgtagttaccgtacggtaggggtaccgtacggggtcccgggtacgttaccggacggtaaacctaacggttacgtttaccctaaccgttaccttacccgaaacccgtacgtacgtaccggtaccgtaaccggtcccgtacgaacccgggtaacggggaacccgttaaggacggttacggttccgggtaacggttttacgttttttaagttttccggaacctaacggttaacttaaacgttttacgtaaccgttaccgttaacgttacccgtttaccgttccccgtttaaacgttaccgggttttaccccggggacggggttaaccgggtaacccgggttaaggggttaaccggtaacgtaaccggttaaaccgtaaaaaggggttcccgtagggttaccgggtaccctaccggtacccgtacgtttaaccg

SEQ ID NO: 108866 - DNA, 675 bp, Homo sapiens
  misc_feature: GYAE6OF02G9W2Z.12.26.C04.1.454.CMB.1.raw
  modified_base (245)..(245): a, c, t, g, unknown or other
  misc_feature (245)..(245): n is a, c, g, or t
  modified_base (483)..(483): a, c, t, g, unknown or other
  misc_feature (483)..(483): n is a, c, g, or t
  modified_base (590)..(590): a, c, t, g, unknown or other
  misc_feature (590)..(590): n is a, c, g, or t
tcagatacgacgtacacgaccggtgctcgatttagtctagcgactttgggtttgggggagctacaacaggcaggcaggggcagcaagatggtgttgcagacccaggtcttcatttctctgttgctctggatctctggtgccgtacggggacatcgtgatcgacccagtctccagacctcccgtggctgtgtctcgtgggcgaggacgggcccacatcaactcgacaacgtccacgccagtagttnttttactcaactaccaacagtagaagaaccttacgttacgtcttacggaaccagaccaaacggaaaccgaggacacggaccccgacctaaggttcgccttacgtactttacggcggactacgtacccggtaacccgggtaacggtccccgggggttccctacggtaacccgtattcggaggtcggacgagggttcggtcgtagacgtactacgttctttccgacctcttaccgaaccntaccgagtccacggtcctagaccgacgggaaccgaagtcgtggtaccgttagtttaggttttactttcggactagtactaatttacgtacactacgttccacccgtnttaccgtacggttaccgggacgggtaacggtaacggtaaggttcgaagtctaaccgaaagttcgtgtacggctacgactccgtag

SEQ ID NO: 108867 - DNA, 781 bp, Homo sapiens
  misc_feature: GYAE6OF02G02HN.12.26.C04.1.454.CMB.1.raw
tcagatacgacgtacacgaccggtgctcgatttagtctagcgactttgggtttgggggagcgtacaacaggcaggcaggggcagcaagatggtgttgcagacccaggtcttcatttctctgttgctctggatctctggtcgccgtacggggacagtcggtgatcgacccagtcctccgagacctcccgtggctgtcgtcgtcgtggcgaggacgggccaaccagtaccaacgtcgacgtaacgtaccgacgaccgaagtagtttacgttttactacgtaaacctaccgaaataacgtacggtaaacgtaaaccttacgtttaacgtcgtttaacggaacccgtaagacccgtaaaggaaaacccgaggaccgaccgaccccggacccgtaagttcgccttaccgttaatttcggacggactactacccggtaacccgggtacggtcccggggtaccctaggaccgtattacgaacggtggaccgtggtacggtccaaggactacggtacttaccgttaccacgtttccaccgtaaacctcgttaaccgaggtacctacggtccctgggaaccgtaagggacccgtaaaggtcgttacgggtcgttaacgttttacggtttttctaacggtctaacgttaacgttaagttctaaagttcaaccgttaccgttcctacgttaccgttacggtaccgggtacggaaccgttacggacgggtactaaacggacgttaaacgaacccgttaggtccggtatccggttacccggatacggttaccgg

SEQ ID NO: 108868 - DNA, 832 bp, Homo sapiens
  misc_feature: GYAE6OF02IXUKA.12.26.C04.1.454.CMB.1.raw
  modified_base (475)..(475): a, c, t, g, unknown or other
  misc_feature (475)..(475): n is a, c, g, or t
tcagatacgacgtacacgaccggtgctcgatttagtctagcgactttgggtttggggagctacaacaggcaggcaggggcagcaagatggtgttgcagacccaggtcttcatttctctgttgctctggatctctggtgaccgtacggggactatcgtgagtcggaacccagtccctaccaacgtaccttcccgtggccttgttcggtacttccggtcgggacgacggacggggcccaacccgtataccaaacgtgacctaacgtacccgaacgaccgaaggttaaggtttcgtttttaacttccgaaacctaccaaactaagtggaactaaacttacttacgtacttacgtaccagaaccaaaggaaacccgaggaccgacgtaacccgcccggtaagttccgaccttacgttaacgttttcggacgggacttacgtaaccccggttaacccgggacgttccccggggttacccncggtaaccttagttcgaaggtcggttaccgagggtccggttacgaggacgtaacgttagtaactttccgacctactaacccgacctagttacccgagcccgtacgtaccgtaggcgtaaccgggacccgtaaggtggtttaacggtcgtttaaccgtttagttttttaacggttttctaccggtaacttaacgttaacttcgttaaccgttactaaccttcccggttaaccctacgtttaccgtacggttaccgggacgggtaccgggtaccggtaagggtaagggttacctaaccggtaaccgttaaaggttcccggtagggttaccgtactaccgggttaccaacccggtttcgg

SEQ ID NO: 108869 - DNA, 952 bp, Homo sapiens
  misc_feature: GYAE6OF02IMZ17.12.26.C04.1.454.CMB.1.raw
tcagatacgacgtacacgaccggtgctcgatttagtctagcgactttggggtttggggggagctacaacaggcaggcaggggcagcaagatggtgttgcagacccaggtcttcatttctctgttgctctggatctctggtcgccgtacggggacatcgtgatcgacccagtcctccacgacctccgtggtctgtgtctcgtgggcgaggacggcctaccactactactagactacgtaccgacgaccaggttagtttagttttaactacctaacctaccaacgtaacgtacgtaacgtaaacctttacgttaacgtaccgtttacggtaaccgaagtacctaaaccggaaaacccgacgggaacctacccggccccggtaacccgttaaggttaccgtaccgtacctttacgtttacggtcgggtacctaccgttaccccggttaaccccggggtaaccggttccccgggggttacccgtaccggaaccgtttacgttaccggtacgggttcggacggtacggggtccgggttacggtagaacggtaacgtaacgttacgtttacccgtaaccttacccgtaccctacgtaaccgtaaccggccggtaaccgcccggttaccgtccgggtaaccgggtaaccggggtaaccgtaagggttaaccgggtttagggtaccccggttttaggttttttaaccggttttttaacgtttaccggaccggttaacgtttaaaccgtttaagtttaacctttaaggtaccctttaaccgggtaacccgttttcccggtaacttaacccggggtttacccggggttaccggggaccggggttaacggggttaaccggtacgggttaaccggtaacgttaaacccggtaacccggggttaaattaccggggttacggggtaaccccgttaccggtaacccgtacccgttacccggttacgg

SEQ ID NO: 108870 - DNA, 531 bp, Homo sapiens
  misc_feature: GYAE6OF01AZSDP.12.71.G05.1.454.CMB.1.raw
tcagatacgacgtacacgaccggtgctcgatttagtgtcgtcgcaagagagagggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggagtttatagctagttgggtgttcgggcgacgggaccaaaggtgaccgtctaagtcagcccaaggcctcgccccctcggtccactctcgttcccgccctcc

SEQ ID NO: 108871 - DNA, 523 bp, Homo sapiens
  misc_feature: GYAE6OF01CKMIY.12.71.G05.1.454.CMB.1.raw
  modified_base (322)..(322): a, c, t, g, unknown or other
  misc_feature (322)..(322): n is a, c, g, or t
  modified_base (518)..(518): a, c, t, g, unknown or other
  misc_feature (518)..(518): n is a, c, g, or t
tcagatacgacgtacacgaccggtgctcgatttagtgtcgtcgcaagagagagggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgaggcactaagcggccctnaggagtttctgatcgcttctctggctccaaggctggcgaccgggcctcctgacaatatctgggctccaggctggaggacgaggctcattactactgctgctcatatggagttatagcacgttggggtgttcggcggcgggacaaagtgaccgtctaagtcagcccaaggctcgcccctcggtcactctcgttcccncctcc

SEQ ID NO: 108872 - DNA, 523 bp, Homo sapiens
  misc_feature: GYAE6OF01DNX73.12.71.G05.1.454.CMB.1.raw
  modified_base (434)..(434): a, c, t, g, unknown or other
  misc_feature (434)..(434): n is a, c, g, or t
  modified_base (516)..(516): a, c, t, g, unknown or other
  misc_feature (516)..(516): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaatacccccggcaaagtccccaagttaatcatttatgagggcacgtaagcggccctcaggagtttctgatcgcttctctggctccaaggctggcgaccgggcctcctgacaatatctgggctccaggctgaggacgaggctcattactactgctgctcatatggagttanagcacgttgggtgttcgggcgcgggaccaaagtcgaccgtctaagcagcccaaggctcgccccgtggtcactctcgttcccnccgtccc

SEQ ID NO: 108873 - DNA, 527 bp, Homo sapiens
  misc_feature: GYAE6OF01DOPCP.12.71.G05.1.454.CMB.1.raw
  modified_base (522)..(522): a, c, t, g, unknown or other
  misc_feature (522)..(522): n is a, c, g, or t
tcagatacgacgtacacgaccggtgctcgatttagtgtcgtcgcaagagagaggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatcgtgggctccgagctggaggacgaggctcattactactgctgctcatatggagttatagctacgttgggtgttcggcggtcgggaccaaagtcgaccgtctaagtcgagcccaaggctcgcccctcggtcactctctcccncctcc

SEQ ID NO: 108874 - DNA, 540 bp, Homo sapiens
  misc_feature: GYAE6OF01C4L8Z.12.71.G05.1.454.CMB.1.raw
  modified_base (415)..(415): a, c, t, g, unknown or other
  misc_feature (415)..(415): n is a, c, g, or t
  modified_base (531)..(531): a, c, t, g, unknown or other
  misc_feature (531)..(531): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgaggcactaagcggccctcaggagtttctgatcgcttctctggctccaaggctggcgaccgggcctccctgacaatatctgggctcgaggctgaggacgaggctcattacnctgctgctcatatggagttatagctacgttggggtgttcgggcggacgggacaaaggtcgaccgtccgtaagtcacgcccaaggcctcgccccgtggtcccactcctcgttccccnccgttcccg

SEQ ID NO: 108875 - DNA, 522 bp, Homo sapiens
  misc_feature: GYAE6OF01DA1Y4.12.71.G05.1.454.CMB.1.raw
  modified_base (423)..(423): a, c, t, g, unknown or other
  misc_feature (423)..(423): n is a, c, g, or t
  modified_base (517)..(517): a, c, t, g, unknown or other
  misc_feature (517)..(517): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgaggcactaagcggccctcaggatttctgatcgcttctctggctccaaggctggcgaccgggcctccctgacaatatctgggctccaggctgaggacgaggctcattacactgctgctnatatggagttatagctacgttgggtgttcggcggcgggaccaaagtcgaccgtctaagtcgagcccaaggctcgcccctggtcactctctcccncctcc

SEQ ID NO: 108876 - DNA, 549 bp, Homo sapiens
  misc_feature: GYAE6OF01AEZT5.12.71.G05.1.454.CMB.1.raw
  modified_base (541)..(541): a, c, t, g, unknown or other
  misc_feature (541)..(541): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgctttctctggctccaaggctggcgaccgggcctcctgacatatctgggctccaggctgaggacgaggctcattactactgctgctcatatggagttatagctacgttggggttgttcgggcggtacgggaccaagtgacccgttcctaagtccgacgcccgaaggcctacgcccccctcggtccaccttcctcgttcccccncccttccc

SEQ ID NO: 108877 - DNA, 653 bp, Homo sapiens
  misc_feature: GYAE6OF01C93XF.12.71.G05.1.454.CMB.1.raw
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctcctggtaccaacaactacccggacaaacgtccccaagttaatctatttataggaggcactaagcgccctcaggtagtttctgatcgcttctctggctccaaggtctcggcgacccggcctccgtagacaattacgtcgtagggcctcgaggtctagagggacgaggctcgtaattactactgctgtcctcattagtggtaggttataagtccgtaggtttggggttcggttccgggtcggaccgggtaacgaaacggttcgtaccggttacccgtaaaggtacccgaaccggtaccccgaaacgggtcccgttacccggtcccccccgttaccggggttaccctaaccccgttcccgtttacccggtttcccccccggtccccttttacccccgg

SEQ ID NO: 108878 - DNA, 686 bp, Homo sapiens
  misc_feature: GYAE6OF01EUE16.12.71.G05.1.454.CMB.1.raw
tcagatacgacgtacacgaccggtgctcgatttagtgtcgtcgcaagagagaggggggggtcacaagaggcagcgctcgtcgggacgcctccaccatggccgtgggctctgctgcctcctcactctcctcactcaggacacgagggtcctgggcccagtctcgccctgactcagcctgcctcgtgtcgtgggtctccgtggacagtcgatccaccgtctcctgcacgtgggaccagtaatgtattttggaaatttcgactagtctctggtaccaacaactacccggacaaacgtcccaagttaactctaatttatggacgggtactaacgtaacggccggtaccctacgaagggtacgttttctaggtactcgtcctttctcgtggcctccgaaggcctacgggccgtacccgggccctccgtcgaacctaacttacgtcgtcgggacctccgagggtcttacggacggacggacgggcggtaagtttacgttatggttgtctactattagtggtacgggttaatagtcttaacgtttcggaacgttcggttaccgttaggttccgggacgggtacgggaccaacggtcgtcggtaacccgttcggtacgggtcaaccggcccgaaacgggtccgtaccccggtaccccgtcggttaccctaccgttcccgttccggttccccccg

SEQ ID NO: 108879 - DNA, 514 bp, Homo sapiens
  misc_feature: GYAE6OF01DCITA.12.71.G05.1.454.CMB.1.raw
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagcagtgatgttggacttataaccttgtctcctggtaccaacaacaccaggcaaagcccccaaatcatgattatgagtcactatcggtcctcaggattctaatcgcttctctgttccaagtctgcaacacggcctcctcgaccatctcgtgggtccaggctgaggacgaggctgatttattactgcagctcatatgcagcagcaactgtttgtctacggtaacgtcggacccgtaggtccgaccgttccgtaggtcacgacccgaacgacccaaccccatcgtcctcttcccg

SEQ ID NO: 108880 - DNA, 526 bp, Homo sapiens
  misc_feature: GYAE6OF01DY9RO.12.71.G05.1.454.CMB.1.raw
  modified_base (323)..(323): a, c, t, g, unknown or other
  misc_feature (323)..(323): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacaggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctnaggagtttctgatcgcttctctggctccaaggctggcgaccgggcctcctgacaatatctgggctccaggctgaggacgaggctcattacactgctgctcatatggagttatagctacgttgggtgttcggcggcggacaagtcgaccgtcctaagtcgagcccaaggcctacgcccctgtcactctcgttcccgccctcccg

SEQ ID NO: 108881 - DNA, 531 bp, Homo sapiens
  misc_feature: GYAE6OF01ELJ16.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctgctccaaggctggcgaccgggcctccgtgacaatatctgggctcgaggctgaggacgaggctcattactactgctgctcatagtggagttatagctacgttgggtgttcggcggcgggacaagtcgaccgtctaagtcgacgcccaaggctcgccccctcggtccactctcgttcccgccctcc

SEQ ID NO: 108882 - DNA, 529 bp, Homo sapiens
  misc_feature: GYAE6OF01D8BP2.12.71.G05.1.454.CMB.1.raw
  modified_base (338)..(338): a, c, t, g, unknown or other
  misc_feature (338)..(338): n is a, c, g, or t
  modified_base (523)..(523): a, c, t, g, unknown or other
  misc_feature (523)..(523): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcattttatgagggcacgtaagcggccctagaggagttttcngatcgcttctctggctcgaaggctggcgaccggcctcctgacatatctggctcagctgagacgaggctcattctactgctgctcatatggtagttatagctagtttgggtgttcgggcggtccgggacaagtcgaaccgtcctaagcacgcccaaggcctcgccccctgtcactctcgttccccncctccc

SEQ ID NO: 108883 - DNA, 788 bp, Homo sapiens
  misc_feature: GYAE6OF01BA0HV.12.71.G05.1.454.CMB.1.raw
tcagatacgacgtacacgaccggtgctcgatttagtgtcgtcgcaagagagagggggggggtcacaagaggcagcgctctcgggacgccctccaccatggcctgggctctgctgctcctcactctcctcactcaggacacgagggtcctgggcccagtctcgccctgactcagcctgcctccgtgtctgggtctccgtggacagtcgatccaccgtctcctgcacgtgggaccagtaatgtattttaggaaattttcgacctagtcctcctggtaaccaacaacgtaccccggacaaacgtcccctaaagttaactctaatttatggacgggactaacgtaaggccggccctcgaggtagtttctgtactcgtcttctcgtggctccgaaggtcgtcggccggacccgggtccctcccgtagaactaacttacgtccgtcgggtccctaccggacggtcgtagggaacgggacgacgggtccctacgtaactttaacctaccgtgtccttcggaccttacgaattacggttagggtaaggtttaagtacgtaccgttacggtttgggggttcgggtttaccgggggaccggggtaaccggggtaaaccgtaaacggggttccggtaacccccggttaaccgttaaaccgggttaccggaacccgggtaaccccggtaaacgggtccccggttacccccggtaccccccccggtttaccgggtaccccttaaccccgtttaccccgtttacccccggtttcccccccgttacccccgtttaccccccgg

SEQ ID NO: 108884 - DNA, 537 bp, Homo sapiens
  misc_feature: GYAE6OF01EWS9A.12.71.G05.1.454.CMB.1.raw
  modified_base (276)..(276): a, c, t, g, unknown or other
  misc_feature (276)..(276): n is a, c, g, or t
  modified_base (331)..(331): a, c, t, g, unknown or other
  misc_feature (331)..(331): n is a, c, g, or t
  modified_base (437)..(437): a, c, t, g, unknown or other
  misc_feature (437)..(437): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctcctggtaccaacaataccccggnaaagtccccaagttaatcatttatgagggcactaagcggccctcaggagttttcngatcgcttctctggctccaaggctggcgaccgggcctccctgacaatatcgtgggctcgaggcctggaggacgaggctcattacactgctgctcatatggagttanagtcacgttgggtgttcgggcggcggacaagtgaccgtctaagtcacgcccgaaggtcctcgtcccctccgtcgtctacttccgttcccgtccccgtccc

SEQ ID NO: 108885 - DNA, 265 bp, Homo sapiens
  misc_feature: GYAE6OF01BY6CE.12.71.G05.1.454.CMB.1.raw
  modified_base (262)..(265): a, c, t, g, unknown or other
  misc_feature (262)..(265): n is a, c, g, or t
tcagatacgacgtacacgaccggtgctcgatttagtgtcgtcgcaagagagagggagggccagctgctgggagcgtctacatatttcgacccctggggccagggaacccaggtcaccgtctcctcagcctccaccaagggcccatccgtcttccccctggcgccctgccccaggagcacctccgagagcacagcggccctgggctgcctggtcaaggactacttcctacgtcgtatctgagcgggctggcaaggcgcatagnnnn

SEQ ID NO: 108886 - DNA, 600 bp, Homo sapiens
  misc_feature: GYAE6OF01ESQGQ.12.71.G05.1.454.CMB.1.raw
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
  modified_base (336)..(336): a, c, t, g, unknown or other
  misc_feature (336)..(336): n is a, c, g, or t
  modified_base (435)..(435): a, c, t, g, unknown or other
  misc_feature (435)..(435): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgactagtctcctggtaccaacaataccccggnaaacgtccccaagttaatcatttangaggcactaagcggccctcaggtattttcngtatcgcttctctggctcaaggctggccgacccgggcctcctgactaatatcgtgggcctcgaggctggaggacgaggctcattactacgtgctgctanatgtggtagttatagtctacgttggggttgttccgggcggtacgggaaccgtaaaggtcgtaacccgtacgtaaacggtccgacggaccccgaagggtccctcccggtccccccgttacgggtccctaaccgttccttcccggttccccctaacccgtttccccg

SEQ ID NO: 108887 - DNA, 523 bp, Homo sapiens
  misc_feature: GYAE6OF01ELPZT.12.71.G05.1.454.CMB.1.raw
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagcagtgatgttgggacttataaccttgtctcctggtaccaacaacaccaggcaaagcccccaaactcatgatttatgagggcactaagcggccctcagggtttctatcgcttctctggctcgagtctggcaacacggcctcctgacaatctctgggctccaggctgaggacgaggcggattattactgttgcttcatatgcgggtagtagctactttcgattgtcctagttcgggcggagggaccaagcgtcgaccgtcgtgggtcaggcccaaggcctcgccccctggtctaccg

SEQ ID NO: 108888 - DNA, 526 bp, Homo sapiens
  misc_feature: GYAE6OF01DRLZ8.12.71.G05.1.454.CMB.1.raw
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctctggtaccaacaatacccggcaaagtccccaagttaatcatttatgagggcactaagcggccctcaggagtttctgatcgcttctctggctccaaggctggcgacgagggccctcccgtgacctaatatcgtgggctccgaggctgaggacgaggctcattactactgctgctcatatgggagttatagctacgtttgggtgttcggcgggcggacaaagtcgaccgtctaagcagccaagcctcgcccctgcactctcgttcccgccc

SEQ ID NO: 108889 - DNA, 635 bp, Homo sapiens
  misc_feature: GYAE6OF01ARQ8W.12.71.G05.1.454.CMB.1.raw
  modified_base (181)..(181): a, c, t, g, unknown or other
  misc_feature (181)..(181): n is a, c, g, or t
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
  modified_base (448)..(448): a, c, t, g, unknown or other
  misc_feature (448)..(448): n is a, c, g, or t
  modified_base (467)..(467): a, c, t, g, unknown or other
  misc_feature (467)..(467): n is a, c, g, or t
  modified_base (624)..(624): a, c, t, g, unknown or other
  misc_feature (624)..(624): n is a, c, g, or t
tcagatacgacgtacacgaccggtgctcgatttagtgtcgtcgcaagagagagggggggtcgacaagaggcagcgctctcgggacgcctccaccatggcctgggctctgctgctcctcactctcctcactcaggacacagggtcctgggcccagtctgccctgactcagcctgcctccgtntcgtgggtcctccgtggacagtcgatccgaccgtctcctgacacgtgggaccagtatgtatttaggaattttcgaccttagtctcgtgtaccacactacccgcaactccctaagtatctatttanggaggcactagccgccctgaggtacgtttcngacgtcgtctttcctcgtcggacctaccgaaggcgttgggaccggtaccccgggtcctcccgtgaacctaagtactcgtacgggcctccgaggtcctgggtaacggacggnggcctactacttactacgngtctgcctactattacgtggtaacgttatcgactacggttgggttcggttcgggcgggaccggaaccaaggttccgtaccggtaccgtaaggtacgaccggtaccccgaaggcccttacccgcccccgttggtaccctacgttccgccgtttccccncccgttacccg

SEQ ID NO: 108890 - DNA, 555 bp, Homo sapiens
  misc_feature: GYAE6OF01B07UQ.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatccaccgtctcctgcactgggaccagtaatgtattttggaaattttgaccttagtctcctggtaccaacaataccccggcaaagtccccaagttaatcatttatgaggcactaagcggccctcaggtagtttctgatcgcttctctggctccaaggctggcgaccgggcctccctgacaatatcgtgggctccgagctggaggacgaggctcattactactgctgctcatagtggagttatagctacgttgggtggttcgggcgggcgggaccaaggtcgtaccgtcgtaacgtcgacgacccgaaggcctccgccccctcggtcctactcctcgttccccgcccttcccg

SEQ ID NO: 108891 - DNA, 550 bp, Homo sapiens
  misc_feature: GYAE6OF01DZ75T.12.71.G05.1.454.CMB.1.raw
  modified_base (284)..(284): a, c, t, g, unknown or other
  misc_feature (284)..(284): n is a, c, g, or t
  modified_base (330)..(330): a, c, t, g, unknown or other
  misc_feature (330)..(330): n is a, c, g, or t
  modified_base (447)..(447): a, c, t, g, unknown or other
  misc_feature (447)..(447): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtatttttggaaattttgacctagtctcctggtaccaacaatacccccggnaaacgtccccaagttaatcatttatgagggcactaagccggccctnaggtagtttctgatcgcttctctggctccaaggctggcgaccggcctccctgacatatctgggctccaggctggaggacgaggcctcaattactactgctgctcatagtggagttanagctacgttgggtgttcggcggcgggacaagtcgaccgtcgtaagtcgacgcccgaaggctccgtccccctcggtccacttcctccttcccctcccgttcccg

SEQ ID NO: 108892 - DNA, 591 bp, Homo sapiens
  misc_feature: GYAE6OF01ENTRR.12.71.G05.1.454.CMB.1.raw
  modified_base (282)..(282): a, c, t, g, unknown or other
  misc_feature (282)..(282): n is a, c, g, or t
  modified_base (306)..(306): a, c, t, g, unknown or other
  misc_feature (306)..(306): n is a, c, g, or t
  modified_base (437)..(437): a, c, t, g, unknown or other
  misc_feature (437)..(437): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaatacccccggnaaagtccccaagttaatcatttangagggcactaagcggccctcaggagtttctgatcgcttctctggctccaaggctggcgaccgggcctcctgacatatctgggctcaggctgaggacgaggctcattactactgctgctcatgtggagttanagctacgttggggtgttcgggcgggtaccgggacctaaaggtcggtaacccgttccgtaaaggttccgaacggccccgaaaggtcccgttccggccccccccgttcgggtccctaacccgttccgttcccgtttcccccgaccccctttccccg

SEQ ID NO: 108893 - DNA, 647 bp, Homo sapiens
  misc_feature: GYAE6OF01ED1XW.12.71.G05.1.454.CMB.1.raw
  modified_base (348)..(348): a, c, t, g, unknown or other
  misc_feature (348)..(348): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtgggaccagtaatgtattttggaaattttgacctagtctcctggtaccaacaactaccccggacaaacgtccccaaagttaactctaatttatgagggcaacgtaagccggccctgaggtagtttcngtactcgtcttctctggcctccgaaggctcggccgacccgggccctcccgtagaaccaattacgtcgtcgggccttacccgaggtctgggaacgggacggagggtcctacgtaatttacctacgtgtcctgctacagttagtggtagttatacgtcttacggttggggttcgttccgggcggtaccgggaacctaaaggtcggaacccgttccgtaagtccgacggacccgaacggtcctcccggtccccccgttacgggtcctaccgttcccttcccggttcccccgccccgttcccg

SEQ ID NO: 108894 - DNA, 543 bp, Homo sapiens
  misc_feature: GYAE6OF01B21YX.12.71.G05.1.454.CMB.1.raw
  modified_base (387)..(387): a, c, t, g, unknown or other
  misc_feature (387)..(387): n is a, c, g, or t
  modified_base (412)..(412): a, c, t, g, unknown or other
  misc_feature (412)..(412): n is a, c, g, or t
  modified_base (447)..(447): a, c, t, g, unknown or other
  misc_feature (447)..(447): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctcctgtaccaacaataccccggcaaacgtcccaaagttaatcatttatgaggcacgtaagccggccctcgaggtagtttctgatcgctttctctggctccgaaggctggcgaccggcctcctagacaatntcgtgggcctcgaggctgaggacgnggctcattactactgctgctcatagtggtagttanagctacgttgggtcgtcggcggcggacaaggtcgtaccgtactaagtcgacgcccgaggtcctccgccccgtcgtcacgtctcgtcccgcccgtcc

SEQ ID NO: 108895 - DNA, 696 bp, Homo sapiens
  misc_feature: GYAE6OF01ANN2I.12.71.G05.1.454.CMB.1.raw
  modified_base (314)..(314): a, c, t, g, unknown or other
  misc_feature (314)..(314): n is a, c, g, or t
  modified_base (353)..(353): a, c, t, g, unknown or other
  misc_feature (353)..(353): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctggtctcctggacagtcgatccaccgtctcctgcacgtcggaccagtaatgtattttaggaaattttgacctagtctcctggtaccaacaactaccccggacaaacgtccctaagttaactctaatttanggacggactacgtaacgccggccctagaggtacgtttcngtactcgtcttctcgtggtctaccgaaggtctcgggcccgacccgggtcccttcccgtagaacctaacgtacgtccgtcgggaccttaccggaggtccgtagggaacgggacggacggtcctacgtaacttaccgtacgtgtcctgccttacgtaagttagtagggtaggtttaatacggtcgttacgggtttggggttaccggttccggggaccggtacgggtaaccctaagggtccgtaacccgttaccgtaaggtccgaccgtacccgaacgggtcccttccccgcccccgttacggtaccctacccgttcccgttcccggttcccccgtcccttacccg

SEQ ID NO: 108896 - DNA, 523 bp, Homo sapiens
  misc_feature: GYAE6OF01DOTV7.12.71.G05.1.454.CMB.1.raw
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
  modified_base (341)..(341): a, c, t, g, unknown or other
  misc_feature (341)..(341): n is a, c, g, or t
  modified_base (376)..(376): a, c, t, g, unknown or other
  misc_feature (376)..(376): n is a, c, g, or t
  modified_base (435)..(435): a, c, t, g, unknown or other
  misc_feature (435)..(435): n is a, c, g, or t
  modified_base (501)..(501): a, c, t, g, unknown or other
  misc_feature (501)..(501): n is a, c, g, or t
  modified_base (509)..(509): a, c, t, g, unknown or other
  misc_feature (509)..(509): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctctggtaccaacaataccccggcaaagtcccaagttaanctatttangaggcactaagcggcctcaggtgttctgatcgcttntctggctcaaggctggccgacggcctcctgacatntcgtgggctcaggctgaggacgaggctcattactactgctgctcatagtaggtagttancgactacgttgggtgtcggcggacggacaagtcgacgtcgtaggcacgccaacgacccaacccctntcgcactntctcccgccctacg

SEQ ID NO: 108897 - DNA, 576 bp, Homo sapiens
  misc_feature: GYAE6OF01E2T4W.12.71.G05.1.454.CMB.1.raw
  modified_base (441)..(441): a, c, t, g, unknown or other
  misc_feature (441)..(441): n is a, c, g, or t
  modified_base (567)..(567): a, c, t, g, unknown or other
  misc_feature (567)..(567): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgcctcctgcactgggaccagtaatgtattttggaaattttgacctagtctcctggtaccaacaactaccccggacaacgtaccctaagttaactctatttatgacgggacactaacgcggccctcaggtagtttctgatcgtcttctcgtcgctacaaggcgtggcggaccgggcctcctgacaatagtcgtcgggctcgaggctggaggacgagctctattactactgctnctcatacgtggtagttgtagcgtacgttggggtcgtttcgggaccgggacggaaccgaaggtcgaccgttaccgagtcgacgaccgaacggccgtaccgccccgtcgtccactcctccgttccccnccgttcccg

SEQ ID NO: 108898 - DNA, 565 bp, Homo sapiens
  misc_feature: GYAE6OF01BACGV.12.71.G05.1.454.CMB.1.raw
  modified_base (312)..(312): a, c, t, g, unknown or other
  misc_feature (312)..(312): n is a, c, g, or t
  modified_base (447)..(447): a, c, t, g, unknown or other
  misc_feature (447)..(447): n is a, c, g, or t
  modified_base (461)..(461): a, c, t, g, unknown or other
  misc_feature (461)..(461): n is a, c, g, or t
  modified_base (557)..(557): a, c, t, g, unknown or other
  misc_feature (557)..(557): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctcctggtaccaacaactaccccggacaaacgtccccaaagttaactctatttangagggcacgtaagccggccctgaggtagtttctgatcgcttctctggctccgaaggctggcgacccgggcctccgtgaccaatatcgtgggctccgaggtctggaggacgaggtctacattactactgtctgctnatagtggtagttanagtcgagttggggtcgttcgggacggcgggacaagtcgaccgtcctaagtcgacgcccgtaaggcctcgcccctcggtccacgtctccgttccccncccttccg

SEQ ID NO: 108899 - DNA, 503 bp, Homo sapiens
  misc_feature: GYAE6OF01AILZZ.12.71.G05.1.454.CMB.1.raw
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (382)..(382): a, c, t, g, unknown or other
  misc_feature (382)..(382): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggagtgataagtttgtctcctggtaccacatcacccaggcaagccccagactcatgatttatgaggacaaaaacggccctcggggattctaatcgcttctctgctcagtctgcacncggcctccngacatctctgggctcgnggctgaggacgaggctgattagttactgtctgctcactatgtctaggtagtcggactcgttcgctactagttcgggacgagggacacggctcgtaccgtcttacgcacgcccgaggtcccg

SEQ ID NO: 108900 - DNA, 575 bp, Homo sapiens
  misc_feature: GYAE6OF01A84Q4.12.71.G05.1.454.CMB.1.raw
  modified_base (303)..(303): a, c, t, g, unknown or other
  misc_feature (303)..(303): n is a, c, g, or t
  modified_base (441)..(441): a, c, t, g, unknown or other
  misc_feature (441)..(441): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccatctcctgcactggaccagcagtgatgttggacttataaccttgtctcctggtaccaacaacacccaggcaaacgcccccaaactcatgatttangaggcactaacgcggccctcgtagggtttctatcgtcttctctggctccgagtctggccaacgaccggcctcccgtgactaactctacgtcgggctccaggctggaggacgagggcggtattacttctgttgctcatntggcgggtatacgctactttcgattcgtacctagttcgggacgggacgggtaccaacggtcgtacggtacccggttccgtacgggtaccaacggtcccgaaacgggtcctccggcccccccgttgggttacccc

SEQ ID NO: 108901 - DNA, 528 bp, Homo sapiens
  misc_feature: GYAE6OF01EZL8F.12.71.G05.1.454.CMB.1.raw
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacngcacccaggcaaacgcccccaactcctgatttangagtcactattcggtctcaggtatttctaatcgcttctctgtcagtcngcacncgcctccngaccatctcgtgggtccaggctgacggacgaggctgtattattacgtgctagttcaatatacaagctacttccaacttctcggtggttgttcgggcggtcggaccaagctcgacccgtctaagtcagccaggctcgcccctcggtcactctcgtccctaccc

SEQ ID NO: 108902 - DNA, 539 bp, Homo sapiens
  misc_feature: GYAE6OF01D2H31.12.71.G05.1.454.CMB.1.raw
  modified_base (351)..(351): a, c, t, g, unknown or other
  misc_feature (351)..(351): n is a, c, g, or t
  modified_base (442)..(442): a, c, t, g, unknown or other
  misc_feature (442)..(442): n is a, c, g, or t
  modified_base (457)..(457): a, c, t, g, unknown or other
  misc_feature (457)..(457): n is a, c, g, or t
  modified_base (531)..(531): a, c, t, g, unknown or other
  misc_feature (531)..(531): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaaagtccccaagttaatcatttatgaaggcactaagcggccctcaggagtttctgatcgcttctctggntccaaaggctggcaaccgggcctccctgacaatatctgggctccaggctgaggacgaggctcattacaactgctgctcatactggagttanaagtcacttcgggtnttcgggcgtcgggaccaaaagtgaccgtcctaagtcagcccaaaggctagccccctcggtcaactctgttcccnccctcccg

SEQ ID NO: 108903 - DNA, 533 bp, Homo sapiens
  misc_feature: GYAE6OF01EQ2YR.12.71.G05.1.454.CMB.1.raw
  modified_base (295)..(295): a, c, t, g, unknown or other
  misc_feature (295)..(295): n is a, c, g, or t
  modified_base (419)..(419): a, c, t, g, unknown or other
  misc_feature (419)..(419): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttggacttataaccttgtctcctgtaccaacaacaccagcaaacgcccccaaatcatgatttangaggcactaagcgcctcgtagggtttctatcgcttctctggctccgagtctggcaacgaccgccctccctgacatctcgtgggcctccgaggctggacggacgaggcgtattatactgttgctnatgtggcggtatcgctactttcgattcgtaccttagtcgggacggacggaccaaggtcgtaggacccgttcgtcgggtccacggtacccgaaggccctccgcccccgtggtccc

SEQ ID NO: 108904 - DNA, 267 bp, Homo sapiens
  misc_feature: GYAE6OF01EH3LI.12.71.G05.1.454.CMB.1.raw
  modified_base (262)..(267): a, c, t, g, unknown or other
  misc_feature (262)..(267): n is a, c, g, or t
tcagatacgacgtacacgaccggtgctcgatttagtgtcgtcgcaagagagagggagggccagctgctgggagcgtctacatatttcgacccctggggccagggaacccaggtcaccgtctcctcagcctccaccaagggcccatccgtcttccccctggcgccctgctccaggagcacctccgagagcacagcggccctgggctgcctggtcaaggactacttcctacgtcgtatctgagcgggctggcaaggcgcatagnnnnnn

SEQ ID NO: 108905 - DNA, 897 bp, Homo sapiens
  misc_feature: GYAE6OF01CFN64.12.71.G05.1.454.CMB.1.raw
tcagatacgacgtacacgaccggtgctcgatttagtgtcgtcgcaagagagagggggggggtcacaagaggcagcgctctcgggacgcctccaccatggcctggctctgctgctcctcactctcctcactcaggacacgagggtcctgggcccagtctgccctgactcagcctgcctccgtgtcgtgggtctccgtggacagtcgatccaccgtctcctgcacgtgggaccagtaatgtaattttggaaatttgaccttagtctccgtaggtaccaacaacgtacccggacaaaacgtcccctaaaagtttactctatttaagtcggaacgggactaaccgtaaacggcccggtacccttagtaagggttacgttttaccaggtaacgtccgtcctttctcgtcggtccttacccgaaggggtccgttcgggacccggaaccccggggtcccctacccgttagggaaccttaaacgttaccgttccgtacggggtccttaccgtacgggtaccggttacgggaacgggtaaccggtaacggtaccgttaccgttaacgtttaaccgttaaccgttcggtacgttccgtacgtaccgttaacgttaacgggttacgggttaaacggtttaacggttaacgtaccgtttaaccgggttttacgggggtttcggggtttacccgggggtacccggggtaaccgggggtaacccggtaaaaacgggttacccgggtaaccccggttaaacccggttaaacgggttacccgaacccgggttaacccccggaaacgggttccccgttaaccccgggttccccccggttacccgggttaccccgttaacccgttccccgtttacccccggtttccccccgttaaccccccggttttaacccccg

SEQ ID NO: 108906 - DNA, 697 bp, Homo sapiens
  misc_feature: GYAE6OF01EXDG6.12.71.G05.1.454.CMB.1.raw
tcagatacgacgtacacgaccggtgctcgatttagtgtcgtcgcaagagagaggggagtgaggagcagcgctctcgggacgcctccaccatggcctgggctctgctgctcctcactctcctcactcaggacacgagggtcctgggcccagtctcgccctgactcagcctgcctccgtgtcgtgggtcctccgtggacagtcgatccaccgtctcctgcacgtggacctagtaatgtattttaggaaattttgaccttagtcctccgtacggtaccaaccaactaccccggacaaacgtacccaagttaactactaatttatggaggactaacgtaacgcggaccctacgtacggtagtttctggtacttcgtcttccgtctcggtacgtccgaaggtcgtacgggtccgacccgggtccctcccgtacgaactaacgttacgttccgtacggtcctacccggtacggtaccgtacggaacgggaccggtacgggtccttaacgtaactttaaccgtacgtcgtccgtgcctactaagttagtgggtaagttacgtaggtcgttacggttgggttacggttccgggacggtacgggtacgtaaacggtcgtaacccgtaccgtaagtccgacgtacccgacggtccgtcccgtccccgtcgtacctaccttccgttacccgttccctcccgttacccg

SEQ ID NO: 108907 - DNA, 526 bp, Homo sapiens
  misc_feature: GYAE6OF01A8TUI.12.71.G05.1.454.CMB.1.raw
  modified_base (522)..(522): a, c, t, g, unknown or other
  misc_feature (522)..(522): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaacgccccccaatcctgatttatgaggtcactattcggtcctcaggtaatttctaatcgcttctctggttccaagtctggcaacacggcctccctgaccatctcgtcggggtccaggctggaggacgaggctgattattactgctagttcatatacagcacttccactctcgtggtgttcggcggtggaccagtctgacctctaagtcacgcccaggctcgcccctgtcactctcgtcccncctc

SEQ ID NO: 108908 - DNA, 847 bp, Homo sapiens
  misc_feature: GYAE6OF01ASXS2.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactggaccagtatgtatttggaatttgactagtctcctggtaccaacaactacccggacaaacgtacccctaagttaactctatttatggaggcaacgtaacgccggccctacgaggtagtttctagtactcgtcttctcgtcggtctaccgaaggtctcggccgacccgggtccctcccgtagaacctaagttacgtccgtgggtaccctaccggtacggtacgtacgggaagggtacccggtacggggtaccccttaaccgtaacgtttaacccgttaccgttacggtccgtaggtccccttaacgtagtttaacgggttagggttaacggtttaacgtaaccgggtaccgtttaacggtttcggggggttaccggtttaccggggtacccggggtaaccccggggtaaaccggttaaaaccgggttacccggggttaaaccccggtttaaaccccgggttaaaaccgggttaccccggtaaaccccggtaacccccggtaaacccggggttccccgttaccccccgggttaccccccccggttaccggggtttaaccccctacccggttttacccccgttacccccgggtttaccccccccttacccccggttttaacccccccgg

SEQ ID NO: 108909 - DNA, 780 bp, Homo sapiens
  misc_feature: GYAE6OF01EZUBF.12.71.G05.1.454.CMB.1.raw
  modified_base (359)..(359): a, c, t, g, unknown or other
  misc_feature (359)..(359): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctcgccctgactcagcctgcctccgtgtctgggtctccgtggacagtcgatcaccgtctcctgcacgtggaccagtaatgtattttaggaaattttcgaccttagtctcctggtaaccaacaactaccccgacaaacgtcccaaagttaactctaatttatggagggctaacgtaacggccggcccgtacgaggtacgtttcnggtattccgtccttctcgtcggctaccgaaggtcgtgggcccgacccggggtccctacccgtagtaacctaagttacgttccgtgggtccgttaccgaggtccgttaagggaacggggaaccgtacgggtccttaccgtaagtttaacctacgtcgtaccgtagtcccgttactaagttacggttagggtacggtttaagtacgtaccgttacgggtttgggggttacggtttccggggacggggtacccgggtaaccgtaaagggtccggttaaacccggttaccgtaaacggttcccgaacccggtaaccccggtaacggggttccccttaccccgggtacccccccgtttacgggttacccctacccggttacccccgtttacccggtttccccccccgaaccccgttttacccccgg

SEQ ID NO: 108910 - DNA, 725 bp, Homo sapiens
  misc_feature: GYAE6OF01C0YBA.12.71.G05.1.454.CMB.1.raw
  modified_base (309)..(309): a, c, t, g, unknown or other
  misc_feature (309)..(309): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctcgtgtctgggtcctcctggacagtcgatcaccgtctcctgcacgtgggaccagtaatgtattttggaatttgacctagtctcctgtaccaacaactaccccggacaaacgtccccaaagttaatctatttagnggacggcactaacgccgccctcgaggtatttctgtatcgcttctcgtggctccgaaggtctcggccgacccggtcctcctagactaatactcgtcggacctccgaaggtcgtaggacgggtaccggagtccttacgtaactttaccgtaccgtgccgttacgtccttacgtagttacggtagggttaaggtttactacggtaccgttacggttttcgggggtcggtttccggggaccgggtaccgggtaaccgtaaacgggttccggtaaccccggttaccgttaaggtccccggaaaccgggtaccccgtaaaccggggtccccttaaccccgggtcccccccgtttacggggttaccccttaccccggttcccggttttaccccgttacccccccgttaaccccgtttcccccg

SEQ ID NO: 108911 - DNA, 647 bp, Homo sapiens
  misc_feature: GYAE6OF01ELQ5R.12.71.G05.1.454.CMB.1.raw
  modified_base (228)..(228): a, c, t, g, unknown or other
  misc_feature (228)..(228): n is a, c, g, or t
  modified_base (264)..(264): a, c, t, g, unknown or other
  misc_feature (264)..(264): n is a, c, g, or t
  modified_base (287)..(287): a, c, t, g, unknown or other
  misc_feature (287)..(287): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgctggagtgatagttgtctctgtaccantcaccaggcaacgccccagactnatgtattagtgaggacgaaaaaccggccgtacgggtactttctaatcgtacttctcgtcggtctaccgtacgtcgtacggaccaaccgaccggtccctcccgtagacctaactcgttacgtcgggtcctccgaggtccgtaggacggacggtaggtacgttaggtatttacgttaacctggtacgtcacggtctaagttggagttacgaccgtacgtccgttaaggtaacggttcgggttacccggttaggttaccggggaccgggtaaccgggtaacccgaacggtcccgttacgggtaaccccgttaccggttacgggtacccaaccggtacccggtaaacgggtcccgtacccccgg

SEQ ID NO: 108912 - DNA, 783 bp, Homo sapiens
  misc_feature: GYAE6OF01BDFLM.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatccaccgtctcctgcacgtgggaccagtatgtattttaggaaattttgaccttagtctcctggtaccaacaactaccccggacaaacgtccccaagttaatcatttatgagggcacgtaagccggccctacgaggtacgtttctgatcgacttctcgtggtctacgaggctcgggccgacccgggcctcccgtagactaatacgtccgtcggggtcctccgaggtccgtagggacgggaccgacgggtctacgttacttaacctacgtcggtaccttcggtaccttactaacgtttacgggttaagggtacgggttttaacgttacggtaccgttaacgggttttcgggggtttaccgggtttacccgggggacgggggttacccggggtaaacccggtaaacgggttacccgggtaaccccgggtttacccttaaaccggggttacgtaccccggggtaaccccgtaaacgggggtccccttcccccggggtccccccccgtttacgggggtcccctttaacccggttacccgttttacccccgggttcccccccgttacccccgttttaccccccgg

SEQ ID NO: 108913 - DNA, 579 bp, Homo sapiens
  misc_feature: GYAE6OF01D9R0Q.12.71.G05.1.454.CMB.1.raw
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctcctggtaccaacaactaccccggacaaacgtccccaagttaatcatttatgaggcactaacgcggccctnaggtatttcngatcgcttctctgctcgaaggctggcgaccggcctcctgacaatatcgtggctcgaggctgagacgaggctacattactactgtctgctctatagtggtagttatagctacggtttgggtgttacgggcggtaccgggaaccgtaaaggtcgtaccgtaccgtaagtccgacgacccgaacggtcctaccgtcccccgtacggtcccaccgttcttcccgttccccgaccccttccccg

SEQ ID NO: 108914 - DNA, 790 bp, Homo sapiens
  misc_feature: GYAE6OF01AK02W.12.71.G05.1.454.CMB.1.raw
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcacgcctgcctccgtgtctgggtctcctgacgagtcgatcgaccgtctcctgcacgtgggacctagtaatgttatttaggtaaattttcgaccttagtcctaccgtacggtaaccaaacaacgtaccccggactaaaccgtacccctaagttactactatttacgaggaggtaccacgtacgcccggtaccctagtacggttacgtttcgtagtacgttccggttctttccgtacgtcgggtacccctaccggtaaacgggtccgtccgggaccccgggtaccccgggttcccctaccgtagtaaacctaacgttacggtccggttacgggtccctaccggtacggtccggttaagggaccgggtaacgggtacgtaccgtaccttaacgttaccgttacgtacgtcgttacgtaccctataaggttacggtacggttaagttaacgtacgtaccggttagggttcgggttaccgggttaccggggacgggttaccggaaccggttaacggccggtaccgttaccgtaacgggtccgaaccggtacccgtacgggtccccttaccccggtaccccgttacgtaccctccgttaccccgtacccgtttccccccgtacccgtttccccgg

SEQ ID NO: 108915 - DNA, 719 bp, Homo sapiens
  misc_feature: GYAE6OF01DFUV8.12.71.G05.1.454.CMB.1.raw
  modified_base (337)..(337): a, c, t, g, unknown or other
  misc_feature (337)..(337): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtggaccagtaatgtattttggaaattttgacctagtctctagtaccaaacaactaccccggacaaacgtccccaaagttaactcatttatgaggcaactaagccgaccctcaggtattttcngtactcgtacttctcgtacggccgttaccgaagggtcgtcgggcccggtaacccggggtcccttcccgtaacgaccgtaaactacgttccgtcggggaccttaccggaacggtccgtagggaacgggaaccggaagggtccctacgttaaacgttaacctacgttcgattcggtacctactaagttacgtcgggtaagttttagaacgtcgtaacggtttggggtcgttccgggcgggtaccgggtaacctaagggttccgtaaccgtaccgttaaggaccgaaccggtaccccgtaaacgggtcccgtaacccccggtcccccgtttacggtacccttacccgttcccgtttccccggtaccccccttccccgttaccccg

SEQ ID NO: 108916 - DNA, 606 bp, Homo sapiens
  misc_feature: GYAE6OF01DYJL0.12.71.G05.1.454.CMB.1.raw
  modified_base (332)..(332): a, c, t, g, unknown or other
  misc_feature (332)..(332): n is a, c, g, or t
  modified_base (430)..(430): a, c, t, g, unknown or other
  misc_feature (430)..(430): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtgggaccagtaatgtattttaggaaattttgacctagtctcctggtaccaaacaactaccccggcaaacgtccccaagttaatcatttatgagggcactaagcggccctanaggagtttctgatcgcttctctggctccgaaggtctggcgaccggcctccctgacaatatcgtggctccgaggctggaggacgaggctcattactacngtctgctcattagtaggtagtatagacgtacgttggggtgttccgggcgggtaccgggacctaaaggtcgtacccggttccgtaaagttccgacggtacccgaacggtcctacccggccccccgttacgggtaccctaccgttcccgttcccgttcccccgtccccgtttaccccg

SEQ ID NO: 108917 - DNA, 289 bp, Homo sapiens
  misc_feature: GYAE6OF01CDHQD.12.71.G05.1.454.CMB.1.raw
  modified_base (179)..(179): a, c, t, g, unknown or other
  misc_feature (179)..(179): n is a, c, g, or t
  modified_base (195)..(195): a, c, t, g, unknown or other
  misc_feature (195)..(195): n is a, c, g, or t
  modified_base (268)..(269): a, c, t, g, unknown or other
  misc_feature (268)..(269): n is a, c, g, or t
  modified_base (272)..(289): a, c, t, g, unknown or other
  misc_feature (272)..(289): n is a, c, g, or t
tcagatacgacgtacacgaccggtgctcgatttagtgtcgtcgcaagagagagggagggccagctgctgggagcgtctacatatttcgacccctggggccagggaacccaggtcaccgtctcctcagcctccaccaagggcccatccgtccttccccctggccgccctgcctccaggancacctccgagagcacngccggccctgggctgcctggtcaaggactacttccacgtcgtatcgtgagcgggctggacaagggcacatagnngannnnnnnnnnnnnnnnnn

SEQ ID NO: 108918 - DNA, 657 bp, Homo sapiens
  misc_feature: GYAE6OF01ACMP7.12.71.G05.1.454.CMB.1.raw
  modified_base (316)..(316): a, c, t, g, unknown or other
  misc_feature (316)..(316): n is a, c, g, or t
  modified_base (350)..(350): a, c, t, g, unknown or other
  misc_feature (350)..(350): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacgagggtcctgggcccagtctcgccctgactcagcctgcctccgtgtcgtgggtctccgtggacagtcgatccaccgtctcctgcacgtggaccagtaatgtattttggaaattttgacctagtctcctggtaccaacaactacccggacaaacgtcccctaagttaactctatttagnggacggcaactaagccggtccctgaggtgtttcngactcgtcttctcgtgcctccgaaggtcgtacggccggacccgggtcctccctgactaaatcgtcgtcgggcctcgaggtcgtaggacgggacgacggtctactaacttacctacgtcgcgttcgcctacagttagtgggtaacgtttaatacggtctaaccgggtttgggtcggttacgggcgggtaccgggaacctaacgggtccgacccgttaccgtaacggtccaccggacccgaacggtcccgttacccgccccccgttgtaccctacccttccgttcccgttcccccgtcccctttacccg

SEQ ID NO: 108919 - DNA, 751 bp, Homo sapiens
  misc_feature: GYAE6OF01CIP8Y.12.71.G05.1.454.CMB.1.raw
  modified_base (305)..(305): a, c, t, g, unknown or other
  misc_feature (305)..(305): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcacatctcctgcacgtgggaccagcagtgatggttgggacttataaccttgtctcctggtaaccaacaacacccaggaccaaacgcccccaaactcactgatttangaggcactaagccgcctcgtacgggtttctagtcgtcttctctggtctccaaggtctggccgacccgggcctccgtagaactaatactcgtcgggtacctccgacggtcgtacggacgggtaaccgagggtaccttacgtaacgtttaccgtaacgttcggtccttacggtaccttaccgtaagtttaacggttacgggttaacgggttttaaacgtacgggttaccgttaacccggtttttaggggggttacccggttttccgggggaacccgggggttaacccggggtaaacccgtaaaacggggttaccgtaaaccccgggtttaaccgttaaaacgggttcccgtaaacccggggtaaccccgtaaaccgggtcccgttaccccgggtacccccccgtttaccgggttaccccttaacccggtttcccgtttaaccccccgg

SEQ ID NO: 108920 - DNA, 613 bp, Homo sapiens
  misc_feature: GYAE6OF01ARP4N.12.71.G05.1.454.CMB.1.raw
  modified_base (229)..(229): a, c, t, g, unknown or other
  misc_feature (229)..(229): n is a, c, g, or t
  modified_base (529)..(529): a, c, t, g, unknown or other
  misc_feature (529)..(529): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcaccctcctcactcagggcacagggtcctgggcccagtctgccctgactcagcctgcctccgtgtctgggtcctcctggacagtcgatcaccatctcctgcactggaaccngcagtgacgttggtgttatactatgtctctgtaccaacagccaccagcacgacgaccccaactcatgtattttgatcgtcacttaacgtccgccctcgtacgggtttctgactcgcttctctgtctaccagtctcgactacgaccgtccctccgtcgacctactcctacggtcgggtcctaccggaggtcgtggaacgggaccggtaacggtcttacggttaatttacgttacgttcgtacgtaccgtctaaccgtaataacctaacgaacgtccgaacgcctacgacccttacccgttntttaccgtcgttacgggtaacggtacggaccgtaacgtccctaaccgtccctacgccgaacgacccctaacggcccctaacccg

SEQ ID NO: 108921 - DNA, 669 bp, Homo sapiens
  misc_feature: GYAE6OF01CQGCV.12.71.G05.1.454.CMB.1.raw
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctcgtgtctgggtctcctggacagtcgatcaccgtctcctgcacgtggaccagtaatgtattttggaaattttgacctagtctcctaggtaccaacaactaccccggacaaaacgtccccaaagttaactctatttagagaggcactaacgccggtccctagaggtactttctagtactcgtctttctcgtggcctaccgaaggtcgttaggccggtacccgggaccctccctagtacctaataacgtcgtacgggctacccgaggtcgtaggacggacgacggcttacaacgtttactacgtcgtctgtacctactactaggttggtaacgggtttataacggtattacgggtttagggttcggtttaccggggcgggtaacgggtaaccgaaagttccggtaaccgttaccgtaaggtacccacggtacccgaaaggtcccgttacccgcccccgtcgttacctacccttccgttccggttcccccgtcccttacccg

SEQ ID NO: 108922 - DNA, 764 bp, Homo sapiens
  misc_feature: GYAE6OF01A9WXF.12.71.G05.1.454.CMB.1.raw
  modified_base (600)..(600): a, c, t, g, unknown or other
  misc_feature (600)..(600): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtccgtggtcctcgtgactacgtcgactccgaccgtcctccgtgcctacggtccgggaacctaagttaatgttagttttaggttaaatttcgaccttagtcctccgtacggtaaccaactaaccgtaccccgaataaaccgtaccctaaagttaactactaatttacgtagggacggacctaacgtaacggcccggtaccctacggaggtttacgtttcgtagtacgtccgttcctttacgtccgtcggtaccctaaccggaacggtcgtaccgggcccggtacccgggtcccctaccggtaacgaaacttaacgtccgtcgggtcgtcccgtaccggaacggtcgtaagggaccgggaacggacggtcctacttaacgttactacgtcgtcgtcaccttatagttaggtaggtagttanagtaccgttgggttgggttcgggtcgggacgggaccgggtaacgtaagggtcccgtaaccgttaccgtaaccgtccgaaccggtacccggtaacggtccccgtaccccgtccccgttaccgtcctacccgtttccgtaccccggttcccccttcccgttacccg

SEQ ID NO: 108923 - DNA, 594 bp, Homo sapiens
  misc_feature: GYAE6OF01BVMP7.12.71.G05.1.454.CMB.1.raw
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (296)..(296): a, c, t, g, unknown or other
  misc_feature (296)..(296): n is a, c, g, or t
tcagatacgacgtacacgaccggtgctcgatttagtgtcgtcgcaagagagaggggggggtcacaagaggcagcgctctcgggacgcctccaccatggcctggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctctgtacaanaatacccgnaaagtcccaagttatcatttangaggcactaagcggccctagaggtagtttcagattcgtcttctctggctccgaaggtctggccgaccgggccctccgtgactaatacgtcgtgggctccgaggtctaggacggacgaggctacattactactgcttgctacatacgtggtaaggttactaggtctaccgttggggtcgttcgggccggtacgggacctaaaggtcggtaacccgttcgtaaacgtcgaacgtccccgaagggtccctacggccccccttcgggtcctacgttaccttccgttccccgtcccttacccg

SEQ ID NO: 108924 - DNA, 626 bp, Homo sapiens
  misc_feature: GYAE6OF01CRQ8O.12.71.G05.1.454.CMB.1.raw
  modified_base (325)..(325): a, c, t, g, unknown or other
  misc_feature (325)..(325): n is a, c, g, or t
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
  modified_base (471)..(471): a, c, t, g, unknown or other
  misc_feature (471)..(471): n is a, c, g, or t
  modified_base (502)..(502): a, c, t, g, unknown or other
  misc_feature (502)..(502): n is a, c, g, or t
  modified_base (573)..(573): a, c, t, g, unknown or other
  misc_feature (573)..(573): n is a, c, g, or t
  modified_base (617)..(617): a, c, t, g, unknown or other
  misc_feature (617)..(617): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctcgtgtctgggtctcctggactagtcgatccaccgtctcctgcacgtgggaccagtaatgtatttaggaaattttcgaccttagtctccgtacggtaaccaactaacgtacccggactaaaccgtcccctaaagttaactctatttagnggtacggacaacgtaacgccgcctgaggtgttcngtactcgtcttctcngtctacgaacgtcgtcggccgaccggtcctccgagtactaagtctcggtcggtctccggaggtctagggacggtacggacgtctactacttacgtancgtctgtctacattacgtgggtatttaacgngtacgtggttgggtacggttccggcgggtaaccgacgtaagtcggtacccgtacgtacgtccgaccggacncggtctccccgtcccgtacgtcctaccttccgtcccgttccccncccgttccg

SEQ ID NO: 108925 - DNA, 569 bp, Homo sapiens
  misc_feature: GYAE6OF01BYRNM.12.71.G05.1.454.CMB.1.raw
  modified_base (326)..(326): a, c, t, g, unknown or other
  misc_feature (326)..(326): n is a, c, g, or t
  modified_base (456)..(456): a, c, t, g, unknown or other
  misc_feature (456)..(456): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaactaccccggcaaacgtccccaagttaatctatttatgaggcactaagcggcctnaggtagtttctgatcgtcttctctcggctccgaaggctgggccgaccgggcctcccgtgacctaatacgtcgtgggcctacgaggctggaggacgaggctacattacactgctgctcatagtggagttanagctacggttgggtgttcgggcggacgggacctaagtcgaccgtccgtaagtcgacgacccgaaggtcctccgcccccgtcggtccacgttcctccgttccccacccttcccg

SEQ ID NO: 108926 - DNA, 956 bp, Homo sapiens
  misc_feature: GYAE6OF01ACVGU.12.71.G05.1.454.CMB.1.raw
tcagatacgacgtacacgaccggtgctcgatttagtgtcgtcgcaagagagaggggagtgaggagcagcgctctcgggacgcctccaccatggccgtgggctctgctgcctcctcactctcctcactcgaggacacgagggttccgtgggcccctagtccgtcgccctgacctcgacgtcctcgtcccgttcggtacgttcggtcggttcctccgtaggtactaggttccgaacttcccgtacccgttcctccgtgaccgtacggtacgggaacctaagttaacgtttgttaacgtttttaaggttaaacgtttttcgaaccgttacgttccgttaccgtacggtaaaccaaaccgtaaccgtaccccggaactaaaccggttacctaaagttactacgttaatttacggaggtacggtacaacgtacgcccggtccgtagtaggtttacgttcgtacgtacgttaccgttctttcgtccgtaccggaccgttaacgacgggtcccggtcgggtaaccccggtaccccggttcccttaaccgtacgtaaacgtttaacggtaccggttccgggtacccgttcccgaaccgggtacggtcggttaaaccggggaccggtaaccggttaccgttaaccgtttacccgttaaacgtttacccggtaacgtccgggtacttacccggttaacgttacggttaacgttttacgggtaacggttttaaacgttaaccggttacgttacccggggtttaggggtttcggggtttacccggggtaaccgggaccccggggtaaacggttaaaccgggtaaccgggttaacccgtacccggttaaacgttaaccggaacccgtacccgggtaacccggttaccgtcccccgggtacccccgtcccggttaaccgtcccgtttaccgttccccggttacccccggttcccttcccggtttaccccg

SEQ ID NO: 108927 - DNA, 823 bp, Homo sapiens
  misc_feature: GYAE6OF01AOEUB.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggcgtctgctgctcctcactctcctcactcaggacacagggtcctgggcccagtctgccctgactcagcctgcctccgtgtctgggtctcctggacagtcgatcaccgtctcctgccactcgggaccagtaactgattttggaaattttgacctagtctcctgtaccaacaatacccggcaaacgtcccaaactcatgattactgaggcactaagcgccctcgtaggggtttcttactcggtcttcgtcctggcctccgtacgtcttcgggaccaaccgacccgggtccctacccgttacggaaccctaaagttcccgttccgttacggggtcccgtcccgtacgggtacccgtagggaacggggaacccggtaacggggaccgggtaaacgttttaacgtttaaccggttcgtttacgggtccgttaccgtaacgttaacgttcgggtacgggggtttaacggttagggtaccctttaacccggttttacggaaccgttttccggggtaccctttaacgggttttacccggggacccgggggtaacggggtaaccccgtaaacgggtccgttaccggggtacccccgggttaacccggtttccgggggttacccgaccgggtcccccggttaaacccgggtcccggttcccggtacccccccccggttcccgggttacccctaacccgtttcccggttacccggtttaccccccccccg

SEQ ID NO: 108928 - DNA, 624 bp, Homo sapiens
  misc_feature: GYAE6OF01EVNLS.12.71.G05.1.454.CMB.1.raw
  modified_base (304)..(304): a, c, t, g, unknown or other
  misc_feature (304)..(304): n is a, c, g, or t
  modified_base (372)..(372): a, c, t, g, unknown or other
  misc_feature (372)..(372): n is a, c, g, or t
  modified_base (391)..(391): a, c, t, g, unknown or other
  misc_feature (391)..(391): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggaccagtcgatcaccgtctcctgcactggaccagtaatgattttggaaattttgacctagtctcctggtaccaacaatacccggcaaagtccccaagttaatccatttangaggcacgtaagcggccctcaggagtttctgatcgcttctctgctcaaggctggcgaccgggcctccngacatatcgtgggctccgngcctggaggacgaggctacacttaactacgtgtccgtgtactacaagttacgtaggtaacggtttataaggtacctacgtttggggttgttaccggggcgggtaccgggaccaaaaggtcggtaaccgttacccgtaaagttcgaacggttccccgaaagggttcctacccggtacccccccgtagggttacccgaaccttccggttccgtttccccccggcccctttccccg

SEQ ID NO: 108929 - DNA, 767 bp, Homo sapiens
  misc_feature: GYAE6OF01CUMZD.12.71.G05.1.454.CMB.1.raw
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctcgtgtctgggtctccgtggacagtcgatccaccgtctcctgctacgtgggacctagtaatgtattttggaaattttgacctagtctccgtgtaccaacaactaccccggacaaacgtccccaaagttaatctatttatgaggcacgtaagccgcctcgaggtagtttctgatcgtcttcgtctggctaccgaaggccgtcgggaccggacccgggtccctcccgtagacctaaatacgttccggttacgggccttacccgagggtccgtagggacggggtaacggacgggtaccttaccgtaacgttttaaacccgtacgttcggacctttcggacccttaccgtaagtttaaggtggggtttaaacgggtttaactacgggtaacccgtacgggtttttagggggttcggtttaccgggggaccgggttaaccggggtaacccgttaaaacggttccggtaaaccccgggttccgttaaacggtacccggtaaccggtacccccggtaacgggttccccgttcccggacccccggtttccgggttacccacccgtttacccgttccccgtttaacccccctccccgttaaccccg

SEQ ID NO: 108930 - DNA, 821 bp, Homo sapiens
  misc_feature: GYAE6OF01C8DNJ.12.71.G05.1.454.CMB.1.raw
  modified_base (734)..(734): a, c, t, g, unknown or other
  misc_feature (734)..(734): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctcactcaggacacgagggtcctgggcccagtctcgccctgactcagcctcgcctccgtgtcgtgggtcctcctggacagtcgatccaccgtcctcctgcacgtcgggacctaagtaattgtagtttttaggtaaattttcgaccttgttccttccgtacggtaacccaaacgtaacctacccccggactaaaaccgtaccccgtaaagtttaactactaacttttagaggtacgggacactaacggcccggtccctacgtaggtacttttcgtgtactccggttccttctcggtccggtccctaccggaacggtccggtcgggacccggtaccccgggtcccttacccgtaacgaaccgtaattaccggtcgggtccgggtccgttacccggacgggtccggtacgggaaccggggtaacggtaccggtccgtttaaaccttaacggtttaacccttacggttccgtccggttaccgtccttacgtaacggtttaggttaaggggttacgttttaaggtcgttaaccggtttcgggttttacgggggttccggtttacccgggggaccgggtaaccgggtaccgtaacggttacccggtaccctaccggtaacncccgaaccggacccggtaccggtcccgtccccgtccccgtcggttacccttacccgtcccgtttccccgtccccttccctttacccg

SEQ ID NO: 108931 - DNA, 272 bp, Homo sapiens
  misc_feature: GYAE6OF01BS7WO.12.71.G05.1.454.CMB.1.raw
  modified_base (262)..(272): a, c, t, g, unknown or other
  misc_feature (262)..(272): n is a, c, g, or t
tcagatacgacgtacacgaccggtgctcgatttagtgtcgtcgcaagagagagggagggccagctgctgggagcgtctacatatttcgacccctggggccagggaacccaggtcaccgtctcctcagcctccaccaagggcccatccgtcttccccctggccgccctgctccaggagcacctccgagagcacagcggccctgggctgcctggtcaagactacttcctacgtcgtatctgagcgggctggcaaggcgcatagnnnnnnnnnnn

SEQ ID NO: 108932 - DNA, 655 bp, Homo sapiens
  misc_feature: GYAE6OF01A1DMJ.12.71.G05.1.454.CMB.1.raw
  modified_base (118)..(118): a, c, t, g, unknown or other
  misc_feature (118)..(118): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctnactctcctcactcaggacacagggtcctgggcccagtctgccctgactcagcctgcctccgtgtcgtggtctccgtggacagtcgatcaccgtctcctgcacgtggaccagtaatgtattttggaaatttgactgtctcctggtaccaacactacccggacaaacgtccccaagttaactctatttatgagggctactaagccggccctgaggtatttctagtactcgtcttctctaggccttacaaggctggccgaccgggcctccgtagaccatacgtcgtggactcgaggctgaacggtcgacgtactcgtattactacgtgccgttagtctacgaattggtggttaacgttagtacgtacggttagggtttcgggttacgggttaccggggtacggacccgggtaaactaagggtaccggtacccgttacccgtaacggtacccgacggaacccgtacggttccgcccccgtaccccgttccgtaacccgtccgttacccgttcccggttccccccgttccccttacccccgg

SEQ ID NO: 108933 - DNA, 617 bp, Homo sapiens
  misc_feature: GYAE6OF01APCYU.12.71.G05.1.454.CMB.1.raw
tcagatacgacgtacacgaccggtgctcgatttagtgtcgtcgcaagagagaggggggggtcacaagaggcagcgctctcgggacgcctccaccatggcctggctctgctgctcctcactctcctcactcaggacacagggtcctgggcccagtctgccctgactcagcctgcctcgtgtctgggtctcctggacagtcgatcaccatctcctgcactggaaccagcagtgacggtttggtggttaataactatcgtctccgtacggtaccaacacgccaccgaggcacgaccgacccccaaactcatgtatttttgatcgtacactaacgtccggtcctacgtaggggtttctagtattccgtcttcgtcgtcggtctaccgtagtcctacgacctaccgtaccggtccctcccgtacgaccctacgttcctccggtcgggtccctaccggacgggtcttagggacggtaccggaaggtcttagtaacttttacgttagttcgacgtacgtcttactaagtactacgaagcagaccacgtcctacccgttgttcgtacgttacggaggtacggacgtacgtccgtacctccgtacgaccacgcccgaacggtcccc

SEQ ID NO: 108934 - DNA, 762 bp, Homo sapiens
  misc_feature: GYAE6OF01E4OQW.12.71.G05.1.454.CMB.1.raw
  modified_base (309)..(309): a, c, t, g, unknown or other
  misc_feature (309)..(309): n is a, c, g, or t
  modified_base (351)..(351): a, c, t, g, unknown or other
  misc_feature (351)..(351): n is a, c, g, or t
  modified_base (749)..(749): a, c, t, g, unknown or other
  misc_feature (749)..(749): n is a, c, g, or t
tcagatacgacgtacacgaccggtgctcgatttagtgtcgtcgcaagagagaggggggggtcacaaggaggcagcgctctcgggacgcctccaccatggcctggctctgctgctcctcactctcctcactcaggacacgaggtcctgggcccagtctgccctgactcagcctgcctccgtgtctggtctcctggacagtcgatcaccgtctcctgcacgtgggaccagtaatgtattttggaaattttgaccttgtctcctagtaccaacactacccggcaaacgtccccaagttaactctatttacgnggacgggacaacgtaacgccggtccctcgtaggtacttttcnggactcgtcgttctcgtcgtctaccgaaggtcgtcggacccggtacccgggtcccttacccgtaggtaacctaacgttacgtccggttacggggtcccttacccggaacgggtccgttaacggggtaacggggtaaccggtacggtacccttaccgttaacttttaaccgtaaccttcggtccgttacgtccttaccgtaagttacggttagggttaacgtttagtaacggtaccggtaacggtttcggggttcggttaccgggacgggtaccgggaaccgtaaacggtccggaacccggttaccgtaacggtaccgaccggtaccccgaacgggtccccgttccccggtaccccccgttcgggtaccctacccgttcccgtttaccccgttcccccnccccgtttacccg

SEQ ID NO: 108935 - DNA, 669 bp, Homo sapiens
  misc_feature: GYAE6OF01BL7C4.12.71.G05.1.454.CMB.1.raw
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactggaccagtaatgattttggaaattttgacctagtctcctggtaccaacaatacccggcaaagtcccaagttaatcattatgaggcactaagcggcctcaggagtttctgatcgcttctctggctcaagctggcgaccgggcctccctagacaaatactcgtgggctccgaaggtcctaggaacggacgaacggcgttacaactttaactaaccttgaccgtggtaccttactaactaagttagggtaacgggtttaattaaggtcctaaacggttttggggttacgggttttaccggggaccggggaccggggtaacccgaaaaacggttaggaaccccggttacccgtaaaaggttacccgtaaacggtcccccgtaaaagggcccttacggccccccccgttaacgggtccctaaccttcccgttacggtttcccccgtccccgttaccccg

SEQ ID NO: 108936 - DNA, 854 bp, Homo sapiens
  misc_feature: GYAE6OF01AX2ZV.12.71.G05.1.454.CMB.1.raw
  modified_base (218)..(218): a, c, t, g, unknown or other
  misc_feature (218)..(218): n is a, c, g, or t
tcagatacgacgtacacgaccggtgctcgatttagtgtcgtcgcaagagagaggggagtggaggagcagcgctctcgggacgcctccaccatcggcctgggctctgctgcctcctcactctcctcactcaggacacgagggtcctcgggcccagtctgccctgactcacgcctgccctcgtcgtcgtcgggtctcgtgactgtcgatccaccgtctcntacacgtcggaacctagtaactgtattttaggtaaattttcgaccttagtcttccgttaggtaacctaacaaccgtacccgtacaaaccgttacccgtaattaactacttaatttacgacggacggactaacgtaacggccggtcctacgtaggttactttccgtgtaacgtccgtcttcgtacgtcggtacttacgacgggtctcggaccgtcccggtcctccgtacggtaactacgttacgttccggtcggtaccgtccggtacggtaccgtacggtaaccgggtacggtacgtaccgtaacgttaacttaaccgttaacgtccggttacgttccggtacctttaacgtacgttaacggttaagggttaaacgggtttttaacggaaccggtttaaggttacccggggtttagggggtttccgggttttacccgggaacggggggttaaccccgggttaaaccggtaaaaccgggtttccgggttaacccgtttaaacccgggttaaacgttacccgggtaaaccggacccgggttaaaccgtccccgggttacccggtacccccggtttacccggttacccgtaacccgtttcccggttaccccctttaccccgttaccccgttttaccccgg

SEQ ID NO: 108937 - DNA, 748 bp, Homo sapiens
  misc_feature: GYAE6OF01DDK41.12.71.G05.1.454.CMB.1.raw
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctccgtggacagtcgatccaccgtctcctgcactggaccagtaatgtattttggaaattttgacctagtctcctaggtaccaaacaactaccccggacaaacgtcccctaaagttaatcctattttaactaggtaacgggactaacgtaacggccggtacccctacgtagggtaagttttccgtagaagttccggtcctttctcgttcggccttaccggaaacggtcgtcgggcccggaaccgggtccccttacccgtagactaattactcgtagggccctcgaggtctggacggtacggacgtcttacaagtttaacctacgtatcgtcggtaccttactagttacggtaggtaaggtttaagttacgtaccgttacggtttgggggttacggtttccgggggtaccggggtaaccgggtaaccgtaaaagggttcccggtaaacccgttacccggttaaggtacccgaaccgggtaccccgtaaacgggtcccgtaccccgtcccccgttacgggttaccctacccgttccgttaccccggttcccctacccccttaccccgg

SEQ ID NO: 108938 - DNA, 818 bp, Homo sapiens
  misc_feature: GYAE6OF01A8TK0.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacgagggtcctgggcccagtctgccctgactcagcctgcctccgtgtcgtgggtctcgtggacagtcgatccaccgtctcctgcacgtcgggacctagtatgtattttaggtaatttcgacttagtcctccgtacggtaaccaacgtaaccgtaaccccggactaaaccggtacccctaaaagtttaactacttaatttagtacggacgggactaacgtaacggcccgtcccgtacgtaggttacgtttcgaggtacttccgttccttcgttccgtacggtacctaccggaagggtccgtaccggggacccggtaccccgggtccctcccgtaggtaaacctaaattccggttaccggtaccggtaccgtaccgggtacggtaccggtagggaaccgggtaccggtaaggttacccttaacgttaaccgtttaaccgtacgtcgttccgttacggtaccttagtaacgttacggttaggggttaacgttaacggtccgtaccgggtttaccggggtttcgggggttacggtcccgggggaaccgggttaccggtaaccgttaacgggttaccgtacccggtaccgttaacggcggtaaacccgtccggtaacggtcccgtacccggtcccccgttagtacccgttccctaccggttcccccgtccccgtcccttaccccgg

SEQ ID NO: 108939 - DNA, 816 bp, Homo sapiens
  misc_feature: GYAE6OF01DOW1B.12.71.G05.1.454.CMB.1.raw
  modified_base (295)..(295): a, c, t, g, unknown or other
  misc_feature (295)..(295): n is a, c, g, or t
  modified_base (607)..(607): a, c, t, g, unknown or other
  misc_feature (607)..(607): n is a, c, g, or t
  modified_base (655)..(655): a, c, t, g, unknown or other
  misc_feature (655)..(655): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtcgtgggtctcctggactagtcgatcctaccgtctcctgccacgtggaaccctaagtagttgaacggttttggtacgtttaattaaccgttttgtctccgtaggtaaccaaancgaccacccgtacgaccaaaccgcccccctaactccttagtaatttacgacgtacggtcctacgttactttccggttacctcgtaaggtaacttttactaactccgtcctttcgttcgttcggtttaccgtaacgttcgtacgggacctaaacccgtccggtacccccttcccgtacggtaaccctaagtttcccgtttccggtacggggtacccgtttacccggaaccgggtcgtttacgggaacgggtaaaccgggtacgtacgttaggtttaactttaggttttacttacgaccggtactaccgtttanaaacgtttaacaacgacgtaccgagaccgtaaccgtcttaccccgttntttaccgtacgggttcgtaacgggttacggggaaccttaaccggggtacccttaacccccgggttaccgttaacgttcccggaaaccccggtaccccgtaaaccgggtacccccctaaacccccgttaacggtcccgttaacgttcccgtttaacccccgg

SEQ ID NO: 108940 - DNA, 744 bp, Homo sapiens
  misc_feature: GYAE6OF01A891V.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtggaccagtatgtatttggaaattttgaccttagtctcctaggtaccaacaactaccccggacaaacgtccccaagttaatctatttatgaggcactaacgccggccctacgaggtagtttctgtactcgtctttctcgtcggcctaccgaaggtcgtcgggccggtacccggggtccctacccgtacgaacctaaacttacgtcgtacggggtccttacccgacgggtccgttagggacgggtaaccggaggtaccccttacgtaaccttttaaccgtaccgttacgtcgttacgccttaccgtaattaacggttacgggtaaggtttaacgtaacggtacgttaccgggtttgggggtttaccggtttacgggaccgggtaccgggttaaaccgtaaacgggtccggtaaacccggttaccgtaaacggtccgaaccggtaccccgtaaggtcccgttacccgccccccgttacgggtccctacccgttacccgttcccgttacccccgaccctttccccg

SEQ ID NO: 108941 - DNA, 834 bp, Homo sapiens
  misc_feature: GYAE6OF01ENUMZ.12.71.G05.1.454.CMB.1.raw
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtcgtggtctcctggacagtcgatcaccgtctccgtgaccacgtcgggaacctagtaatgttaagtttttaggtaaatttttcgaaccttacgttcttacccgtacggtaaaccctaaactaaaccgtaaccccggactaaaaccgttacccctaaaagtttaactactaagttttaacgtggtaacgggaccaacgttaacggccggttacccgtacgtacgggttacgttttcgtacgtaacgttccgttccgtttccgttcgtacggtacctaccggtaaagggcccggttacgggacccggaccccgggtacccttcccgtaagtaactaaacgttacgtccggttccgggtacccgttaccgggtacggtacggttaccgggaacgggtaaccggtccgggttaaccttaacgtttaaactttaccgtaccgttaccgtacgttcgtaccgttacgtaagtttaaggttaggttaggttaacgtcgttaccgggttaggtttcgggttccgggtaccgggtaccgggacggtaaaccgtacgggtaccgtaccggttaccgtaacgtaccggtaccgtacccggaactcccgtcccgttccccgtacgttccctacccgttaccgttccccgtccccttaccgtacccg

SEQ ID NO: 108942 - DNA, 704 bp, Homo sapiens
  misc_feature: GYAE6OF01ERYG9.12.71.G05.1.454.CMB.1.raw
  modified_base (216)..(216): a, c, t, g, unknown or other
  misc_feature (216)..(216): n is a, c, g, or t
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctcactcaggacacgagggtcctgggcccagtctgccctagactcagcctgcctccgtgtcgtgggtctcctggacacgtcgactcacctatttccngccaccggaacaatagtcgacgttggtacttataactttgtctctggtacaaacngccaccagcaaaccgcccccaactcctgactttangagtcactattccggtcctgacgtatttcaatcgtcttctcgtgttaccaagtctggacctaacgaccggtccctcccgtagaacccgtctttacgtcccggtgggtcccgtaaggtccgtaggaacggacggaacggtcgtacgtattacgttacgcgtctaggttacctataactacaagtaccgtaccttccgtaacgttcgttaccggttgggttcggttccggggtaccgggttacggggaacccgtaacgggttacccgtacggtaaccccgttaacccggtaaacggtccgtaacccggaccccggtaacgggtaccccgttacccggacccccccggttacggttacccgtaacccgttcccgttaccccgttcccccgttaaccccccg

SEQ ID NO: 108943 - DNA, 713 bp, Homo sapiens
  misc_feature: GYAE6OF01AZTFC.12.71.G05.1.454.CMB.1.raw
  modified_base (222)..(222): a, c, t, g, unknown or other
  misc_feature (222)..(222): n is a, c, g, or t
  modified_base (290)..(290): a, c, t, g, unknown or other
  misc_feature (290)..(290): n is a, c, g, or t
  modified_base (362)..(362): a, c, t, g, unknown or other
  misc_feature (362)..(362): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctcgcctccgtgtctgggtctccgtggacagtcgactcaccgtctcctgcncgtcgggacagtaatgtattttaggtaatttgacctagtcctcgtcgtaaccaacaactaccccgganaaaccgtccctaaagttactctactttagtggacggctacgtaacggccggtccctacgaggtacgtttcgngtactcctacttctcgtcggtctaccgaacggtcgtcgggcccgtaccccgggtccctacccgtagaacctaattacgtcggtaccgggtctaccgaggtcgtaggtacggacggacgtcgtactacttacgtacgtcgtctcgtacctagtaagttacgtagggttaacgttacgtacgtacggttacgtttaggggttcgggttaccgggaccggggtaaccgggaacgtaaacggtccgtaaccggttaccgtaacggtacgacccgtaccggaacgtcccgttaccccgggcccccgttaacgggtcccttacccgttccgtttacccttcccccgtccctttaccg

SEQ ID NO: 108944 - DNA, 704 bp, Homo sapiens
  misc_feature: GYAE6OF01EM2KJ.12.71.G05.1.454.CMB.1.raw
  modified_base (310)..(310): a, c, t, g, unknown or other
  misc_feature (310)..(310): n is a, c, g, or t
tcagatacgacgtacacgaccggtgctcgatttagtgtcgtcgcaagagagagggtgggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtggaccagtaatgtattttaggaaattttgacctagtctctgtaccaacaactaccccggacaaacgtcccctaagttaatctatttanggacgggcactaagccggccctcgaggagtttctgactcgcttctcgtcgctaccgaggcgtggccggacccgggcccttcccgtacgaactaacgttatcgtcgggcctccgacggtcgtggaacggacgacggtccttacgatttaacctacgtcgactcgcctctaagttagtacgggtaaggtttacgtaaggaccgttacggtttacggggtggtttacccggggcggggtaacccgggtaaccgtaaaacgggttcccggtaacccggttcccggtacggggtttacccaacccgggacccgtaaacggggtcccgttccccggtacccccccgttcgggttaacccctaaccgtttcccgttcccggttccccccgttaccccccgg

SEQ ID NO: 108945 - DNA, 673 bp, Homo sapiens
  misc_feature: GYAE6OF01AGMTR.12.71.G05.1.454.CMB.1.raw
  modified_base (279)..(279): a, c, t, g, unknown or other
  misc_feature (279)..(279): n is a, c, g, or t
  modified_base (301)..(301): a, c, t, g, unknown or other
  misc_feature (301)..(301): n is a, c, g, or t
  modified_base (330)..(330): a, c, t, g, unknown or other
  misc_feature (330)..(330): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtcgtgggtctcctggacagtcgatccaccgtctcctgcacgtgggaccagtatgtattttggaattttgacctagtctctggtaccaacactacccgnaacgtcccaagtatctatttangaggcacgtagcgccctagaggtatttcngactccgtcttctcgtcgcctaccgaacggtcgtcgggaccgtacccgggtccctcccgtaggaactaacgttcgtccgtacgggcctaccgagggtcgtacggacggacgacggtcctacgtactttaacgacctcggtctcggtacctctaagttcggtaggttaacggttactacggtcgttacgggtttcggggttaggttccgggaccgggtaccgggtaacctaaagggtccgtaaccgttaccgtaacggtcgaacccgacccggtaacggtcccttccccggtaccccgtcggtaccctaccgttcccttcccgttacccccgtccgttaccccg

SEQ ID NO: 108946 - DNA, 784 bp, Homo sapiens
  misc_feature: GYAE6OF01AO9DT.12.71.G05.1.454.CMB.1.raw
  modified_base (218)..(218): a, c, t, g, unknown or other
  misc_feature (218)..(218): n is a, c, g, or t
  modified_base (274)..(274): a, c, t, g, unknown or other
  misc_feature (274)..(274): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcaccctcctcactcagggcacagggtcctgggcccaatctgccctgactcagcctgcctccgtgtctgggtctccgtggacagtcgatcacctatttccngccaccggaaccaatagtgacgttggtcgttatactttgtctccgtggtaacaacngccaccaggacaaccgcccccatcctgtattatgacgtcacttattccggtcctcgagtatttctaatccgtcttcttcgtcgttccgaacgttcgtacggactaaccgccggtacccttccgtacgaccctacttccgttcggtcgggtccgtacgggtccgttagggacgggaccggtagggtccgttagtaacgttttacttacgttggaccgttacggttacctaagttaacctaacgaacgtcccgtaaccctttaccctacgtttaccgttcgggtttacggggttcgggtttccggggtaccggggtttaccgggaaccccgtagggtaccccggttacggtaccccggttaaacccgttaaacggggttcccaacccgggtacccccggtaaacgggttcccccgttacccccgggttccccccccgttacgggttaccccctaacccgttttccccggttacccccgggtttcccccccgtaccccctttttacccccggg

SEQ ID NO: 108947 - DNA, 892 bp, Homo sapiens
  misc_feature: GYAE6OF01AF10E.12.71.G05.1.454.CMB.1.raw
  modified_base (360)..(360): a, c, t, g, unknown or other
  misc_feature (360)..(360): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacgagggtcctgggcccagtctgccctgactcagcctgcctcgtgtcgtgggtcctccgtggaccaggtcgatccgaccgtctacctgcctacgtgggaacctagtactggttagttttagggaaacttttcggaccttaggtccgttcctacggtaaccaaaccgtaaccgtaaccccggactaaaaccgttccccctaaaagtttaaactcctaattttagngggtacgggtactaacgttaacggcccgggtccctacggaacgggttagttttccgtaggtaacgttccgtccgttttacgtccgttccgggtaccttaccggaacggggtccgttacggggacccggtaaccccggggtcccttacccggtaacggaacccgtaaacgtttacgtcccggttacgggtaccccgttacccgggtagggtacccttaggggaaacgggaccggtacgggtaccctttaccgtaaacgtttaacccggttacgtcggtaccgttacggtaccgttacgtaaagtttacgggtaggggtttaacgtttaacggtaccgttacccggtttacggggttttagggggtttcccggttaacccggggtccggggaacccggggttaaaccaacgggttccggtaacccgttaaaccgtaccggttaccggaccgggtaacccgaggggttccctccccgggtacccccttgggaccctttacccgtccgttccccgttaccccgtcccgtttacccg

SEQ ID NO: 108948 - DNA, 739 bp, Homo sapiens
  misc_feature: GYAE6OF01AWLU7.12.71.G05.1.454.CMB.1.raw
  modified_base (323)..(323): a, c, t, g, unknown or other
  misc_feature (323)..(323): n is a, c, g, or t
  modified_base (346)..(346): a, c, t, g, unknown or other
  misc_feature (346)..(346): n is a, c, g, or t
  modified_base (429)..(429): a, c, t, g, unknown or other
  misc_feature (429)..(429): n is a, c, g, or t
tcagatacgacgtacacgaccggtgctcgatttagtgtcgtcgcaagagagagggggggggtcacaagaggcagcgctctcgggacgcctccaccatggcctggctctgctgctcctcactctcctcactcaggacacgagggtcctgggcccagtctgccctgactcacgcctgcctcgtagtcgtggtctccgtggacagtcatccaccgtctcctgaccacgtcggaacctagttaacgttgttaacgtttttaggtaaaacttttcgaacccgttagtccttaccgtacggtaacccaaaccgtaacgtaccccggaanaaaccgttaccctaaagttaacncttatttaagcggacggactaacgtaacggcccggtacctaggaacggttacgttttcgaggtactcggtacttcgttaccgngtacctacgaacggtcgtacggacccggttaccccggccttaccgagtaaactaacgtttcgtaccgacggtccctaacgacggtctagggaccggtaacgtacgtacctacgtacttacgtacgtgacttagcctacgtagtaggtacggttaagtcgtaagtaccgttcggttacggggtacgttaccgggacggaccgggttaacaaacggtcgtaccggtacgtaacgtaccgaccgtaccggaacgtccgtaccccgtaccgttaccgtacgttaccgttaccgaccctttccccgacttaccgg

SEQ ID NO: 108949 - DNA, 820 bp, Homo sapiens
  misc_feature: GYAE6OF01AI4K1.12.71.G05.1.454.CMB.1.raw
tcagatacgacgtacacgaccggtgctcgatttagtgtcgtcgcaagagagaggggagtgaggagcagcgctctcgggacgcctccaccatggcctgggctctgctgctcctcactctcctcactcaggacacgagggtcctgggcccagtctcgccctgactcagcctcgcctccgtgtcgtgggtcctccgtggacagtcgactccgtaccgtcctcctcgcctacgtcgggaacctagtaattgttagttttaggtaaattttcgaccgttatccttaccgtacggtaacccaaaccgaaccgtaccccggactaaaaccggttaccctaaagttactactaatttagacggtaacggtactaacgtaacgcccggtacctaggtacggttacgtttcgtagtaccgtcgtcctttctaccggtcgtaccgtaaccggaacgggtccggtaccgggtcccggtacccgggtcccttaccgtaactaaacgtaacgttacggtccggtacgggtccctacgtaccggtacggtacggaacgggacggtacggtacctacgtaacttaaccgtacgtacgtccgtacgtcctacgggggtaacttacggtaggttaacggttaacgttacgtacggttacggtttcgggttacgggttaccggggtaccggggtaaccggtaaccggttaacggtaccggttaccggttaaccgtaacggtaccgtaacccggtacccgaaccggtcccgtacccggtccccgttaccggttacccgttacccgttacccggttcccgttcccccgtcccgttaccccg

SEQ ID NO: 108950 - DNA, 155 bp, Homo sapiens
  misc_feature: GYAE6OF01DKX16.12.71.G05.1.454.CMB.1.raw
  modified_base (134)..(155): a, c, t, g, unknown or other
  misc_feature (134)..(155): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcannnnnnnnnnnnnnnnnnnnnn

SEQ ID NO: 108951 - DNA, 722 bp, Homo sapiens
  misc_feature: GYAE6OF01B3XM0.12.71.G05.1.454.CMB.1.raw
  modified_base (192)..(192): a, c, t, g, unknown or other
  misc_feature (192)..(192): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctcactcaggacacgaggtcctgggcccagtctcgccctgactcagcctgcctccgtgtcgtcgggtctccgnggactagtcgatccgaccgtctccgtgcctacgtcgggaacctagtaactgttaagttttaggtaaatttcgaaccttaggtcctccgtacggtaaccaaccgtaacgtaccccggaactaaaccgtaccccgtaaagttaactctaacgttagtcggacgggtactaacgtaacgccggtacctacgaggttacgtttctagtacgttcgtcttcgtcgtcgtacctaccggaacggtccgtccggggacccgtaccccggggtcccttacccgtacgtaactaagtacgtccggtcggtcctccggtaacggcgtacgggaacggacggtacggtcctacgttaacttacgtactcgtcgtacgtccttatacgttaaggtggtaagttctacggtacgtgggtttcgggtaccggtcggggaccggtacggacggtaacgcgtaacccgtacgtaacgcgtaaccgacgtcgccgtacccggtcccgtacgtccctaccttccgtaccctccccgtaacccttccgg

SEQ ID NO: 108952 - DNA, 794 bp, Homo sapiens
  misc_feature: GYAE6OF01CEKKV.12.71.G05.1.454.CMB.1.raw
  modified_base (607)..(607): a, c, t, g, unknown or other
  misc_feature (607)..(607): n is a, c, g, or t
  modified_base (642)..(642): a, c, t, g, unknown or other
  misc_feature (642)..(642): n is a, c, g, or t
tcagatacgacgtacacgaccggtgctcgatttagtgtcgtcgcaagagagagggggggggtcacaagaggcagcgctctcgggacgcctccaccatggcctgggctctgctgcctcctcactctccctcactcaaggaccagacggggtcctcgggcccagttcctcgcccctgacctcacgcctgcccttccgtgtcgtcggtctcccgtggaactggtcgactccgtaccgttcgtcctagccaccggtcgggacctaaggttaattggtttaaacgttttttggtaaaacgttttttcggaaccctttagttcccgttacccggttacggttaaacccaaaacctaaccgttaaccccccggactaaaccggtaccccttaaagttaactcttaagtttaggtaggacgggtactaaccgtaacggacccggtcccttaggtacgggtttactttaccgtgtaaccgttccgtaccttccgtcgtccgtacccgtacggaccgggtccgtccgggtacccggaccccggttaccctcctaagactaacgtccgtcggtaccgggcctcgacgtcggtacggacggacgcgtcacttacttacncgtgctagcctataccggtagtacgggtattacgngtaccgttacggttcggggttaggccggggtcggaaccggagtaacgtccggtaaccgtcgaaccggacgtacccgacccgaccgggttccgtacccccgtccggtaccccgttataccccgttcggttccccgtccccttaacccgttccg

SEQ ID NO: 108953 - DNA, 894 bp, Homo sapiens
  misc_feature: GYAE6OF01A17PA.12.71.G05.1.454.CMB.1.raw
  modified_base (87)..(87): a, c, t, g, unknown or other
  misc_feature (87)..(87): n is a, c, g, or t
  modified_base (185)..(185): a, c, t, g, unknown or other
  misc_feature (185)..(185): n is a, c, g, or t
tcagatacgacgtacacgaccggtgctcgatttagtgtcgtcgcaagagagagggggggggtcacaagaggcagcgctctcgggacncctccaccatggcctgggctctgctgcctcctcactcctcctcactcaggacacgagggttccgtacgggcccaggttcctcggaccccttagacctnacgtccctgcccgttccgtgtccgtcggtcctaccgtgggacctacggtctactcccgtaccggttcctcgtgacgtacggtcgggtaacctagtaacgtggtttaagttttaggtaaactttttcgaacccgtacgtttccttaccgttaccggtaaaccaaaccggtaaccctaacccccgggtacctaaaaccgttaccccttaacgttaacttacttaacgttttaaggaccggtaggtaaccctaaccggtaacgtccccggtacccgtaggtacgggtttactttacgttacgtattcccgttacttcgtacgtccggtactccggtaaaggtcccggtacggtccccggaacccgttcccgtacccgttaacgtactaaagtttacgtccggtacgggtacctacggtaccgtagggtacggtacggtaaacgggcttaacccttaaacttaccgttaccttaccgtgtaccgttacggtacttagtacggtaacgtttaacggtacgtttacggtaaccgtttacgttaccggggtttacgggttcgggttaccggggtaccggtaacggggtaaccgtaggtaaccccgttaaccgttaaccggacgtaaccgggactaccgggtaacctccccggtacccgtcccgggtttaccaccgtttccgggtacccttccccgggttcccgtacccgtttcccg

SEQ ID NO: 108954 - DNA, 732 bp, Homo sapiens
  misc_feature: GYAE6OF01B1O5W.12.71.G05.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (329)..(329): a, c, t, g, unknown or other
  misc_feature (329)..(329): n is a, c, g, or t
  modified_base (374)..(374): a, c, t, g, unknown or other
  misc_feature (374)..(374): n is a, c, g, or t
  modified_base (536)..(536): a, c, t, g, unknown or other
  misc_feature (536)..(536): n is a, c, g, or t
tcagatacgacgtacacgaccggtgctcgatttagtgtcgtcgcaagagagaggggggggtcacaagaggcagcgctctcgggacgcctccaccatggcctggctctgctgctcctcactctcctcactcaggacacgaggtcctggcccagtctcgccctgactcacgcctgcctcgtgtcgtggtctcgtgacngtcgatccnccgtctccgtgcacgtcggacagttacgtgttacgtttagttaactttcgaccttacgttctccgtacgtaaccaactaaccgtacccggactaaaccgtaccctaaagttactactagtttanagggaccgacaaccgtacgccgtaccgtagtacggtacgtttcgngtacttcgtacttcctgtacggtcctacgaggtccgtccggaccggtcccggtcccttaccgagtactaacgttggtcccgtacggccgtaccgacggtacgtacggacgggaacgttcgacttacttacgttaacgtacgtcgtacgttcgaccgtttaancggtttagtacggtaagttactaccggtggtttaccggtttcgggtccgggttacggtaccggggtaacgtaccggtaacggttaccggtaccgttacgtaaccggtacgacgggtacccgacgggtccccgttcccggcccgtttaccgtacccgtaccgttccccgtttaccccgttcccgtcccgtttacccg

SEQ ID NO: 108955 - DNA, 712 bp, Homo sapiens
  misc_feature: GYAE6OF01CYOY4.12.71.G05.1.454.CMB.1.raw
  modified_base (122)..(122): a, c, t, g, unknown or other
  misc_feature (122)..(122): n is a, c, g, or t
  modified_base (544)..(544): a, c, t, g, unknown or other
  misc_feature (544)..(544): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctnactcaggacacgagggtcctcgggcccagtctgccctgactcacgcctgcccttcgtgtcgtgggtctccgtggacagtcgtactcaccgtctcctgctacgtggacagtatgttagtttagtaatttcgactatctcctagtaaccaacgtaacgtacccgataaaccgtacccgtaaagttaactactaagttttacgacgggaacggtacctaacgtaaccggtcccggttacctacggtaaggttacgttttaccgtagtaccgttcggtactttaccgtcgtaccgggtacccttacggaacgggtcggtcggacccggaacccggtcctacgacggtaactacgtcgttcggacggtcctacgaggtcgtacggaacggtaccgtacggtcctaagttaacttaccgtagttccgngttcgacccttagttagacggttagggtacttagtccgggacttacgggtgggttacgccgggtcggtaaccggacgtaagtccgtaccggtacgtcggaccacggtacccgaggcccttccggacccttcggtactaccttcgtaccccgttcccaaccgttcccgg

SEQ ID NO: 108956 - DNA, 707 bp, Homo sapiens
  misc_feature: GYAE6OF01AV7UE.12.71.G05.1.454.CMB.1.raw
  modified_base (544)..(544): a, c, t, g, unknown or other
  misc_feature (544)..(544): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacagacggtcctggcccagtctgcccttgactcagcctgcctccgtgtcgtagggttcctccgtagactaggtcattccgacctctcctgacacgtcgggaaccaagtatgttaagttttacgaagttttcgacttagtcctccgtacgtaactaacaacgtacccgacaacgtacccctaattactctatttacgagacggaccaacgttaacgccggtccctacggtacggttacgtttacgtggttactcggtaccttacgtcgtcgtccgttacccggaagccgtacgggccgtaccccgggtcccttaccggacgtaacaagttaacgtacgtccgggacctaccggtacggacgtacggacgggtacggaagtcccttacgtaacttacgtacctgtaccgtntacgtactaaggtcgtaggtacgttacgtacctaaggttcgttacggggtacgttcgggaccgggtacgaaccgtacgtaccgaccgttaccgagtaccgaccgtacgaaccggctaccccggtccttaggaccctacgttcttacccgtccctacccgttcc

SEQ ID NO: 108957 - DNA, 261 bp, Homo sapiens
  misc_feature: GYAE6OF02FE32O.12.71.G05.1.454.CMB.1.raw
  modified_base (258)..(261): a, c, t, g, unknown or other
  misc_feature (258)..(261): n is a, c, g, or t
tcagatacgacgtacacgaccggtgctcgatttagtgtcgtcgcaagagagagggggccagctgctgggagcgtctacatatttcgacccctgggccagggaacccaggtcaccgtctcctcagcctccaccaagggcccatccgtcttcccctggcgccctgctccaggagcacctccgagagcacagcggccctgggctgcctggtcaaggactacttcctacgtcgtatctgagcgggctggcaaggcgcatagnnnn

SEQ ID NO: 108958 - DNA, 517 bp, Homo sapiens
  misc_feature: GYAE6OF02IVAWQ.12.71.G05.1.454.CMB.1.raw
tcagatacgacgtacacgaccggtgctcgatttagtgtcgtcgcaagagagagggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaacacccaggcaaagcccccaaactcatgatttatgagggcactaagcggccctcaggggtttcttatcgcttctctggctccgagtctggcacacggcctccctgaccatctctggggtccaggctgaggacgaggctgattattactgcagttcatatacaagcacttccactctcgtgtgttcggcggtggaccagctgccgtcctaagtcagcccaagctcgcccctggtcactctcgttccccg

SEQ ID NO: 108959 - DNA, 545 bp, Homo sapiens
  misc_feature: GYAE6OF02FEW3A.12.71.G05.1.454.CMB.1.raw
  modified_base (433)..(433): a, c, t, g, unknown or other
  misc_feature (433)..(433): n is a, c, g, or t
tcagatacgacgtacacgaccggtgctcgatttagtgtcgtcgcaagagagagggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggctccctgaccatctctgggctccaggctgaggacgaggctgattactactgctgctcatatgagtnagcagtcgtacgttcgtcggcgtacgaaagtcggaccgtacgtacgtccgtacgaccgtacggactccgaccccggtccgtacccaccttcgtccgttacccgcccttcccg

SEQ ID NO: 108960 - DNA, 522 bp, Homo sapiens
  misc_feature: GYAE6OF02I0GG4.12.71.G05.1.454.CMB.1.raw
tcagatacgacgtacacgaccggtgctcgatttagtgtcgtcgcaagagagagggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaatttgacctagtctcctggtaccaacaataccccggcaaagtccccaagttaatcatttatgagggcaaaaaacggcctacggggatttcgtaatcgcttctctggctccaagtctggcaacacggcctcctgacaatctctgggctccagctgacggacgaggctgattattactgctgctcatatgcaggtagtgcactttcgctactattcgggcgagggaccaagctgaccgtctacgtcagcccaagctgcccctggtccactctcgtccctaccc

SEQ ID NO: 108961 - DNA, 542 bp, Homo sapiens
  misc_feature: GYAE6OF02IIIMZ.12.71.G05.1.454.CMB.1.raw
  modified_base (334)..(334): a, c, t, g, unknown or other
  misc_feature (334)..(334): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttcngatcgcttctctggctccaaggctggcgaccgggcctccctgacaatatctgggctccgaggctgaggacgaggctcattactactgcttgctcatatggaggttatagcacgtttgggtgttcgggcggcgggaccaaaggtcgaccgtacctaagtcgagcccaaggcctcgccccgtcggtccactcctcgttccccgccctccc

SEQ ID NO: 108962 - DNA, 530 bp, Homo sapiens
  misc_feature: GYAE6OF02FG5RI.12.71.G05.1.454.CMB.1.raw
  modified_base (374)..(374): a, c, t, g, unknown or other
  misc_feature (374)..(374): n is a, c, g, or t
tcagatacgacgtacacgaccggtgctcgatttagtgtcgtcgcaagagagagggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctcccngacaatatctgggctccaggctgaggacgaggctcattacactgctgctcatatggaggttatagctacgttgggtgttcggcggcgggaccaagtgaccgtccaagtcaagcccaaggcctcgcccctcggtccacctctcgttcccgccctccc

SEQ ID NO: 108963 - DNA, 687 bp, Homo sapiens
  misc_feature: GYAE6OF02I6Q2B.12.71.G05.1.454.CMB.1.raw
  modified_base (118)..(118): a, c, t, g, unknown or other
  misc_feature (118)..(118): n is a, c, g, or t
  modified_base (126)..(126): a, c, t, g, unknown or other
  misc_feature (126)..(126): n is a, c, g, or t
  modified_base (146)..(146): a, c, t, g, unknown or other
  misc_feature (146)..(146): n is a, c, g, or t
  modified_base (148)..(148): a, c, t, g, unknown or other
  misc_feature (148)..(148): n is a, c, g, or t
  modified_base (150)..(150): a, c, t, g, unknown or other
  misc_feature (150)..(150): n is a, c, g, or t
  modified_base (203)..(204): a, c, t, g, unknown or other
  misc_feature (203)..(204): n is a, c, g, or t
tcagatacgacgtacacgaccggtgctcgatttagtgtcgtcgcaagagagaggggggtcacaagaggcagcgctctcgggacgcctccaccatggcctgggctctgctgctccctcnctctctcnctgagacagcgtcgtcgccntncnctgctgcgtctcgcctcgtgtcgtggtcctcgtgactgctctccgtcgtctcnnctcgtcgactagtatgttagttagttaattcgactgtcctcgtacgaaccaataccgtcccgaataacccgtaccgtaaagttacacttaatttgagggacgactaaacgtacggccccgtccctaggaaggtttctttcgagtaccgtcgttcttctcggtcgtcctaacggagtcgtcggacccggacccgtccctcgtacgaactaatcgtcggtcgtcctacggacgtcagggaacgacggcgtcctataacttactcgcgtcgtcgtcctataagttcggtaggttaagttacacgccgtttaggggtttggggttccggttccggggccgggtaaacccggtaaaacgtaagggtcccgttacccccgttagttaaccgtcggaaccccggtaaccggtacggtcccgtccccccgttcccggttacgtacccttacccgtttccggtttacccgttacccccctaccccgtttccg

SEQ ID NO: 108964 - DNA, 562 bp, Homo sapiens
  misc_feature: GYAE6OF02H38HL.12.71.G05.1.454.CMB.1.raw
  modified_base (312)..(312): a, c, t, g, unknown or other
  misc_feature (312)..(312): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtgggaccagtaatgattttggaaattttgacctagtctcctggtaccaacaactaccccggacaaacgtccccaaagttaactctattttangtaggcactaagccggccctcaggtagtttctgatcgcttctctgctccaaggctggcgaccgggcctccctgacaatatctgggcctccgaggctggaggacgaggctcattactactgctgctcatagtggagttatagctacgttgggtgtcgggcggcgggaccaaagtcgaccgtacgtagtcgagacccgaggcctccgcccccgttcggtcctaccgtccgttccgttcccccgtccctcccg

SEQ ID NO: 108965 - DNA, 528 bp, Homo sapiens
  misc_feature: GYAE6OF02IVU0Q.12.71.G05.1.454.CMB.1.raw
  modified_base (275)..(275): a, c, t, g, unknown or other
  misc_feature (275)..(275): n is a, c, g, or t
  modified_base (435)..(435): a, c, t, g, unknown or other
  misc_feature (435)..(435): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggnaaagtccccaagttaatcatttatgagggcactaagcggccctcaggagtttctgatcgcttctctggctccaaggctggcgaccgggcctcctgacaatatcgtgggctccgaggctgaggacgaggctcattacactgctgctacatagtggagttanagctacgttgggtgttcggcggtcgggacaaagtcgacgtctaagtcgacgcccaaggcctcgcccctggtcactctcgttcccgccttcccg

SEQ ID NO: 108966 - DNA, 531 bp, Homo sapiens
  misc_feature: GYAE6OF02GDOQ3.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctggaggacgaggctcattacactgctgctcatatggaggttatagctacgttgggtgttcggcggcggacaagtgaccgtctaagtcgacgcccaaggctcgccccgtcggtccactcgtcgttcccgccctcc

SEQ ID NO: 108967 - DNA, 535 bp, Homo sapiens
  misc_feature: GYAE6OF02JAUZF.12.71.G05.1.454.CMB.1.raw
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
  modified_base (377)..(377): a, c, t, g, unknown or other
  misc_feature (377)..(377): n is a, c, g, or t
  modified_base (403)..(403): a, c, t, g, unknown or other
  misc_feature (403)..(403): n is a, c, g, or t
  modified_base (433)..(433): a, c, t, g, unknown or other
  misc_feature (433)..(433): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggnaaacgtccccaagttaatcatttangaggcactaagcggcctnaggagtttcngatcgcttcnctggctccaagctggcgacgggctcctgacatanctgggctcaggctgaggacgaggctnattactactgctgctcatagtggtagttanagtctacgtttggggtagttcgggcggtcgggaaccaaaggtgaaccgtcttaagcacggacccaggctcgcccctggcaccgtctacgttcccaccttccc

SEQ ID NO: 108968 - DNA, 533 bp, Homo sapiens
  misc_feature: GYAE6OF02IA0X1.12.71.G05.1.454.CMB.1.raw
  modified_base (440)..(440): a, c, t, g, unknown or other
  misc_feature (440)..(440): n is a, c, g, or t
  modified_base (525)..(525): a, c, t, g, unknown or other
  misc_feature (525)..(525): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaatacccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggagttanagctacttgggtgttcggcggtcgggaccaaaggtgaccgtactagtcgagcccaaggctcgcccctcggtcactctcgttcccncccttccc

SEQ ID NO: 108969 - DNA, 531 bp, Homo sapiens
  misc_feature: GYAE6OF02IKJ37.12.71.G05.1.454.CMB.1.raw
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggagtgataagtttgtctcctggtaccaacatcacccaggcaaagcccccagactcatgatttatgaggacaaaaacggcctacggggatttctaatcgtcttctctggctcaagtctggcaacacggcctccctgacaatctctgggctccaggctgaggacgaggctgattattactgctgctcgatatgctaggtagtggtctacgtttcgctactaagtttccgggcggaacgggaccgtaagccgtaggacccgttcctaccggtccgaacgtccccgaaggtcccg

SEQ ID NO: 108970 - DNA, 534 bp, Homo sapiens
  misc_feature: GYAE6OF02HLJI0.12.71.G05.1.454.CMB.1.raw
tcagatacgacgtacacgaccggtgctcgatttagtgtcgtcgcaagagagagggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcattatgaggcactaagcggcctcaggagtttctgatcgcttctctggctcaagctggcgaccgggcctcctgacaatatctgggctccaggctggaggacgaggctcattactactgctgctcatatggaggttataggctacgttgggtgttcgggcgggcgggaccaaagtgaccgtcctaagtcgagcccaaggcctcgcccctcggtccacttcctcgttcccgcccttcccg

SEQ ID NO: 108971 - DNA, 506 bp, Homo sapiens
  misc_feature: GYAE6OF02JF5V6.12.71.G05.1.454.CMB.1.raw
  modified_base (371)..(371): a, c, t, g, unknown or other
  misc_feature (371)..(371): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgaggcactaagcggcctcaggagtttctgatcgcttctctcggctcgaagctggcgaccggcctccngacatatctgggctcagctgagacgaggctcattcatgctgctcatatggagttatgctacgttggtgttcggcggcggaacaagtgacgtctaagcagccaagctcgccctggtcactctcgttcccgccctcc

SEQ ID NO: 108972 - DNA, 520 bp, Homo sapiens
  misc_feature: GYAE6OF02FOMWW.12.71.G05.1.454.CMB.1.raw
  modified_base (305)..(305): a, c, t, g, unknown or other
  misc_feature (305)..(305): n is a, c, g, or t
tcagatacgacgtacacgaccggtgctcgatttagtgtcgtcgcaagagagaggggggggtcacaagaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctagatttangaggtcactattcggtctcaggtaatttctaatcgcttctctggttccaagtctggcaacacggcctcctgaccatctcgtggggtccaggtctgaggacgaggctgattatactgctagttcatatacagcacttccactctcgtgtgttcggcggtggaccagctgacctcgtaagtcagcccaagctcgcccctggtccactctgttccccg

SEQ ID NO: 108973 - DNA, 537 bp, Homo sapiens
  misc_feature: GYAE6OF02GSHS9.12.71.G05.1.454.CMB.1.raw
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggagttatagcacgttgggtgttcggcggcgggacaaagtgaccgtcctaaggtccagcccaaggcctcgcccccgtcggtccaccttcctcgttccccaccttccc

SEQ ID NO: 108974 - DNA, 566 bp, Homo sapiens
  misc_feature: GYAE6OF02I6YTV.12.71.G05.1.454.CMB.1.raw
  modified_base (439)..(439): a, c, t, g, unknown or other
  misc_feature (439)..(439): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaatacccccggcaaagtcccccaagttaatcatttatgagggcactaagcggccctcaggagtttctgatcgcttctctggctccaaggctggcgaccgggctcccgtgacaatatctgggctccaggctgaggcgaggctcattactactgctgctcatatggagttanagtcactttggggtgtttcgggcggcgggaaccgtaaagtcgaccgtaccttaagtcctaaggacccgaaggcctacggcccccgttcggtcctaccgttccgtcgtttccccgaccctttaccccg

SEQ ID NO: 108975 - DNA, 564 bp, Homo sapiens
  misc_feature: GYAE6OF02GRVER.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccgaggcctggagggacgaggcctcattactactgctgcctcatatggtaggttatagctacgtttggggtgttcgggcgggcgggaccaaaggtcgaccgttccgtaagtcacggacccgaagggtcctcggtcccccgtcggtccaccttccgtcgttcccccaccttccc

SEQ ID NO: 108976 - DNA, 578 bp, Homo sapiens
  misc_feature: GYAE6OF02G06BW.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtgggaccagtaatgattttggaaattttgacctagtctctggtaccaacaataccccggcaaacgtccccaagttaatcatttatgagggcactaagcggccctcgaggtagtttctgatcgtcttctctggctcaaggctcggcgaccggcctcctcgaccatctcgtcggacctccacgcctggacggacgacggccgtattactactgctattcgcacagacaaggactccgagttcgggtgttcggcggagggaccaacgtcgaccgtccgtaggtcacggaccgaacggcgtccgtcccccgtcggtccctaccgttccttccgttcccctaccccttccctccttacccgg

SEQ ID NO: 108977 - DNA, 531 bp, Homo sapiens
  misc_feature: GYAE6OF02JH0H6.12.71.G05.1.454.CMB.1.raw
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctcaaggctggcgaccgggcctccctgacaatatctgggctccaggctgaggacgaggctcattactactgctgctcatatggtaggttatagctacgttgggtgttcgggcggcgggaccaagtgaccgtctaagtcacgccaagctcgcccctcggtccactcgtcgttcccgccctcccg

SEQ ID NO: 108978 - DNA, 538 bp, Homo sapiens
  misc_feature: GYAE6OF02HFTJU.12.71.G05.1.454.CMB.1.raw
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaaacaatacccccggcaaaagtcccccaagttaatcatttatgagggcactaagcggccctcaggagtttctgatcgcttctctggctccaaggctggcgaccggcctcctgacatatctgggctccaggctgaggacgaggctcattactactgctgctacatatggagttatagctacgttgggtgttcggcgtcgggacaaagtcgaccgtcgtaagtcagtcccaaggctcgccccctcggtccacttctcgttccccacccttcccg

SEQ ID NO: 108979 - DNA, 557 bp, Homo sapiens
  misc_feature: GYAE6OF02HG1I3.12.71.G05.1.454.CMB.1.raw
  modified_base (405)..(405): a, c, t, g, unknown or other
  misc_feature (405)..(405): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagccggccctcaggagtttctgatcgcttctctggctccaaggctggcgaccgggcctcctgacaatatctgggctccaggctgaggacgnggctcattactactgctgctcagtatgggtagttataggtctacggtttggggtacgttcgggcgggacggggtaccaaaggtcgaccgtctaaggtccgaggacccaaggcctccgccccgtcggtcaccttcctcgttccccaccttccc

SEQ ID NO: 108980 - DNA, 545 bp, Homo sapiens
  misc_feature: GYAE6OF02HOEHA.12.71.G05.1.454.CMB.1.raw
  modified_base (339)..(339): a, c, t, g, unknown or other
  misc_feature (339)..(339): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaaacgtccccaaagttaatcaatttatgagggcactaagcggccctcaggagtttcngattcgcttctctggctccaaggctggcgaccgggcctcctgacaatactcgtgggctcgaggctgaggacgaggctcattactactgctgctcatatggtagttatagctacgttggtcggttcggcggcgggaaccaaggtcgaccgttactagcgacgccgaggctacgccccgtcgccaccgttcgtcgttccccgcctccg

SEQ ID NO: 108981 - DNA, 588 bp, Homo sapiens
  misc_feature: GYAE6OF02HVS56.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctcctggtaccaacaactaccccggcaaacgtccccaagttaatctatttatgagggcactaagcggcctcaggtatttctgatcgcttctctggctccaaggctggcgaccggcctcctgacaatatcgtgggctcgaggtctggaggacgaggctacattactactgctgctacatagtggtagttatagcgtagttggggtcgttcgggacggtcgggaacaaaggtcgacccgttacgtaaggtccgacggacccgaagggtcctaccggtccccccgttcgggtaccctaccgttccgttcccggtttcccccacccgtttccccg

SEQ ID NO: 108982 - DNA, 517 bp, Homo sapiens
  misc_feature: GYAE6OF02IOLUF.12.71.G05.1.454.CMB.1.raw
  modified_base (216)..(216): a, c, t, g, unknown or other
  misc_feature (216)..(216): n is a, c, g, or t
  modified_base (407)..(407): a, c, t, g, unknown or other
  misc_feature (407)..(407): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccatttccngcaccggaaccaatagtgacgttggtcgttataactttgtctcctggtacaaacagcacccaggcaaagccccccaatccctgatttatgaggtcactattcggtcctcaggaatttctaatcgcttctctggttccaagtctggcaacacggcctccctgaccatctctcggggtccaggctgaggacgnggctgtattatactgcagttcatatacagcacttcactctgtgtgtcggcgtggacagctgaccgtctagtcagccaaggcctcgcccctggtcactctcgtccctaccc

SEQ ID NO: 108983 - DNA, 534 bp, Homo sapiens
  misc_feature: GYAE6OF02FXK5Y.12.71.G05.1.454.CMB.1.raw
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtcccccaagttaatcatttatgagggcactaagcggccctcaggagtttctgatcgcttctctggctccaaggctggcgaccgggcctccctgacaatatctgggctccaggctgaggacgaggctcattactactgctgctcatatggagttatagctacgttgggtgttcggcggcggaccaagtcgaccgtctaagtcgacgcccgaaggcctcgcccctcggtcacgtctcgttcccgccctcccg

SEQ ID NO: 108984 - DNA, 524 bp, Homo sapiens
  misc_feature: GYAE6OF02HA4VV.12.71.G05.1.454.CMB.1.raw
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgaggcactaagcggcctnaggagtttcngatcgcttctctggctcaagctggcgaccggcctcctgaccaatatcgtgggctcgaggctgaggacgaggctcgattactatgctgctcatagtggagttatagctagttgggtagttcggcggtcgggaacaaaggtgaccgtctaagtcagcccgaaggctcgccctcgcactcgtcttcccgcctccg

SEQ ID NO: 108985 - DNA, 529 bp, Homo sapiens
  misc_feature: GYAE6OF02FN7BR.12.71.G05.1.454.CMB.1.raw
  modified_base (339)..(339): a, c, t, g, unknown or other
  misc_feature (339)..(339): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagccttgcctccgtgtctgggtctcctggacagtcgatcaccgtcgtcctgcactgggaccagtaatgattttggaaattttgacctagtctcctggtaccaacaataccccggcaaagtccccaagttaatcatttatgagggcactaagcggccctcgaggtagtttcgngagtcgcttctctggctcaaggctaggacgaccggcctcctgaccatactctagggctccaggctgaggacgaggctcattacactgactgctcatatgagttatagctagttggtgttcggcgtcggaccaaagtgaccgtctagtcagcccaaggctcgcccctggtcacgtctcgttcccaccttcc

SEQ ID NO: 108986 - DNA, 543 bp, Homo sapiens
  misc_feature: GYAE6OF02I78XI.12.71.G05.1.454.CMB.1.raw
  modified_base (330)..(330): a, c, t, g, unknown or other
  misc_feature (330)..(330): n is a, c, g, or t
  modified_base (439)..(439): a, c, t, g, unknown or other
  misc_feature (439)..(439): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtcccccaagttaatcatttatgagggcactaagcggccctcagggatttcngatcgctttctctggctccaaggctggcgacccgggcctccctgacaatactctgggctccgaggctggaggacgaggctcattactactgctgctcatatggagttanagctagtttgggtgttcgggcggcgggaccaaaggtcgaccgtcaagtccaacgtcccaaggtctccgccccgtcggtcaccttcctcgtccccacccttcccg

SEQ ID NO: 108987 - DNA, 513 bp, Homo sapiens
  misc_feature: GYAE6OF02FWAYJ.12.71.G05.1.454.CMB.1.raw
  modified_base (362)..(362): a, c, t, g, unknown or other
  misc_feature (362)..(362): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagcagtgatgttgggacttataaccttgtctcctggtaccaacaacacccaggcaaagcccccaaactcatgatttatgaggcactaagcggccctcaggggtttctatcgcttctctggctcgagtctggcaacncggcctccctgacaatctcgtggggtccaggctggaggacgaggctgattattactgctagttcatatacaagcacttcactntcgtgtntcggngtggaccagctgccgtcctaagtcacgcccaaggcctacgcccctggtccactccg

SEQ ID NO: 108988 - DNA, 529 bp, Homo sapiens
  misc_feature: GYAE6OF02FKZ4D.12.71.G05.1.454.CMB.1.raw
  modified_base (409)..(409): a, c, t, g, unknown or other
  misc_feature (409)..(409): n is a, c, g, or t
  modified_base (431)..(431): a, c, t, g, unknown or other
  misc_feature (431)..(431): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgaggcactaagcggcctcaggagtttctgatcgcttctctggctcaaggctggcgaccggctcctgacaatatctgggctcaggctgaggacgaggctcattacnctgctgctcatagtggagttanagctacgttgggtgttcgggcggtcggacaaagtcgaccgtctaagtcacgcccaaggcctcgcccctggtcctaccttctcgttcccacccttcccg

SEQ ID NO: 108989 - DNA, 527 bp, Homo sapiens
  misc_feature: GYAE6OF02HX0LP.12.71.G05.1.454.CMB.1.raw
  modified_base (281)..(281): a, c, t, g, unknown or other
  misc_feature (281)..(281): n is a, c, g, or t
  modified_base (445)..(445): a, c, t, g, unknown or other
  misc_feature (445)..(445): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggnaaagtccccaagttaatcatttatgagggcactaagcggccctcaggagtttctgatcgcttctctggctccaaggctggcgaccgggcctcccgtgacaatatctgggctcgaggctggacggacgaggctctattactactgctgctcatagtggaggttanagactacgttgggtgttcggcggtcggaacaaggtgacgtctaagcacgccgagctcgccctgtcactctcttcccacctcc

SEQ ID NO: 108990 - DNA, 550 bp, Homo sapiens
  misc_feature: GYAE6OF02HYOZF.12.71.G05.1.454.CMB.1.raw
  modified_base (310)..(310): a, c, t, g, unknown or other
  misc_feature (310)..(310): n is a, c, g, or t
  modified_base (383)..(383): a, c, t, g, unknown or other
  misc_feature (383)..(383): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcttgggcccagtctgccctgactcagcctgcctccgtgtctgggtctcctggacagtcgatcaccgtctcctgcactgggaccagtaatgtattttaggaaattttgaccttagtcttcctggtaccaacaataccccggcaaagtccccaaagttaatcatttangagggcactaagcggccctcaggtagtttctgatcgcttctctggctcaaggctggccgaccgggcctcccgngacaatatcgtgggctccgaggctggaggacgaggctcattactactgctgctcatagtggagttatagcgtacgttgggtcgttcgggcgggacgggaacaaagtcgaccgtctaagtcacgcccaaggcctcgccccgttcgctcctctcgttccccaccctccc

SEQ ID NO: 108991 - DNA, 617 bp, Homo sapiens
  misc_feature: GYAE6OF02F6HJU.12.71.G05.1.454.CMB.1.raw
  modified_base (279)..(279): a, c, t, g, unknown or other
  misc_feature (279)..(279): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctctggtaccaacaataccccggnaaacgtccccaagttaatcatttatgaggcactaagccggccctcaggatttctgattcgcttctctggtctccaaggctggccgacccgggcctccctgaccaattctcgtgggctccgaggcctgacggacgaggctacacttactactgcgtcgccttcaagttacgtgggtaagtttagtacgtcgtacgtttggggttcggttcgggccgggcgggaaccgtaaacggtcgtaacccgttaccgtaacggtcgaaccggacccgtaaacgggtccctacccggtcccccgtccggtacctaccgttccgtcccgtttccccggcccttccccg

SEQ ID NO: 108992 - DNA, 611 bp, Homo sapiens
  misc_feature: GYAE6OF02HMG3H.12.71.G05.1.454.CMB.1.raw
  modified_base (258)..(258): a, c, t, g, unknown or other
  misc_feature (258)..(258): n is a, c, g, or t
  modified_base (267)..(267): a, c, t, g, unknown or other
  misc_feature (267)..(267): n is a, c, g, or t
  modified_base (290)..(290): a, c, t, g, unknown or other
  misc_feature (290)..(290): n is a, c, g, or t
  modified_base (319)..(319): a, c, t, g, unknown or other
  misc_feature (319)..(319): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactggacagtaatgtatttggaatttgacctagtctctgtaccaanataccccgnaaagtccccaagttaatcattangaggcactaagccggccctcaggatttcngatcgcttcgtctggctaccaaggtctcggcgacccgggtcctcccgtagacctaaatatccgtgggccttcccgagggtcctaggagggacggacggctctaactttactaacgtgcttaggcctacgtaatagtggtaagtttataggtacctacgtttggggtagttcgggacgggccgggaacaaaaggtcgtaccgtaccgttaaggtccgaacggacccgtaaggcccttcccggacccccgttggtacccaacgtttacctaccgttacccccgacccttccccg

SEQ ID NO: 108993 - DNA, 547 bp, Homo sapiens
  misc_feature: GYAE6OF02IRSUM.12.71.G05.1.454.CMB.1.raw
  modified_base (231)..(231): a, c, t, g, unknown or other
  misc_feature (231)..(231): n is a, c, g, or t
  modified_base (301)..(301): a, c, t, g, unknown or other
  misc_feature (301)..(301): n is a, c, g, or t
  modified_base (328)..(328): a, c, t, g, unknown or other
  misc_feature (328)..(328): n is a, c, g, or t
  modified_base (378)..(378): a, c, t, g, unknown or other
  misc_feature (378)..(378): n is a, c, g, or t
  modified_base (439)..(439): a, c, t, g, unknown or other
  misc_feature (439)..(439): n is a, c, g, or t
tcagatacgacgtacacgaccggtgctcgatttagtgtcgtcgcaagagagagggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaangattttggaaatttgactagtctctggtaccaacaataccccggcaaagtccccaagttaatctatttangaggcataagcgcctcaggtagtttcngatcgcttctctggctccaaggctggcgtaccggcctccctagacaatanctgggcctccgaggctgaaggcagctcattacactgcttgacttcatactggacggttaanacgtctagttggtcgtcgggacgacggaactaagtcgaccgtacgtaagtcgacgtaccgaggtcctaccgtcccgtcggtactacctcgttccgtcccctacctccg

SEQ ID NO: 108994 - DNA, 526 bp, Homo sapiens
  misc_feature: GYAE6OF02GQVK3.12.71.G05.1.454.CMB.1.raw
  modified_base (307)..(307): a, c, t, g, unknown or other
  misc_feature (307)..(307): n is a, c, g, or t
  modified_base (449)..(449): a, c, t, g, unknown or other
  misc_feature (449)..(449): n is a, c, g, or t
  modified_base (522)..(522): a, c, t, g, unknown or other
  misc_feature (522)..(522): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctcctggtaccaacaataccccggcaaacgtccccaagttaatcatttangaggcactaagcgccctcaggagtttctgatcgcttctctggctccgaacggctggcgaccgggcctcccgtgacaatatcgtgggctccgaggctaggaggacgaggctcattactactgctgcttcattagtgtagttanagctagtttgggtgttcggcgcgggacaagtcgaccgtcaagtcagccagctcgcccgtcgcactctctcccncctc

SEQ ID NO: 108995 - DNA, 535 bp, Homo sapiens
  misc_feature: GYAE6OF02FNHU7.12.71.G05.1.454.CMB.1.raw
  modified_base (322)..(322): a, c, t, g, unknown or other
  misc_feature (322)..(322): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagcagtgatgttgggacttataaccttgtctcctggtaccaacaacacccaggcaaacgcccccaaatcatgattatgaggcactaagcgccctnagggtttcttatcgcttctctggctccaagtctgactacacggcctccctgaccatctcgtcgggctccaggctgaggacgaggctgattattactgctagttcattataacaagcacttccactcttcgtggttcgttcgggcgggtggaccgaagcgtacgaccgttctaagtcacggcccaaggcctccggcccccgttcggtcctaccg

SEQ ID NO: 108996 - DNA, 633 bp, Homo sapiens
  misc_feature: GYAE6OF02JO6GM.12.71.G05.1.454.CMB.1.raw
  modified_base (329)..(329): a, c, t, g, unknown or other
  misc_feature (329)..(329): n is a, c, g, or t
  modified_base (455)..(455): a, c, t, g, unknown or other
  misc_feature (455)..(455): n is a, c, g, or t
tcagatacgacgtacacgaccggtgctcgatttagtgtcgtcgcaagagagaggggggggtcgacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctctggtacacaatacccggcaagtccccaagttatcatttatgaggcactaagcggccctcagggtatttcngtatcgcttctctggctccaagctggccgacccgggcctccgtgactaactagtcgtagggcttcccgagggcttaggagggtaccgagggccttcgaactttaccgtactcggtcttcgaccttnacttagttacgggtaggtttagttaacggtacttaccgttttggggtcggtttccgggcgggtcgggaacctaaacggtcgaaccgttccgtaagtccgaacggacccgtaagggacctccggtacccccgtcggttacccacgtttcccgtccggtttacccctaacccgttccccg

SEQ ID NO: 108997 - DNA, 747 bp, Homo sapiens
  misc_feature: GYAE6OF02IV1O0.12.71.G05.1.454.CMB.1.raw
  modified_base (270)..(270): a, c, t, g, unknown or other
  misc_feature (270)..(270): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgacgttggtagttataactatgtctcctggtaccaanacgcaccaggaccaaaccgcccccaactcctagtactttacgtcgagtcaacttattccggtacctgaacggtaatttctaaactcgtactttccttcgttacggttacctaaggttccgttacggaccgtaaaccacccggtcccttccccgtacgtaccctaagttaccgttccgttacgggggtaccctaacggggtcctacggggaacgggaccggaacgggtcttaggtaacgttttaattaccgtcggtacttaacgtttactaagttaactaaacgaaacgtacccttaacctttaccctaacctttccgttacggtttcgggtttaccggttccgggggtaccgggttacggggaacccgtaaggtcccggttaacggtaaccccggttaaccgttaacggttaccgaacggttaccccgaaacgggtcccgttccccggacccccgtttaccgggtaccttaacccgg

SEQ ID NO: 108998 - DNA, 594 bp, Homo sapiens
  misc_feature: GYAE6OF02HEY82.12.71.G05.1.454.CMB.1.raw
  modified_base (218)..(218): a, c, t, g, unknown or other
  misc_feature (218)..(218): n is a, c, g, or t
  modified_base (306)..(306): a, c, t, g, unknown or other
  misc_feature (306)..(306): n is a, c, g, or t
  modified_base (431)..(431): a, c, t, g, unknown or other
  misc_feature (431)..(431): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcaccctcctcactcagggcacagggtcctgggcccaatctgccctgactcagcctgcctccgtgtctgggtctccgtggacagtcgatcacctatttccngcaccggaaccagcagtgatgctggggatgataagtttgtctcctggtaccaacatcacccaggcaaagccccagactcatgatttangagggacaaaaaacggcccgtacggggatttcgtaatcgtcttctctggctcgaagtctggtacaacacggccctccctacgacaaactctacgtcgggctccgaggtctggacggacgacggtntggtattattactgtctgtctactataagtcgtacgaaggttaggtgacttacgtttcgactacttacgttcggacgggacgggaaccgaacgtccgttacggacccgttacccgtacggtaccacggtacccgtaacgggccttaccggcccccgttaccgg

SEQ ID NO: 108999 - DNA, 593 bp, Homo sapiens
  misc_feature: GYAE6OF02IEUOR.12.71.G05.1.454.CMB.1.raw
  modified_base (302)..(302): a, c, t, g, unknown or other
  misc_feature (302)..(302): n is a, c, g, or t
  modified_base (375)..(375): a, c, t, g, unknown or other
  misc_feature (375)..(375): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctggtctcctggacagtcgatcaccgtctcctgcactgggaccagtaatgtattttggaaattttgacctagtctcctggtaccaacaactaccccggacaaagtccccaagttaatctatttangaggcaactaagcggcctcgaggtgtttctgatcgcttctctgctccagctggcgaccggcctcctgacaatntcgtgggctccgaggctgacggacgaggctacattactactgctgctctatagtggaagttatagtctcgtttaggggttgtttccgggcggccgggtaaacctaaaggtcgaaccggttacctaaggttaccgacggtaccccgaagggccccttaccggaccccccgttcgggttacccaccgttcccgttccgtttccccccaccctttcccccg

SEQ ID NO: 109000 - DNA, 571 bp, Homo sapiens
  misc_feature: GYAE6OF02HGTIA.12.71.G05.1.454.CMB.1.raw
  modified_base (328)..(328): a, c, t, g, unknown or other
  misc_feature (328)..(328): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaaagttaatcatttatgaggcactaagcggcctcaggagtttcngatcgcttctctggctccaaggctggcgacccggcctcctgacaatatcgtggctccgagctgaggacgagggcggattattactgttcgcttcattatggtacgggtagtaagtctacgtttcgattcgtccttagttccgggcgggtacgggaccaagctacggtccgtaccgtggggtacctacggcccgtaaggccgtcgccccccgttcggtccctaccgttcgttccgttccccccg

SEQ ID NO: 109001 - DNA, 578 bp, Homo sapiens
  misc_feature: GYAE6OF02F7PWD.12.71.G05.1.454.CMB.1.raw
  modified_base (311)..(311): a, c, t, g, unknown or other
  misc_feature (311)..(311): n is a, c, g, or t
tcagatacgacgtacacgaccggtgctcgatttagtgtcgtcgcaagagagaggggggggggtctcaggaggcagcgctctcaggacatctccaccatggcctgggctctgctgctcctcaccctcctcactcaggacacagggtcctgggcccagtctgccctgactcagcctgcctccgtgtctgggtctcctggacagtcgatcaccgtctcctgcactgggaccagtaatgtattttggaaattttgacctagtctcctggtaccaacaactaccccggcaaacgtcccccaaagttaatcatttanggagggcactaagccggccctcgaggtagtttctgatcgtcttctctggctccgaaggctgggcgaccggcctccctgacaatagtcctgggcctccgaggtcctggacgggacgaggtcctactattactactgctgctacatagtggagttatagctacgttgggtcgttcgggcgggaccggtaacgaaaggtcgacccgttactaaggtccacggcccgaagccgtccgccccgttcggcctactccttcgttccccctcccg

SEQ ID NO: 109002 - DNA, 531 bp, Homo sapiens
  misc_feature: GYAE6OF02H9NAU.12.71.G05.1.454.CMB.1.raw
  modified_base (306)..(306): a, c, t, g, unknown or other
  misc_feature (306)..(306): n is a, c, g, or t
  modified_base (341)..(341): a, c, t, g, unknown or other
  misc_feature (341)..(341): n is a, c, g, or t
  modified_base (431)..(431): a, c, t, g, unknown or other
  misc_feature (431)..(431): n is a, c, g, or t
  modified_base (525)..(525): a, c, t, g, unknown or other
  misc_feature (525)..(525): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttcgacttagtctcctggtaccaacaatacccggcaaagtccccaagttaatctatttangaggcactaagcgcctcaggatttctgatcgcttntctggctcaaggctgcggaccggtctcctgacaatagtctgggctccgagctggacggcgaggctcgattactactgactgctcattagnggtagttatagctagtttggtggttcgcggcggacaagtcgaccgtactagcagacccaggcctcgccccgtagtaccaccttcctcgttcccnccttcc

SEQ ID NO: 109003 - DNA, 605 bp, Homo sapiens
  misc_feature: GYAE6OF02F99HA.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccgaggcagacgccccccaactcctgatttatgaggtcactattcggtcctacgaggtaatttctaatcgtctttctcttcggttccaagttcgtggaccaacgaccgtccctccctagacctactcctcgtcggggtaccagggctggacggacgaggcttaggtacttattacgtgactagtttacattaactacaagtcctaaccttccacttccgttcggtggttcgtcgggtcggtcgggaccaggtcctcggtaacccgttcctaacggtccaacggtcccgaagggtccctaccggtcccccgtacggttccacccgttcccg

SEQ ID NO: 109004 - DNA, 571 bp, Homo sapiens
  misc_feature: GYAE6OF02IK397.12.71.G05.1.454.CMB.1.raw
  modified_base (306)..(306): a, c, t, g, unknown or other
  misc_feature (306)..(306): n is a, c, g, or t
  modified_base (413)..(413): a, c, t, g, unknown or other
  misc_feature (413)..(413): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaatttgacctagtctcctggtaccaacaactaccccggacaaacgtccccaagttaatcatttangaggcactaagccggccctcaggagtttctgatcgtcttctctggctccgaaggctggccgaccgggcctccctgacatatcgtgggctccgaggctaggaggacgnggctcattactactgctgctacgatagtggtagttatagctacgttgggtcgttcgggcggtacgggaaccaaggtcgaccgtacgtaagtaccgacgtacccgaaggtccgtaccgccccgttcggtccaccgttctccgttccccctaccctcccg

SEQ ID NO: 109005 - DNA, 693 bp, Homo sapiens
  misc_feature: GYAE6OF02GVHDD.12.71.G05.1.454.CMB.1.raw
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagcagtgatgttggacttataaccttgtctctcggtaccaacagcacccaggcagacgacccccaaatcatgtattttgatgtacactaagtccggccctcgtaggggtttctgactcgtcttctcgtcggctaccaagtctgactacgaccggtcctcccgtgacctatccgtcgtcgggtcctaccggaggtcgtaggaacgggaccggtacggtcgttaggtaacttttacgttagtttcgactacggtacttaccgtaaattaacgttaaaccgaacgaccgtaacggtacccgacggtaaccccttaaccccgtttcgttttacggttaccggtttaccggggaaacgggttaaccggggtaacccgtaaacgggttaccccgtaaccccggtttacccgttaaccggttacccgtaaccgggaacccccgtaaaccgggtacccccctaaaacccccgg

SEQ ID NO: 109006 - DNA, 907 bp, Homo sapiens
  misc_feature: GYAE6OF02JR2B3.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatccaccgtctcctgcactgggaccagtaatgtattttggaaattttgaccttagtctcctggtaccaacaactaccccggacaaacgtccccaaagttaatcctaatttatggtagggacctaacgtaacgccggtacccctacgagggtacgtttccgtgtaactcgtcctttcctcgttcggacctccgaacggtccgtcgggacccggtacccggggtccccttacccgttacgggacctaaaacgttacgttaccggttcggggtcccttaccggtaacgggtccctagggtaacgggaccggtaacggggtccttaccgtaaacgtttaaccgtaacgttcggtccgttacggtacccttacgtaacgtttaaggttacggggttaacgggttttaaacgttaacgggtaccgtttaacgggttttacggggggttacgggttttacccggggggtacccggggttaacccgggggttaaacccggttaaaaacgggtttacccgggtaaccccggggtttacccgttaaacccgggtttaacccgggtaaacccggggttacccccggtaaaacggggtcccccgtttaaccccgggtcccccccccggtttaaccgggttaccccggtttaaccccgtttaccccggttttaccccgggttttaccccccccgtaacccccccgttttacccccgg

SEQ ID NO: 109007 - DNA, 692 bp, Homo sapiens
  misc_feature: GYAE6OF02G16G9.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtcgtgggtctccgtggactagtcgactccaccgtctcctgccacgtcgggaccagtaatgtattttaggtaaattttcgacttagtcttccgtggtaaccaactaacgtaaccccgactaaacgtaccccaaagttaactctatttacaggacggacaacgtaaggcccggtaccctacgaacgggtatttcgtagtactcgtcttctcgtcggtcctaccgaacggtcgtcgggaccggacccgggtccctaccgtcgaacgtaatacgtacgtcgggacctccgacggtcgtacgggaacggacgggacggaccgtacgtaacttacgtacgttcgacgttcgtcttacacgttagtagggtaggttatacgtacgtacggttgggtggttcgggcgggtacgggtaacgtaaacgttccgaccgttaccgtaacgtccgtaccggaccgtaaggcccgtaccgtccccggacgttcctacgttccgtccgtccccctaccgtccccg

SEQ ID NO: 109008 - DNA, 593 bp, Homo sapiens
  misc_feature: GYAE6OF02JSSFF.12.71.G05.1.454.CMB.1.raw
  modified_base (443)..(443): a, c, t, g, unknown or other
  misc_feature (443)..(443): n is a, c, g, or t
  modified_base (533)..(533): a, c, t, g, unknown or other
  misc_feature (533)..(533): n is a, c, g, or t
tcagatacgacgtacacgaccggtgctcgatttagtgtcgtcgcaagagagagggggggtcgacaagaggcagcgctctcggacgcctccaccatggcctggctctgctgctcctcactctcctcactcaggacacagggtcctgggcccagtctgccctgactcagcctgcctccgtgtctgggtctcctggacagtcatcaccgtctcctgcaacgtgggaccagtaactgattttggaaattttgacctatctcctgtaccaacactacccgcaaacgtcccaagttactacatttatagaggtctactaagccgaccctcacggtagtttcagtatcgtcttctctggtcctccgaaggtctacggtcgacccgggtccctaccgtgactatactctacgggtctcacggctcgagcgtaggctcattactacgctgtntaccgtctaatcgtagggtacgtattacggactaacggtttgggttacggttgggaccgtcgggtaacaaggttcgacctcgtacgtacncggttaccgagtaccgtcgaccccgtcggtctaaccgtcttaccggtccctcccttaccg

SEQ ID NO: 109009 - DNA, 556 bp, Homo sapiens
  misc_feature: GYAE6OF02G7HVW.12.71.G05.1.454.CMB.1.raw
  modified_base (466)..(466): a, c, t, g, unknown or other
  misc_feature (466)..(466): n is a, c, g, or t
  modified_base (550)..(550): a, c, t, g, unknown or other
  misc_feature (550)..(550): n is a, c, g, or t
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctcctggtaccaacaactaccccggcaaaacgtcccccaaagtttaactcaatttatggagggcactaagccggccctcaggagtttctgatcgtcttctctggctccgaaggtctgggccgacccgggcctcccgtgacaatactcgtgggctccgaggctggacggacgaggctacattactactgctgctcatagtggtagttanaggctagttggggtgttcgggcggacggactaagtcgaccgtctaagtcacgccgagctccgcccctggccactctccgtcccnccctcc

SEQ ID NO: 109010 - DNA, 560 bp, Homo sapiens
  misc_feature: GYAE6OF02FXNS5.12.71.G05.1.454.CMB.1.raw
  modified_base (283)..(283): a, c, t, g, unknown or other
  misc_feature (283)..(283): n is a, c, g, or t
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctcctggtaccaacaataccccggnaaagtccccaagttaatcatttatgagggcactaagcggccctcaggagtttctgatcgcttctctggctccaaggctggcgaccgggcctcctgacaatatcgtgggctcaggctggaggacgaggctcattactactgctgctcatagtggtaggttatagctacgtttgggtgttcgggcgggacgggaaccaaggtcgaccgttaccgtaagtccgacgcccgaaggcctccgccccctgggtccaccgttctccggttccccgcccttcccg

SEQ ID NO: 109011 - DNA, 712 bp, Homo sapiens
  misc_feature: GYAE6OF02HTLL6.12.71.G05.1.454.CMB.1.raw
  modified_base (310)..(310): a, c, t, g, unknown or other
  misc_feature (310)..(310): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtggaccagtaatgtattttaggaaattttgacctagtctcctggtaccaacaactaccccgacaaacgtccccaaagttaatcatttangaggcactaagccggcctcgaggtagtttctgattcgtcttctctggctccgaaggctggccgacccgggtcctccgtagaactaagttacgtcgtcgggcctaccgaaggtccgtaggaacgggtacggaacggtccttacgtaacgtttacctaaccgttacgtccttacggaccttaccgtagtttaaggttacgggtaaggttttaacgtacggtaccgttacgggttttggggttacgggtttccgggggaccgggttaaccggggaaacccgtaaaagggtccgtaacccggttaccgttaacggtaccgtaaccggaccccgtaaacgggtcccgtacccggtcccccgtcggtaccctacccgttccgttaccgttcccccacccgtttccccg

SEQ ID NO: 109012 - DNA, 568 bp, Homo sapiens
  misc_feature: GYAE6OF02IZ33P.12.71.G05.1.454.CMB.1.raw
  modified_base (445)..(445): a, c, t, g, unknown or other
  misc_feature (445)..(445): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgaggcactaagcggccctcaggagtttctgatcgcttctctggctccgaagctggcgaccgggctcccgtgacaatactctcgggctccaggctggaggacgaggctcattactactgtctgctcatagtggtaggttanagtctacgttgggtcgttcgggcgggcgggaacctaaaggtcgacccgttacgtaagtacgaacgtacccaaggtcctccgtcccccgtcggtcctacgtcctaccgttccccgcccttcccg

SEQ ID NO: 109013 - DNA, 680 bp, Homo sapiens
  misc_feature: GYAE6OF02GRAW1.12.71.G05.1.454.CMB.1.raw
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
  modified_base (336)..(336): a, c, t, g, unknown or other
  misc_feature (336)..(336): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctctgtacaacataccccgnaaacgtcccaagttactctatttangagggcaactaagccggtccctacaggtagtttcnggacttccggtctttcctcgtggtcctaccgaaaggtcgtcgggaccggaccccggggtcctacccgtacgaacctaattacgtcgtcgggtcctaccgagggtctaggacgggacgtacggctacgtaattaccgtacgtcgtaccttgtacttacgattagtacgggtaagttagttaggttacgtttggggttacgttccggggacgggtccggggtaaacctaaacggtcggtaacccgtaccgttacggtactaaccggacccgtaacggtccgtcccggacccccgttggtcccgtaaccttcccgttaccgttcccccgtacccttcccgttacccg

SEQ ID NO: 109014 - DNA, 541 bp, Homo sapiens
  misc_feature: GYAE6OF02FSQXL.12.71.G05.1.454.CMB.1.raw
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcgccctcaggtagttctgatcgctttctctggctccgaaggctggcgacccgggcctcccgtgaactaatatcgtgggctccgaggctggaggacgaggctcattactactgctgctcatatggtaggttatagctagttgggtgttcgggcggcggacaagtcgaccgtctaagtcgacgccgaggtcctcgcccgtcgtccacctctcgtccccacccttc

SEQ ID NO: 109015 - DNA, 553 bp, Homo sapiens
  misc_feature: GYAE6OF02HZOBS.12.71.G05.1.454.CMB.1.raw
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
  modified_base (450)..(450): a, c, t, g, unknown or other
  misc_feature (450)..(450): n is a, c, g, or t
  modified_base (544)..(544): a, c, t, g, unknown or other
  misc_feature (544)..(544): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctctgcactggaccagtaatgattttggaattttgacctagtctctgtaccaacaatacccgnaagtccccaattancattatgaggcactaagcggcctcaggtagtttctgatcgtcttctctgctccaaggtctcggccgaccgggcctcccgtgacctaagtactcgtacgggctaccgaggtctggaaggacgacggctctaattactactgactgctacatagtggtagttanagtacagtttcggtgttcggcggtcggacaaagtcaccgtcgtaagcgaacgtcccaggtcctccgcccctggtccaccttccgtcgttccccncccttaccc

SEQ ID NO: 109016 - DNA, 877 bp, Homo sapiens
  misc_feature: GYAE6OF02H616Z.12.71.G05.1.454.CMB.1.raw
  modified_base (374)..(374): a, c, t, g, unknown or other
  misc_feature (374)..(374): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactcctcctcactcgaggacacgacgggtccgtcgggcccagtctcgccctgacctcgacgtcctcgtccctccggtcgtcgtcgggttcctccgtggactaggtcgtactccaccgttcctccgtcgacctacggtcgggaacctaagttaatgttagttttaggtaaatttcgaccttgtcctccgttacggtaaccaaactaaccgtaccccggactaaaaccgtacccctaaagttactacttaatttagnggacggacctaacgtaacggcccggtaccctacgaacgggttactttcgtagtacgttccgtctttcctcggtcggtcctaacccggaaggtccgtacggggaccccgggtaccccgggtcccttacccgtagtaactaaacgttacgttccggtcgggtacccctacggacgggtccgtaagggaacgggtaaccggacggtcctacgttaaacgttaccttacgtaccgtcgttacgttacctacttaacgttaggtacggggttaaagtttaacggtaaccgttcgggtttaacgggttttcggggtttacggggtcccggggtaccgggggtaacccgggtaaaaccggttaaacgggtacccggttaaccccgtttaacggtaaccgtaccggtaacccggacccggtaacggtccccgttcccccggtaccccccgttacggtccctacccgtttccggtttacccccggttccccccgtacccgttttacccccgg

SEQ ID NO: 109017 - DNA, 736 bp, Homo sapiens
  misc_feature: GYAE6OF02H4IJ6.12.71.G05.1.454.CMB.1.raw
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgaccttagtctcctggtaccaacaacgtaccccggcaaaacgtccccaaagttaatctaatttatgagggcaacgtaagccggccctcaggtacgtttctggactcgctttctcgtcggtctaccgaaggtccgtacggccggtaacccggtccgtaccctcgacgtaaactattacgtcgggtccgtaccgtcggcgttacgggacgggacggacgggtctacgtacttaacgttaccttacgcgttacgtcttacgtagttaagttacgggtagggtttaacgttaacggtaccgttacggtttggggtttacgggtccgggttacggggaccggggtaacccgtaaaacggtaccgttaacccggtacccgttaacggtaccgtacggaacccggtaacgggtacccgtcccgttaccccccggttaccggtaccgttacccgtcccggttttaccggtttccccccgtacccctttaccccgg

SEQ ID NO: 109018 - DNA, 573 bp, Homo sapiens
  misc_feature: GYAE6OF02H2VTP.12.71.G05.1.454.CMB.1.raw
  modified_base (308)..(308): a, c, t, g, unknown or other
  misc_feature (308)..(308): n is a, c, g, or t
  modified_base (340)..(340): a, c, t, g, unknown or other
  misc_feature (340)..(340): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctctggacagtcgatcaccgtctcctgcacgtgggaccagtaatgtattttggaaattttgaccttagtctcctggtaccaacaactaccccggcaaacgtccccaagttatcatttangaggcaacgtaagcggcctcgaggtagtttcngatcgtcttctctggctccgaaggctggccgaccggcctcctgactaatctcgtgggctcgaggctggaggacgaggctctacttactatgctgtctctatagtggaagttatagtctacgtttgggtcgttcggcggcgggtaacaaacggtcgaccgttacgtaagtcgacgtacccgaggcccttccgccccgttcggtccaccgttccgtcgttccccacccgttcccg

SEQ ID NO: 109019 - DNA, 642 bp, Homo sapiens
  misc_feature: GYAE6OF02HBWD6.12.71.G05.1.454.CMB.1.raw
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
  modified_base (474)..(474): a, c, t, g, unknown or other
  misc_feature (474)..(474): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagtaatcatttangaggcactaagcggccctnaggtagtttcngatcgcttctctggctccaaggctcggcgacccgggcctcccgtagacctaatacgtctcgggcctaccgaggctaggagggacggagggtcctacaacgttacctactcgcctgccttacgattagtaggtaggtttanacgtctacgtttggggttacgttcgggaccgggacgggtaccaaaggttcgaacccgttacgttaacggtccgtaacggccccgtaaaggtccgttaccggaccccccggtttcggtcccgttaacccgttcccgttcccgggtttacccccgcccccgtttaccccg

SEQ ID NO: 109020 - DNA, 814 bp, Homo sapiens
  misc_feature: GYAE6OF02H5C9E.12.71.G05.1.454.CMB.1.raw
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgccctccgtgtctgggtctcctggacagtcgatcaccatctcctgcactgcaaccagcagtgacgttangataataatattcnctaggtacagcacaccgaggacaagcccccaatcctctattatggtcgtacgggtaatccggaccgtcgtaggggtttactaacgtcgtacctttcctaccgtcggtaccttaccgaacggtttccgttacggggaaccctaaaaccgggtcccttaccccgtacggtaacccctacgttcccgtttaccgtacgggaaccctttccccgtaacggtaccccgttacgggaacgggtaacccgggtacgggtacccggtaacgtttttaacctaaaccggttcgtaccgtaagtttccggaacctaaccggtaacggaccgaaaacggggtccctttaaccccgtacgggttttacggggttacgggtttacccggggaccggggtaaacgggtaaacccgttaaacccgggttcgtaaccccgggtttacccgttaacgggttaacccgtaaccgggtacccccggttaaagggtccccgtttaccccggacccccggtttccgggtaaccctacccggtttacccggtttccccggttacccccggttacccccccg

SEQ ID NO: 109021 - DNA, 815 bp, Homo sapiens
  misc_feature: GYAE6OF02J3IQB.12.71.G05.1.454.CMB.1.raw
tcagatacgacgtacacgaccggtgctcgatttagtgtcgtcgcaagagagaggggggggtcacaagaggcagcgctctcgggacgtctccaccatggcctgggctctgctgctcctcactctcctcactcaggacacgacgggtcctcggaccaatcctcgccctgactcacgcctcgcctccgtgtcgtcgggtctacgtacggacgtacgtcgactccgaccgttctccgtgactaccggtacgggacctaaggttaacttggttaacgttttagtaaacgttttcgaaccgttcgtaccttaccgtacgtaacccaaaccgtaccgtaacccggtaacctaaaccgttacccgtaattactacgtattaggacgagactacgtacgcgtacctagtaggtacttgacgtactcgtactcgcgtacgcgtacgacgtcgtcccgggaccgtcccgtaccgtaccgtacgtaacgtacgttccgtcggtccggtaccgtaccggaggtccggtaacggtacgggacgtaccggttacttaacctaaccggtttaccgagttccgtaccttaccgttacgtaaccggttaggttacgtaagggtttaccttacgtacggttaccggttaccggggttcgggtaaccgggtccgggtaacggtaacccggggtaaacttcgggacccgttaaccggtaccgtaacggtccgggaaccccgttacggaacccgttcccggttaccccgttaacccggttccgtaccccgttaccggtttacccccgttacccgttaccccccgtagtttaccccgg

SEQ ID NO: 109022 - DNA, 614 bp, Homo sapiens
  misc_feature: GYAE6OF02GRM4X.12.71.G05.1.454.CMB.1.raw
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
  modified_base (458)..(458): a, c, t, g, unknown or other
  misc_feature (458)..(458): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtcctcctggacagtcgatcaccgtctcctgcacgtggaccagtaatgtattttggaaatttgactagtctctgtacanaatacccggnaacgtcccaagttaatcattatgaggcactaagcggcctacgaggtattctgactcgtcttctcgtgctaccgaagctgaccaacgtacggcctcctagaactactctcgtcggtcgtaccnggtcctgggacgaaccgnggacttacgtaatttaacgtctagcgtacgtactctaacgtntacgacggtaaggtcgtcggtaccttaccgtttccggataccgttacggttcgggacgggaacgggtacctaggccgttccggaacccgtccgttaaccgttcgaacccgtacccggtaacggccttacccgcccccggttacggacttaccccgg

SEQ ID NO: 109023 - DNA, 701 bp, Homo sapiens
  misc_feature: GYAE6OF02H7MM5.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcgtggacagtcgatcaccatctcctgcactcggaaccagcagtgacgttggtggttatactatgtctcgtgtacaacagcaccagcagacgccccaaactcatgtattttgactgtctactaacgtccggcctcgtagggtttctagactccgtctttctcgtcggctacctaagttctacgtaacctacgacccggtcctcccgtacgaccgtcttccgtccgtcgggtccctaccgtaggtccgttagggaacgggtaccgggacgggtacgtttacggttaattttaacgtttacgttacggacgtacgttactaacgttacttaaacgtaaaccgaagtcctaacggactaccgtacccttaacccgtttcgttttaccgttacgggttaccgggttaaacggttaccggggtaaccccgttaaaccggttcccgtaacccgggtttaccccgttaaccggtacccgtaaccggtacccccggttaaaccccggtaaacccccccg

SEQ ID NO: 109024 - DNA, 659 bp, Homo sapiens
  misc_feature: GYAE6OF02G47JK.12.71.G05.1.454.CMB.1.raw
  modified_base (283)..(283): a, c, t, g, unknown or other
  misc_feature (283)..(283): n is a, c, g, or t
  modified_base (338)..(338): a, c, t, g, unknown or other
  misc_feature (338)..(338): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtgggaccagtaatgtattttggaaattttgacctagtctcctggtaccaacaactaccccgnaaacgtccccaagttaatcatttatgaggcactaagcggccctgaggtagtttcngatcgtcttctcgtggctccgaaggtctcgggccgaccgggtcctccgtgaactaatactcgtgggcctccgaggtctaggacggacgagggtcctactatttaaccgtactcgcttacgccttactattacgtaggtaaggtttatacgtcgttacggtttggggtcgtttccggggacgggtaccggggtaaacctaaacggttcgtaacccggttaccgtaacggttccgaacggtaccccgaaggtccttcccggtaccccccgttcgggttacctacccgtttccggttcccggttccccccgtccccttaccccg

SEQ ID NO: 109025 - DNA, 577 bp, Homo sapiens
  misc_feature: GYAE6OF02HV4O1.12.71.G05.1.454.CMB.1.raw
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
  modified_base (411)..(411): a, c, t, g, unknown or other
  misc_feature (411)..(411): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccatctctgcacgtcggaccagcagtgattggtaggacttataaccttgtctctgtaccaacaacaccagacaaacnccccaaancangtattangagacactaagcgcctcgtagggttctagtcgtcttactcgtgtctccgagtctggaccaacgcggccctccagacaactctagtcggctccgagctagaggacgaggngtacttaattcgttgtcgtcttacaagtataggtcgggttaatacggtacttacgtttccgaattcgttactagttaccgggacggtaggaccctaaggtcgtaccggtacgtcccggtaggtacctacggacccggtaagccgtccggttacccgtcgtaacccg

SEQ ID NO: 109026 - DNA, 684 bp, Homo sapiens
  misc_feature: GYAE6OF02HL7LT.12.71.G05.1.454.CMB.1.raw
  modified_base (310)..(310): a, c, t, g, unknown or other
  misc_feature (310)..(310): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgaccttagtctcctggtaccaacaactaccccggcaaacgtccccaaagttactcatttangaggcacgtaagcggcctgaggtatttcngatcgcttcncttggctcgaagctcggcgacccggctccgtgacaattactcgtgggcctccgaggctaggaggacgaggtccgtctaacttacgtaccgtgtacttcggtactacgtattagtggtaaggtttacgttaacgtccgttaccggtttggggtttcggttacgggggttcccggaacccgggggtaaaccgtaaacgggttacggtaacccggttacccgttaaacggtcccgtaacgggtccccgtaaaacgggtcccgttaacccggtccccccgttacgggtaccctaaccgtttcccgtttacccggtttcccccggtaccccctttcccgg

SEQ ID NO: 109027 - DNA, 665 bp, Homo sapiens
  misc_feature: GYAE6OF02JRC2O.12.71.G05.1.454.CMB.1.raw
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagcagtgatgttggacttatacttgtctctggtaccaacaacaccagcaaacgaccccaaactcactgatttactggacgggcaacgtaacggtccggaccccttcgtaacggggttttcttacttccggtctttccgtcgttcggtccgttccgagttcgtcggacaaccgtaccgggtcccttcccacggtaacctaacttccgtccgtcgggtccctaccgtacgggcgttacggacggaacggtacggtacggtaattttactaacgttggtttcgctttacgaattagttgggtaccgggttaagtacggaccttacgtttcgtaagtttcgttacccttaggttccgggacgggtagggtacctaagtccgtacgtaccggttcggtacggtaccgacggaccctacgggacctccggtccccggtacggtccctacg

SEQ ID NO: 109028 - DNA, 579 bp, Homo sapiens
  misc_feature: GYAE6OF02JC110.12.71.G05.1.454.CMB.1.raw
  modified_base (180)..(180): a, c, t, g, unknown or other
  misc_feature (180)..(180): n is a, c, g, or t
  modified_base (264)..(264): a, c, t, g, unknown or other
  misc_feature (264)..(264): n is a, c, g, or t
  modified_base (274)..(274): a, c, t, g, unknown or other
  misc_feature (274)..(274): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
  modified_base (427)..(427): a, c, t, g, unknown or other
  misc_feature (427)..(427): n is a, c, g, or t
  modified_base (437)..(437): a, c, t, g, unknown or other
  misc_feature (437)..(437): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctcgtntctggtctcctggacagtcgatcaccgtctcctgcactgggaccagtaatgattttggaatttgacctagtctcctgtaccaanataccccggnaaacgtccccaagttaancatttangaggcactaagcgcctcaggagtttcngatcgtcttctctggacttccgaaggtctggacgaccgggcctccgtgacaatctcgtgggcctccgaggcctggagacgaggcggtattatactggttcnctcattacgngtacgggtataagtcgtaactttcgattcggttcctagtttccgggcgtacgggaaccagccgtgtacccggtccgtgggttccacggacccgtaaggcccttcggccccccgttaggtcctacctccgttggttccccccg

SEQ ID NO: 109029 - DNA, 766 bp, Homo sapiens
  misc_feature: GYAE6OF02H2W5C.12.71.G05.1.454.CMB.1.raw
  modified_base (308)..(308): a, c, t, g, unknown or other
  misc_feature (308)..(308): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatccaccgtctctgcacgtgggaccagtaatgtattttggaatttgactagtctcctggtaccaacaactacccggactaaacgtcccaagttaactctatttangaggcactaagccgcctgaggtatttctgtatcgtcttctcgtcggtcctaccgaaggtcgttacgggccggtaaccccgggtcccttacccgtagaaacctaagttacgtacgtcggggtacccttaccgagggtccgtagggaacgggtaccggtaacggtccttacgtaaacgttaccgtaaccgtcgtacgttcgtaccttacgttaaacgttagtaacggggtaaggttttaaagtacggtaccggtttacgggttttagggggtttcgggttacccgggggaccggggttaaaccggggtaaaacccggttaaaacgggttcccgtaacccgggttacccgttaaacgggtccgtaaaccggacccggtaacgggtcccgttaccccggtcccccggttacgggtaccctacccgttcccggttaccccgttacccccacccgtttaccccg

SEQ ID NO: 109030 - DNA, 538 bp, Homo sapiens
  misc_feature: GYAE6OF02HEMFK.12.71.G05.1.454.CMB.1.raw
  modified_base (331)..(331): a, c, t, g, unknown or other
  misc_feature (331)..(331): n is a, c, g, or t
  modified_base (431)..(431): a, c, t, g, unknown or other
  misc_feature (431)..(431): n is a, c, g, or t
  modified_base (455)..(455): a, c, t, g, unknown or other
  misc_feature (455)..(455): n is a, c, g, or t
tcagatacgacgtacacgaccggtgctcgatttagtgtcgtcgcaagagagaggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacataccccagcaaagtccccaagttaatcatttaatgagggcactaagcggcctcaggagtttcngatcgcttctctgctccaaggctggcgacgggcctcctgacaatatctgggctccaggctgagacgaggctcattacactgcttgctcatatggtagttntagctacgttgggttgttacgggnggcgggaccaaggtgaccgtctaacggtcaggcccaaggcctcggccccctcgggtcctaccgtccgtacgttccctaccccg

SEQ ID NO: 109031 - DNA, 533 bp, Homo sapiens
  misc_feature: GYAE6OF02GJDNX.12.71.G05.1.454.CMB.1.raw
  modified_base (216)..(216): a, c, t, g, unknown or other
  misc_feature (216)..(216): n is a, c, g, or t
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (431)..(431): a, c, t, g, unknown or other
  misc_feature (431)..(431): n is a, c, g, or t
  modified_base (528)..(528): a, c, t, g, unknown or other
  misc_feature (528)..(528): n is a, c, g, or t
tcagatacgacgtacacgaccggtgctcgatttagtgtcgtcgcaagagagagggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttccngcaccggaaccaatagtgacgttggtcgttataactttgtctcctggtacaaacngcaccaggacaaacgccccccaatcctgatttangagtcactattcggtcctcgaggtaatttcaatcgtcttctcttggttaccaagtctggcaaacgacggcctcccgtgacccatctcgtggggtaccaggctgaggacgaggtctgattactacgngactagttcattactacaagcacttccacttctcgtggtgttcggcgtcggacagctgaccgtctaaggtcacgccaagctcgcccctgtcactctntcccc

SEQ ID NO: 109032 - DNA, 772 bp, Homo sapiens
  misc_feature: GYAE6OF02FXAA0.12.71.G05.1.454.CMB.1.raw
  modified_base (281)..(281): a, c, t, g, unknown or other
  misc_feature (281)..(281): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccgganaaacgtccccaagttaatctaattttagtaggacggggcctaacgtaaacggccggccctcgagggtagtttctagtactcgtcttctctggcctaccgaaggtctcgggaccggacccgggtccttcccgtaggaacctaaattacgttcgtacggggccttccgaagggtcgtagggacggaaccggaggtaccgtacacgtttaaccctacggtgtacccgttggacccttacgtaactttaggtacggggtaacgggttttaataccggtacgttaccgggttttagggggttcggtttaccggggccggggtaacccggggtaaacctaaaggggttacccgtaaccccgggtttacgtaaacggttacccgtaaccgggtacccccgtaaacgggtccccgttaccccgggtacccccccgttcgggttacccctacccggtttcccgttaccccggtttaccccccctaccccgtttacccccg

SEQ ID NO: 109033 - DNA, 715 bp, Homo sapiens
  misc_feature: GYAE6OF02JPO69.12.71.G05.1.454.CMB.1.raw
  modified_base (317)..(317): a, c, t, g, unknown or other
  misc_feature (317)..(317): n is a, c, g, or t
  modified_base (373)..(373): a, c, t, g, unknown or other
  misc_feature (373)..(373): n is a, c, g, or t
  modified_base (488)..(488): a, c, t, g, unknown or other
  misc_feature (488)..(488): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatccaccgtctcctgccacgtgggacctagtaatgtattttaggaaattttgaccttagtctcctggtaccaactactaccccggctaaacgtccccaaagttaatcaattttanggaggctaacgtaagccggaccctagacggtagtttactggacttcggtctttccncttacggcctcgaagggtccgtagggcccggaccccgggtccttacccttggaacctaaacgttcgttcccgcggggtcttacccggacggtcccgtagggaacggtaaccgggnggtaccttactaagtttacctaacgtcgtcgtcgtccttctaagttacgtagggtaggtttacaacggtccttaacggtttggggttcggttccgggacgggtacccgggaaacgtaaacggtcggtaccgttaccgtaaggtccggtaacgcccggtaaggtcccgttcccgtacccggttaccgtacctaccgttcccgttccgggttaccccctcccttcccgg

SEQ ID NO: 109034 - DNA, 646 bp, Homo sapiens
  misc_feature: GYAE6OF02IEDY1.12.71.G05.1.454.CMB.1.raw
  modified_base (348)..(348): a, c, t, g, unknown or other
  misc_feature (348)..(348): n is a, c, g, or t
  modified_base (417)..(417): a, c, t, g, unknown or other
  misc_feature (417)..(417): n is a, c, g, or t
  modified_base (444)..(444): a, c, t, g, unknown or other
  misc_feature (444)..(444): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtggacagtaatgtattttggaattttgactagtctcctgtaccaacaactacccgcaaacgtccccaaagttaactctaatttactagagggacaacgttaagccggtccctacacggtacgtttcngacttcgtctttctcgtggcctaccgaaggcgtggccgacccgggtcctcccgtagaactaatatccgnggtcctcgagtcgtagacggacgacgntacctattactacgtgcgttgcgtacagttagtacggtaggtttagtacggtacttacgttggggttcggttccgggacggtaccggggtaaaccaacgggtacgtacccgtaccgtaacgtccgaacggtaccgacggaccttcccggtcccccgtacggtcctaccgttcccgttaccggttccccctacccgttacccg

SEQ ID NO: 109035 - DNA, 778 bp, Homo sapiens
  misc_feature: GYAE6OF02F6QP7.12.71.G05.1.454.CMB.1.raw
  modified_base (210)..(210): a, c, t, g, unknown or other
  misc_feature (210)..(210): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
tcagatacgacgtacacgaccggtgctcgatttagtgtcgtcgcaagagagaggggggggtcgacaagaggcagcgctctcgggacgcctccaccatggcctgggctctgctgctcctcactctcctcactcaggacacaggtcctggcccagtctgccctgactcagcctgcctccgtgtctgggtctcctggacagtcgatcaccgtntcctgcactcgggaccagtaatgtattttggaaattttgacctagtctctgtaccaanacgtacccganaacgtccccaaagttaatctattactagacgggtcacgtaacgccggtaccctacgaaggtacgtttctacgagtccgtcttccttcgtaggtccttaccgaacggtccgttacggggaccgtaccccggggtcccttaccccggtacgtaaccgtaaaacttaacgtccgggttaccgggtcccgttaccccggaaggtcgtaacgggtaacggaacccgggtaggttcctaccttaaagttaccctaaccgtgtaccgttcgccgtttaccaagtttaggtaacgggtaaggtttaactaccggacgtttaaccggtttggggggttttaaccgttccggggccggggttaacccgggaaaaccgtaaaagggtttccgggaaaaccccgtttccgtaaaacggttccggaaccggaacccgtaacggcccgttacccggtcccccgttacggtcctaacccgttcttacccgggttttccccccacccctttcccg

SEQ ID NO: 109036 - DNA, 558 bp, Homo sapiens
  misc_feature: GYAE6OF02GM4YY.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgaccttagtctcctggtaccaacaataccccggcaaagtcccccaagttaatcatttatgagggcactaagcggccctcaggagtttctgatcgcttctctggctccaaggctggcgaccgggcctccgtgacaatatctgggctccaggctggaggacgaggctcattactactgctgctcatatggaggttatgctacgtttgggttgttcgggcggcgggacgaaagtcgacccgtctaacggtcacggacccaaggccgtaccgcccccgtcggtccaccgttccgtcgttccccgtcccttcccg

SEQ ID NO: 109037 - DNA, 571 bp, Homo sapiens
  misc_feature: GYAE6OF02FTLZG.12.71.G05.1.454.CMB.1.raw
tcagatacgacgtacacgaccggtgctcgatttagtgtcgtcgcaagagagaggggagtgaggagcagcgctctcgggacgcctccaccatggcctgggctgtgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaaactcatgatttatgaggcactaagcggccctcaggggtttcttatcgcttctctggctccgagtctggcaacacggcctccctgacaatctctgggctccaggctggaggacgaggctcattactactgctgcttcatagtggtaggttatagctacgtttaggggttgttcgggcgggacggaaccgaaagttcgacccgttcctaacggtccgtacgacccgaacggtcctaccgcccccgttcggtccctaccgttcctccggttccccgtccccttccccg

SEQ ID NO: 109038 - DNA, 979 bp, Homo sapiens
  misc_feature: GYAE6OF02GUWKF.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctccgtggacagtcgatcaccgtctcctgcacgtcgggaccagtatgtattttggaaattttgacctagtctccgtggtaaccaacaactaccccggacaaacgtccccaaagttaatactaagtttagtacgggggtctaacgtaaggccggtacccctacgtaagggttacgttttcctagggtaacttccggtactttccgtttccgtcgggtcccttaccgtaaacgggtccgttacgggaccccggaacccgggggtccccttaccccgtacggtaaaccctaaaacgtttaacgtttccggttacgggggtccctttaaccccggtaacgggtacccggtttaaggggaacccgggggtaaaccgggtacggggttaacccttaacccgttaaaacgtttttaaacccgttaacccggtttacggtaccggtttaccggtacccgttttaaccgtaaagggtttaacggtttaaggggggttaaaccggtttttaaacgttaaccgggttacccggtttaacgggttttttacggggggttccgggttttaaccgggggggtccccggggttaaaccggggttaaacccgggaaaacgggtttacccgggttaaaccccgggtttacccggtttaaaacggtcccggtaaacccggtcccccgggtaaacgggttacccccggtaccccgggttacccccccggtacgggtttacccctaccgggttttcccccgtttaacccgggtttcccccccgtttacccccgttcccgtttaaccccgg

SEQ ID NO: 109039 - DNA, 692 bp, Homo sapiens
  misc_feature: GYAE6OF02F6UVB.12.71.G05.1.454.CMB.1.raw
  modified_base (300)..(300): a, c, t, g, unknown or other
  misc_feature (300)..(300): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccatcctcctgcacgtgggaccagcagtgattggtggacttataaccttgtctctgtaccaacacaccagacaacgccccaatcatagtattanggaggcagtaacgcgcctcgtacgggtttctatcgtcttctctcgctcgtagtcgtcggacaacgaccgccctccgtagactaacttcgtcgtacgggtcctaccggacggtcgtacggaacgggtaccggacggggtacggttaattttacgttaacgtttcgttacggtaccttacgtaagtttaacgtcgggtaaccgggttaaggtacgtacctttaacgtttcgtaactttcggttaccgtttacggttaccgggaccggggttaacggaacccgtaacgggttacccgtaacgggttaccccggttacccgggtacgggttaccgtaaccggtacccggtaaccgggtcccgttaccccgggttacccccgttaccggttaccccg

SEQ ID NO: 109040 - DNA, 661 bp, Homo sapiens
  misc_feature: GYAE6OF02JLGTC.12.71.G05.1.454.CMB.1.raw
  modified_base (257)..(257): a, c, t, g, unknown or other
  misc_feature (257)..(257): n is a, c, g, or t
  modified_base (325)..(325): a, c, t, g, unknown or other
  misc_feature (325)..(325): n is a, c, g, or t
tcagatacgacgtacacgaccggtgctcgattagtgtcgtcgcaagagagaggggggggtcgacaagaggcagcgctctcgggacgccgtccaccatggcctgggctctgctgctctcactctcctcactcaggacacagggtcctgggcccagtctcgccctgactcagcctgcctccgtgtctgggctcctggacagtccgatcaccgtctcctgcgacctgggaccagtaatgtattttggaaattttgacctntctcctgtaccacataccgcaagtcccattatcattatagcggatactaacggtacctggggaccttntacggtacgttactcggtacttcgtcttcgtcctacggtaccgtcctaagggccgtaccgggcccgtacccgggtactacccctaggtaccctacgtcgtcctcggggactccgagggacgtacggacggtacgtacggtacttaccgtattaccgtactcgtctcgtactcgagttacgtagtacggtacttaggtcgttacggttcgggtacgggttaccgggacggtaacggtccggtaaccgttacggtaccgtccgtaacggtaccctgaaccggtcccgtacggtccctaccggtccccgtacgtccctaccgttccctcccgttacccc

SEQ ID NO: 109041 - DNA, 761 bp, Homo sapiens
  misc_feature: GYAE6OF02F3L3T.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaacgtaccccggacaaacgtccccaaagttaactctatttatggagggcaacgtaagccggccctacaggtagtttctgacttcgtctttctcgtggaccttccgaagggtctcgggccggaccccgggtccctcccgtacgtaactaacttacgttcggtacggggtccctccgagggtcccgtagggaacgggaaccgtacggggtccttaccgtaaactttaaccgtacgtacggtccttcggtacccttactaagtttacgtaggggttaaggttttaacgttaacggtaccgtacgggttttagggggttacgggttacccggggccggggtacccgggaaaccggttaaagggttaccggtaaccccggttaccgttaacggtccgaacgggtaccccaaacgggtcccgttaccggtccccccgttacgggttcccgtaacccgttcccgttcccggtttaccccccgtaccccctttaccccg

SEQ ID NO: 109042 - DNA, 644 bp, Homo sapiens
  misc_feature: GYAE6OF02HQRKM.12.71.G05.1.454.CMB.1.raw
  modified_base (318)..(318): a, c, t, g, unknown or other
  misc_feature (318)..(318): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctcgccctgactcagcctgcctccgtgtcgtggtctcgtggacagtcgatccaccgtctcctgcacgtgggactagtaatgtattttggtaaatttcgacttagtctccgtggtaaccaactaactaccccggacaaacgtcccctaagttactctatttangaggcaacgtaagccggtcctcgaggtagtttctgactcgtcttctacgtcggactaccgaagcgtggaccggtaccggtcctccgtacaactactagttcgtacggcctacgaggtctacggacggacgtacgtctacgtattaccacgtcgtactggtcctatacgtaagttcggaagtttagtaccgtagttacgtttggggtcggttcgggaccgggtaccggtaaacgtagggtccgttaaccgtacggtacgtcgacgtacccgtaggtcctcccggcccgttacggacctaccggttcctccgttacccctcgttaccc

SEQ ID NO: 109043 - DNA, 726 bp, Homo sapiens
  misc_feature: GYAE6OF02JNC3C.12.71.G05.1.454.CMB.1.raw
  modified_base (215)..(215): a, c, t, g, unknown or other
  misc_feature (215)..(215): n is a, c, g, or t
  modified_base (327)..(327): a, c, t, g, unknown or other
  misc_feature (327)..(327): n is a, c, g, or t
  modified_base (703)..(703): a, c, t, g, unknown or other
  misc_feature (703)..(703): n is a, c, g, or t
tcagatacgacgtacacgaccggtgctcgatttagtgtcgtcgcaagagagagggggggggtcgacaagaggcagcgctctcgggacgcctccaccatggcctgggctctgctgctcctcactctcctcactcaggacacagggtcctgggcccagtctgccctgactcagcctgcctccgtgtctgggtctccgtggacagtcgatccaccgtntccctagctactgggacctaggtaatgtattttggaaattttgaccttagtcctcgtggtaccaactaactaccccggacaaccgtacccctaagttaactctaacttttanggaggactaccgtaaggccggccctacgtaggtacgtttcctagacgttccgtcttaccgttcgtcggtacttacccgaaggtccgttcggggacccggtacccggggtcccttacccgtagaaccgtaacgttactaccggtcgggtccttacccggtaagggccttacgggagggtaccgtaggtaccttacgtaatttacccggtaacgtcgttaccgtacggtcctttaacgtaacgttagttcgggttaagggtttactaccggtacgttaaccgggttttggggtacccgggttcgggccgggaaccggtacgtaaagtccgtaccgtacgtaactcgaccggtacacgccgtaccgcccgttacgtacnccgttctccggtcccacgttccg

SEQ ID NO: 109044 - DNA, 665 bp, Homo sapiens
  misc_feature: GYAE6OF02HBHNW.12.71.G05.1.454.CMB.1.raw
  modified_base (315)..(315): a, c, t, g, unknown or other
  misc_feature (315)..(315): n is a, c, g, or t
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
tcagatacgacgtacacgaccggtgctcgatttagtgtcgtcgcaagagagagggggggggtcacaagaggcagcgctctcgggacgcctccaccatggcctgggctctgcctgctcctcactctcctcactcaggacacagggtcctgggcccagtctgccctgactcagcctgcctccgtgtcctgggtctcctggacagtcgatcaccgtctcctgcactgggaccagtaatgtattttggaaattttgacctagtctcctgtaccaacaactaccccgaacaaacgtccccaaagttaactctaagtttanggaggcacgtaacgcggccctcgaggtactttcngtactcgtcttcncgtggctccgaaggctggccggtaccgggtcctcccgtagacaatactcgtgggcctcgaggtctggaacgggacgaggtcctactacgttacctacgtcgcgtacgtactactattagtaggtaggtttactaagtccgttaggttttggggtcggtttaccgggaccgggtacgggtaaacccgtaaaggttccgtaacccggttacgtaaacggttccgaaaccggacccgaacggtcccgtacccggtccccgttcggtaccctcgtcccgtttcccgttacccccctaccgttccccg

SEQ ID NO: 109045 - DNA, 563 bp, Homo sapiens
  misc_feature: GYAE6OF02HJ1EF.12.71.G05.1.454.CMB.1.raw
  modified_base (336)..(336): a, c, t, g, unknown or other
  misc_feature (336)..(336): n is a, c, g, or t
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgaccttagtctcctggtaccaacaactaccccggcaaacgtccccaagttaatcatttatgaggcactaagcgcctcagagtttcngatcgcttctctgctccaaggctcggcgaccggcctcctgaacaatatcgtgggcctcgaggctgaggacgaggctcattaactctgctgctactatagtggagtttagagtacgtacgttgggtgttcggcggacggaacctaaggtcgaccgtacgtagtaccgacgacccgaaggcctccgccccgttacggtcctaccgtcgttccggttccccgcccttccg

SEQ ID NO: 109046 - DNA, 657 bp, Homo sapiens
  misc_feature: GYAE6OF02F38TI.12.71.G05.1.454.CMB.1.raw
  modified_base (65)..(65): a, c, t, g, unknown or other
  misc_feature (65)..(65): n is a, c, g, or t
  modified_base (509)..(509): a, c, t, g, unknown or other
  misc_feature (509)..(509): n is a, c, g, or t
tcagatacgacgtacacgaccggtgctcgatttagtgtcgtcgcaagagagagggggggggtcanaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtgggaccagtaatgtattttaggaaacttttgaaccttagttctcctggtaccaacaactaccccgacaaaacgtccccaagttaactctatttatagagggtcaactaagccggtccctgaggtcgttactgatcgtccttctcgtcggctaccgaaggtcgtcgggcccggtacccgggccttccgtacgtaacaacttactcggtcgggctccgaaggtctcgggaggacgtaggccttatacgttactacgtcgacttgcctacagttagtaggtacgtttagngccgtacgtttgggtcgtcgggtcgaccgggacaaggtccgtaccgtacttaacggcctaacggacccgtaacggtcctacccggtccccccgttaagggtcccttaccggttacccttacccggtttccccctaacccccgtttccc

SEQ ID NO: 109047 - DNA, 883 bp, Homo sapiens
  misc_feature: GYAE6OF02J107P.12.71.G05.1.454.CMB.1.raw
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctcgtgtctggtctctggacagtcgatccaccgtctcctgctacgtgggaccagtaatgtattttgggaaattttgaccttagtctccgttaggtaccaacaacgttacccccggactaaacggtacccctaaagttaactcctaatttaacgtggaacggtccaacgtaacgccgggtcccttaccgaaggttacgtttcctaggtacttcggtccttctcgttgggacccttccgaaacgggtcctcgggtaccggaaccccgggtcccttacccgttaggaaacccgtaaattaccgttaccggttcggggtaccccttaccggtaacgggtccgttaacggggtaacgggaaccgggtagggttaccctccgttaaacgtttaaccgttaaccgttggtaccgttcgtaccgttaaccgtaagttaacgggttagggttaacggttaacgttaaccggttacgttaacccgggtttttcgggggttaccggttttacccgggggtaacccggggttacccgggggtaaaaccccgttaaacggggttacccggtaaccccgggtttaccgtaaaccggttacccggaaacccggttaccccgtaaacgggtccccgttaacccggtacccccccggttacggggttacccaaccccgggttttcccgaaccccggttttacccccccgaacccggttttcccccg

SEQ ID NO: 109048 - DNA, 775 bp, Homo sapiens
  misc_feature: GYAE6OF02GWEQU.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatccaccgtctcctgcacgtgggaccagtaatgtattttggaaatttgacctagtctctggtaccaacaactaccccggacaaacgtccccaagttaactcctaatttagtggagggactaacgtaacggcccggtccctacgagggtacgttttacgtgtactccggtccttctcgtcgcctaccgaaggcgtcggaccgacccgggtccctccgtagaactaattacgtcggtcgggaccctaccgaggtctacgggaacggacggacggtctaccgtaattaccgtacgtcgtacgttcgtaccttacgtaagttaggttacgggttaacggtttactaccgggtaccgtttacggggttttcgggggtttaccgggttcccgggggaccgggggtaacccgggttaaaaccggttaacgggttaccgtaacccgggttacgttaaccggtacccggtaacccggtaccccgtaacggggtccccgttccccgggtacccccggtttaccggtacccgttacccgttaccccggtttccccggtttaccccccgtcccgtttacccccg

SEQ ID NO: 109049 - DNA, 733 bp, Homo sapiens
  misc_feature: GYAE6OF02HP1F8.12.71.G05.1.454.CMB.1.raw
tcagatacgacgtacacgaccggtgctcgatttagtgtcgtcgcaagagagagggggggggtcacaagaggcagcgctctcggaacgcctccaccatggcctgggctctgctgctcctcactctcctcactcaggacacagggtcctgggcccagtctgccctgactcagcctgcctccgtgtctggtctccgtggacagtcgatcaccgtctctgccacgtgggaccagtaatgtattttgaattttgactagtctcctgaccaacactaccccggataaacgtccctaagttaatctaattatgaggacacgtaagccggcctagaggtagtttcgagtatccgactttctcgtggtctacgaacgcgttggaccggaccgggccctacccgtgtaaccaattacgtcgagggtccttacgacggtctacggacgggacgaggtcgttactacttacctacgtgtacctcgtaccctctaactaacgttagggtaacgggtttactaacggtaccgttaacgggtttcgggggttacggtttacggggacccggggtacggggtaaaccgttaaacgggttacgggttaaaccccgtacgttaaaccggtttacggaacccggtaacccggtaaaaccgggtcccgtttaaccccggccccccgtttacgggtaaccccgtaccgtttaccccgtttacccggttacccccgttaaccccctttcccccgg

SEQ ID NO: 109050 - DNA, 603 bp, Homo sapiens
  misc_feature: GYAE6OF02JR2NG.12.71.G05.1.454.CMB.1.raw
  modified_base (477)..(477): a, c, t, g, unknown or other
  misc_feature (477)..(477): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtgggaccagtaatgtattttggaaattttgacctagtctcctggtaccaacaactacccgacaaacgtccccaagttaatctatttatgaggcactaagccggtacctcaggtagtttctgtatcgtcttctctcggctaccaaggtctcggcgaccgggccctccgtgaactaatactcgtcgggctccgaggcgtggaacggacgagtctactacttactacgtcgtctacgtctacattagtaggtacgttanagtctacgttgggtcgttcggcggtcggaactaaagtcgtacccgtacgtaagtcgaccggaccgaaggtcccgtaccgtcccccgtacggtccaccgttccgtccggttcccccgcccgttcccg

SEQ ID NO: 109051 - DNA, 762 bp, Homo sapiens
  misc_feature: GYAE6OF02JC0SO.12.71.G05.1.454.CMB.1.raw
  modified_base (182)..(182): a, c, t, g, unknown or other
  misc_feature (182)..(182): n is a, c, g, or t
  modified_base (430)..(430): a, c, t, g, unknown or other
  misc_feature (430)..(430): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtntcgtgggtcctcctggacagtcgatccaccgtctcctgccacgtgggaacctagtaatgtaattttggaaattttcgacctagtctccgtggtaccaacaacgtaccccgactaaacgtcccccgtaagttaactctaatttaagtggacgggctaacgtaacggccggaccctacgaggtatttctcgattccgtcttcctcgtcggtctaccgaagtcgtcgggccgacccgggtcctacccgtanaaccgtaaattcgtaccggttcgggtacccttaccgggacggtacgtagggacggggtacggacggtcctaactaacgtttaaccgtagtcgggtacctacgttccctaaacgttattaagggtcgggttaacggttaagtacggtaaccttacgggtttggggttaacgggtttcccggggacggtacccggggtaaaccgtaaacggtcggtaacccgttacgttaaccgggtctaaccgggtacccgtaaccgggtcccgtacccggtcccccggttacggttacccgtacccgttcccgttaccccgttaccccctcccgttaccccg

SEQ ID NO: 109052 - DNA, 533 bp, Homo sapiens
  misc_feature: GYAE6OF02GM5LS.12.71.G05.1.454.CMB.1.raw
  modified_base (456)..(456): a, c, t, g, unknown or other
  misc_feature (456)..(456): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctctggtaccaacaataccccggcaaagtccccaagttaatcatttatgaggcactaagcggccctcaggatttctgatcgctttctctgctcaaggctggcgaccgggcctcctgacatatctgggctccaggctgaggacgaggctcattactactgactgctacatatggtaggttatagctacgttggtgttcggnggccggacgaaagtgaccgtctaagtcacgcccaacggctcgcccccgtcggtcctacctctcgttcccaccctccc

SEQ ID NO: 109053 - DNA, 719 bp, Homo sapiens
  misc_feature: GYAE6OF02GD40P.12.71.G05.1.454.CMB.1.raw
  modified_base (199)..(199): a, c, t, g, unknown or other
  misc_feature (199)..(199): n is a, c, g, or t
  modified_base (216)..(216): a, c, t, g, unknown or other
  misc_feature (216)..(216): n is a, c, g, or t
  modified_base (295)..(295): a, c, t, g, unknown or other
  misc_feature (295)..(295): n is a, c, g, or t
  modified_base (331)..(331): a, c, t, g, unknown or other
  misc_feature (331)..(331): n is a, c, g, or t
  modified_base (460)..(460): a, c, t, g, unknown or other
  misc_feature (460)..(460): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacgagggtcctgggcccagtctgccctgactcagcctgcctcgtgtctggtctccgtggacngtcgatcaccgtctccngcactggacagtatgtatttaggaatttcgactgtctctgtacaacacgtacccgcaaacgcccgaattaatctattangaggcactaagcgaccctgagtagttctgatccgtntctgtcgctcgaaggtcgtccggaccgaccgggtcctaccgtagaacctaattacgtcggtacgggtcctacggacggtcgtagggacggtacggacggtactactaacgttacctaagtcgtaccgtntccttacaatttacgggtaggttaacgggttaacttacggtaaccgtttagggttttacggggttcgggttacgggtaccggggtttaacgggaaacccttaacgggacccgttacggttaccccggttaaacgttaacgggtccccggttaaaccggaaccccgggttaaccgtaacccggttccccggttacccccgttaccgggtacccttacccgggttacccttcccccggtttaaccccccggttaacccccc

SEQ ID NO: 109054 - DNA, 776 bp, Homo sapiens
  misc_feature: GYAE6OF02JGNVI.12.71.G05.1.454.CMB.1.raw
  modified_base (339)..(339): a, c, t, g, unknown or other
  misc_feature (339)..(339): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtggaccagtaatgtattttggaaattttgactagtctcctggtacaacaactaccccggacaaacgtccccaaagttaatctaatttacgtagagggcaactaaacggccggccctanaggtatttctgatcgtcttctcgtcggctccgaaggtcgtaggaccggacccgggtcctcccggtgaaacctaacttacgtacgtccgggtaccttaccggacgggtaccttgggtaaacgggaccgggtacggtccgttactaactttaacctaaccggttcgcgttcggtaccttacgttaaacgttacggttacggggtaaaggtttaagttacgtaccgttaaccgggttttgggggttaccggttaccgggggtcccggggtaacgggtaaaccccggtaaaagggttcgttaaaccccggggttaccgtaacggttacccggaaccgggtaaccccgtaagggtcccccgttaacggtcccccccggttacggtttaacccgtacccgtacccggttttcccgggttacccccctccccggtttaaccccg

SEQ ID NO: 109055 - DNA, 791 bp, Homo sapiens
  misc_feature: GYAE6OF02JLPQC.12.71.G05.1.454.CMB.1.raw
  modified_base (335)..(335): a, c, t, g, unknown or other
  misc_feature (335)..(335): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgacctcagcctgcctccgtgtctgggtctccgtggacagtcgatccaccgtctcctgcacgtgggaccaagtatgtattttggaaattttcgaccgttagttcctcctggtaaccaaactaacgtacccccggactaaaaccgtcccccgtaaagtttaactctatttacgnggtacggactaacgtaacggccgggcccttacgtaacggttacgttttccgtagtacgttccgtaccttttcgtccttcggtaccgttacccgaaaggtccgtcgggtacccgggaccccgggttccttccccggttacgaacctaaactttacggttcccgttaccgggggtcccttaccgtacggggtcccttacggggaacgggtaacccgggtagggtccccttacgttaacgtttaacccttaccgtcgttccgtacgtcttaacgttaattacgggtcgggttaagttcgtacgtccgttacgggtttggggttcgtccggggaccggtacgggtaaacctagggtccgtaaccttccggtaaggtccgacggtaacccgacgggtcccctaccgggtcccccttcggtacgtccccgttccgtaccccggttcccccacccgtttaccg

SEQ ID NO: 109056 - DNA, 608 bp, Homo sapiens
  misc_feature: GYAE6OF02G5NCN.12.71.G05.1.454.CMB.1.raw
  modified_base (199)..(199): a, c, t, g, unknown or other
  misc_feature (199)..(199): n is a, c, g, or t
  modified_base (310)..(310): a, c, t, g, unknown or other
  misc_feature (310)..(310): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (380)..(380): a, c, t, g, unknown or other
  misc_feature (380)..(380): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacngtcgatcaccgtctcctgcacgtgggaccagtaatgtattttggaaattttgacctagtctcctggtaccaacaactaccccggcaaacgtccccaagttaactcatttangaggcactaagcggccctnaggtnttctgatcgcttctctggctccaggctcggcgaccgggccttccgngacaatcgtcgtgggcctccgaggtctggaacggacgacggctcacttactacgtgcttggcctacgatagtgggtaagtttacgagtaccttacggttggggttggttccgggcgggaccggtaaccgaaaggtcgaaccgttacgtaacgtcgacggttacccgaaggtcctaccggtcccccgtagggtcctaccgtttccgtaccgttcccccgacccttcccg

SEQ ID NO: 109057 - DNA, 817 bp, Homo sapiens
  misc_feature: GYAE6OF02GR4BO.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctccgtggacagtcgatcaccgtctcctgcactgggaccagtaatgtattttggaaattttgacctagtctctggtaccaacaactaccccggacaaacgtcccccaagttaactctaatttagagagggtacaactaacggccggccctgaagggtgtttctgactccggtcttctcgtcggtccttaccgaagggtcgtacgggcccgggacccggggtcccttacccgtacgaacctaaagttacgttaccggtcggggtaccctaccggtacgggtaccgtttagggaaaccggggtaaccggtacgggtaccttaaccgtaaacgtttaaccctaaccggttcgtaccgttacgtacccttactaagtttaacggtagggtaaggtttacgtaacggtaccgttaacggttttgggggttaccgggttaccgggggtaccggggtaaccggggaaacccgttaaacggggttccgaaccccggtttaaccggttaaaccggttacccggaacccgggtaaccccggtaacgggtaccccgttccccgggtaccccccgttacggggtacccttacccggtttacccgtttccccgggtttaccccctcccccgtttaccccgg

SEQ ID NO: 109058 - DNA, 604 bp, Homo sapiens
  misc_feature: GYAE6OF02H3RDU.12.71.G05.1.454.CMB.1.raw
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctctgcacgtgggacagtaatgtattttggaaattttgactagtctcctggtaccaacaataccccggacaaacgtccccaaagttaatctaatttatgaggacaacgtaacgcggtccctacgaggtacgtttcagatcgtcttctctggcctccgaaggtcgtggccgaccggcctccgtgaactaatctcgtggcctcaggctggaggcgagtctcattaccagtcgctcgtctacagttagtggtaagttatagtacgttacggttgggttcggtccgggacgggtaccgggaaactaacgggtcgaacccgtacgtaacgttcgacggtacccgaaggccgtcccgtccccgtcggtacctccgttaccgttcccgttacccctccttaccccg

SEQ ID NO: 109059 - DNA, 652 bp, Homo sapiens
  misc_feature: GYAE6OF02JLRGY.12.71.G05.1.454.CMB.1.raw
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
  modified_base (320)..(320): a, c, t, g, unknown or other
  misc_feature (320)..(320): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
  modified_base (398)..(398): a, c, t, g, unknown or other
  misc_feature (398)..(398): n is a, c, g, or t
tcagatacgacgtacacgaccggtgctcgatttagtgtcgtcgcaagagagagggggggggtcgacgaagaggcagcgctctcgggacgcctccaccatggcctgggctctgctgctcctcactctcctcactcaggacacagggtcctgggcccagtctgccctgactcagcctgccctccgtgtctgggtctccgtggaccngttcntcacccgtctcctgccncgtgggacctagtaatgttattttaggaaattttgaccttagtccttctgtaccaactaactacccgacaactccccaagttaactctatttangaggtcaactaacgcggcctacgtagtacgttntgtatcgtcttctntcgcgtacaacgtntcggcgccggcctcgtnaccgtattactcgtcggtcttccgacggtcgtggacggacgcgctcgacttactaccgtgtcctgtcctcgtattaagtgggtaagtttacgtacgtactacgtttggggttacgttcgggtaccgggtaccgggtaaccgttaacgggtacggtaccgttaccgtaacgtcccgaacggtccttaacgggtacgtcccggttacccgtccgttccgtaccctacggtttccccgtccccgttaccccttcccg

SEQ ID NO: 109060 - DNA, 736 bp, Homo sapiens
  misc_feature: GYAE6OF02IZF9A.12.71.G05.1.454.CMB.1.raw
  modified_base (293)..(293): a, c, t, g, unknown or other
  misc_feature (293)..(293): n is a, c, g, or t
  modified_base (345)..(345): a, c, t, g, unknown or other
  misc_feature (345)..(345): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgccctccgtgtctgggtcctcctggacagtcgatccgaccgtctcctgcacgtgggaccaggtaatgtattttaggaaattttgaccttagtctcctggtaccaacaacgtaccccgganaaacgtaccccaagttaatcattatgaggacactaagcgcctgagtagttcngatcgtcttctcgtcgcctcgaacggcgtggccggtaccggcctccgtagactaactactcgtcgggctaccgaggtaccgtaggaacggtaccgggacgtccgtacgtaacgtttaacctaccgttacgcgttcgtcgtaaccgttaagttagttaacggggttaaacggtttaagttaccggttacgttaacggttttagggggttcgggtttacggggaccggggtaacccggggtaaaccgtaaagggttcccggaaccggtttacccggtaaggttacccggaacggaccccggtaacgggtcccgttaaccccggtcccccggttacgggtacccttaacccgttccgggtttaccccgttacccccggtccctttaacccccgg

SEQ ID NO: 109061 - DNA, 756 bp, Homo sapiens
  misc_feature: GYAE6OF02HS7NX.12.71.G05.1.454.CMB.1.raw
  modified_base (224)..(224): a, c, t, g, unknown or other
  misc_feature (224)..(224): n is a, c, g, or t
  modified_base (319)..(319): a, c, t, g, unknown or other
  misc_feature (319)..(319): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctcgccctgactcagcctgccctccgtgtcgtgggtcctccgtaggacagtcgatccaccgtctcctncacgtgggaccaggtaatgtattttggaaattttcgacttagtctcgtaggtacaaacactacccggacaaactccccgaaagttatctatttangacggctaacgtaagccggtcctacgagggtacttttcacgtagtccgtcttcgtcgttcggccttacccgaaagggtcgttcggacccgggtacccgggtccctccccgttaggaacctaaattcgtcgtcgggtccctacgagtccgtaggacgggaacgaggtcctacgtaactttaccgtaaccgtgtaccgttacgtcctaccttaagttaaggtagggtttaaacgggttaagtaccgtacgttaaccgggttttgggggttacgggttttacccgggacgggggttaaccggggaaaccttaaaacgggtcccgtaacccggttaccgttaacggtaccgaaccggtcccgaaacggtcccggttcccgcccccgttacggtacccaccggtttaccggttcccgttcccccggtaccccttaccccggg

SEQ ID NO: 109062 - DNA, 680 bp, Homo sapiens
  misc_feature: GYAE6OF02JZSLR.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctccgtggacagtcgatccaccgtctcctgcacgtgggaccagtaatgtattttaggaaatttgaccttagtctcgtgtaccaacaacgtaccccgcaaactccccaaagttaactctattacagaggacaacgtaagccgacctgaggtcgttctagacttcgtcttacgtcgtcggctaccgaaggtccgtcggtcccggacccggtccgtcccgtagaaccgtaagttaccgtcgtcgggtcctaccggacggtaccgtaggaacgggacgaacggtcctacgtaacgtttaccgtactcgacgttcgtacctactagttacgttacgggtagtttaagaccgttcgtaccgggtttgggttcggttacgggacgggtaccggaaacgtaaacggttccgaccgttacggtacgtccgaacggacccgtaagcccggttccgacccgttcgacgttacccgtcggtcccttaccccgccgttaccccg

SEQ ID NO: 109063 - DNA, 664 bp, Homo sapiens
  misc_feature: GYAE6OF02FGEZO.12.71.G05.1.454.CMB.1.raw
  modified_base (258)..(258): a, c, t, g, unknown or other
  misc_feature (258)..(258): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtgggaccagtaatgtattttggaattttgacctgtcnctggtacaacatacccggcaacgtccccaagttaatctattatggaggcacgtaaggccgtaccctcgaggtacgtttctgattccggctttcctcgtcggcctaccgaaggcgtacgggccggacccgggtccctcccgtagaacctaagtacgtccgtgggtccctaccgagggtctaggacgggtacggacggtactcgtaactttacctacgtgcgtcgcttctagtacgttgggtagtttacagtccgttacggttcggggttcgttaccggggcgggtaacccgaacgttacggtacggtaacccgttgtaacgtccgaacgtaccccggaagttcccgtaccgtcccccgttacggtaccgtaaccgttccgttcccgttaccccctccctttaccccg

SEQ ID NO: 109064 - DNA, 836 bp, Homo sapiens
  misc_feature: GYAE6OF02FJXD5.12.71.G05.1.454.CMB.1.raw
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctgccctgactcagcctgcctcgtgtcgtgggtctccgtggacagtcgatcaccgtctcctgcacgtcgggaccagtaatgtattttaggtaaattttgacctagtcctcctggtaaccaaacaacgtacccccggactaaacgtaccccaaaggttaactcctaatttacgtaggacgggtctaaacgtaacggacccggtacccctaggaaggttacgtttctggtactccggtctttcgtaccgtcggtctaccgaaacgggtcttacggggcccgaccgggtccccttacccgtacggaacctaaagtaccgttccggtacgggtacctaccggtaggccggtaagggaacgggtaccgggacgggtacccttacgtaaaccgtttaccgttaccgacgttccgtccggtacttaccgtaacggtttaaggtacggggtttaagtttaaacggttaccgtacgttttaccggggttttaggggtttaccgggttcggggtaacccgggggaaaccggttaaccggaaacggggttcccgtaacccggttaacggttaacggtccggtaaacgggtacccccggaaacgggtccccttacccggtaccccccgtttcgggtaccccgtaccgtttaacccggtcccggttaccccccctccgttttaaccccccgg

SEQ ID NO: 109065 - DNA, 785 bp, Homo sapiens
  misc_feature: GYAE6OF02F65FG.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtcctgccctgactcagcctgcctccgtgtctgggtctccgtggacagtcgatccaccgtctcctgcacgtgggaccagtaatgtattttggaaatttgaccttagtctcctggtaaccaacgtaactaccccgggataaacggtaccccctaaagttaactcgtaattttagtcggaaggtcctaacgtaaggtccggaccctacgagggtagtttccgtagtaacgttcgtccgtttactaccgtggtaccttaccgaaagggtccttacggggacccggtacccgggtcccttcccgtagaacctaaatcgtttaccggtagggtccctaccggacgggaccgtagggtaacgggaaccgggacggtaccttacggtaactttaaccgtacgttacggtacccgtgtaccttaccgtaacttaggttcggggttaagttaacgtacgaccggttacgggtttggggttccggttacgggtccggggtaaccggaaaccgtaaaggttccgaaacccgtttccgaagggttcccaacgggtacccgtaacggtcccgttacccgggtaccccgttacgggtttacccaaccggttccttacccggtttaccccctaccccgttacccgg

SEQ ID NO: 109066 - DNA, 758 bp, Homo sapiens
  misc_feature: GYAE6OF02JX9HK.12.71.G05.1.454.CMB.1.raw
  modified_base (290)..(290): a, c, t, g, unknown or other
  misc_feature (290)..(290): n is a, c, g, or t
  modified_base (307)..(307): a, c, t, g, unknown or other
  misc_feature (307)..(307): n is a, c, g, or t
  modified_base (320)..(320): a, c, t, g, unknown or other
  misc_feature (320)..(320): n is a, c, g, or t
tcagatacgacgtacacgaccggtgctcgatttagtgtcgtcgcaagagagagggggggggtcgacaagaggcagcgctctcgggacgcctccaccatggcctgggctctgctgctcctcactctcctcactcagggcacagggtcctgggcccaatctgccctgactcagccttgcctccgtgtcctgggtctacctggacacgtcgatcacctatttcctgccaccggaaccaatagtcgtacgtttggtcgtttattaactttgtcctccttacggtaacaaacganacctaccaggacaaacncccccgaactccngtacttatgacggtcctactacgttcgttccacgtaaggtaatttacgtaactcgtcttacgtctttaacggtcctaaacgttcgtcggtacaacgaccgtcccttaccgacgaacctagtccttacggcgggtacctaggaccgtggaacggaccgggtaggtctacggtactttaacgttacttcggaacttagttaactaagtaaactactaaaacgtcctaaaccctttacctaacctttccgtacgggttttacggttaccggttccgggggtaccgggttacggggttaaaccccgaggttacccgttaccgggtacccgttaaccggtttaccgaacccggtaacgttacccggaaaccggtttcgtaccccggtcccccgttacggtacccgttaacgtcccgtttacccggtacccctttaacccccgg

SEQ ID NO: 109067 - DNA, 702 bp, Homo sapiens
  misc_feature: GYAE6OF02FYCV2.12.71.G05.1.454.CMB.1.raw
  modified_base (298)..(298): a, c, t, g, unknown or other
  misc_feature (298)..(298): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctcgtgtctgggtctcctggactagtcgatccaccgtctcctgcacgtggaccagtatgtatttaggaatttgactgtctctggtacaacatacccgacaaacgtcccaagttactctattanagacggcacgtaacgcggtccctcgtacggtacgtttctagtactcgtctttccgtacgttggccctacgaggtccgttacggccggtaacccgggtcccttaccgtagtaaccgtaacttacgtcggtcgggtacctccgtaagggtcctagggacggaaccgggtacgtcgttactaaacgttacctacgtccgtcttacggacttcgtaagttcggtaggtaacggttgtaacggtctacggtttggggtacggttccggggacgggtaacccggttaacgtaacggtccggtaacccgtacgttaaccggtactaaccggtacccggaaggtcccctacccggttccccgtaggttaccctaccggttaccgttccccgttacccgtacccgttaccccg

SEQ ID NO: 109068 - DNA, 751 bp, Homo sapiens
  misc_feature: GYAE6OF02IF6JF.12.71.G05.1.454.CMB.1.raw
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
  modified_base (374)..(374): a, c, t, g, unknown or other
  misc_feature (374)..(374): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacgacgggtcctgggcccagtctgccctgactcagcctgcctccgtgtctgggtctccgtggacagtcgactccgaccgttctcctgccacgtcgggaaccaagtaattgtagttttaggtaaattttcgaccttagtcctcctacggtaaccaacaacgaccccganaaaccgtcccaaagttaatctaatttagnggacggacacgtaacgccggtaccctagaggtacgtttcngattcgtcttctcgtggtcctacgaaggtcgtcggaccggacccgggtcctaccgtagaactaatcgtccggtagggccttacgacgggtacgtcgggaaacgggtaccggtaacggtccttacgttaaccttaacgtacgttacgtcgtacggtctacgtattacggtaggtaacggttataaccggtcgttaaccggtttgggggttcgtttaccgggggaccgggtaacgggtaaaccgaacgggttaaccggtacccgttacccggttaagtaccgacgggttaacccccgaagggtccccgttaccccggtccccggttacccggacccttacgttacccgttcccgttacccccctacccgttaccccccg

SEQ ID NO: 109069 - DNA, 718 bp, Homo sapiens
  misc_feature: GYAE6OF02FZDFM.12.71.G05.1.454.CMB.1.raw
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtgggaccagtatgtattttggaattttcgacctagtctctcggtacaactaactaccccgacaaacgtacccctaagttaactctatttagtaggacgggtacaacgtaacggccggtccctacgtaaggtactttcgtaggtacttcgtctttactcgtcggtccttaccgaaggtccgtcggaccggtacccggggtcccttcccgtacgaactaaacgtcgttaccggttcgggtacctaccgtacgggacgttacgggaacgggacggtacgggtcttaccgtaacgttacctaccggttcgtacgttcggtccttacgtaacgtaggtaggggtacgttaactagggtacttacggtttagggtcggttaccgggccgggtacggaaccgtaaaggtccgtaccgtacgtaacgtcgaccggtacccgaggtacccgtccggtacccgtcggttacctccgttaccgttcccgttacccctccgttacccg

SEQ ID NO: 109070 - DNA, 685 bp, Homo sapiens
  misc_feature: GYAE6OF02G5E36.12.71.G05.1.454.CMB.1.raw
  modified_base (430)..(430): a, c, t, g, unknown or other
  misc_feature (430)..(430): n is a, c, g, or t
  modified_base (504)..(504): a, c, t, g, unknown or other
  misc_feature (504)..(504): n is a, c, g, or t
  modified_base (524)..(524): a, c, t, g, unknown or other
  misc_feature (524)..(524): n is a, c, g, or t
  modified_base (527)..(527): a, c, t, g, unknown or other
  misc_feature (527)..(527): n is a, c, g, or t
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctcgccctgactcacgcctgcctccgtgtctgggtctccgtggacagtcgatcaccgtctcctgcacgtgggaccagtaatgtattttaggtaaacttttcgaactcgtctcctggtaaccaaactaacgtaccccggataaaccgtacccctaaagttaactactatttagacggaggctaacgtaacggccggtcctacgtaaggtggttttccagtacttcgtcgttctcgtcggccttacgaacgggtctacgggccgacccgggtccncccgtagaacctaaatctcggtcggactcgaggtcgtcggacggacgacggtctctaattactacgtgtcgtanctacagtacgtggtagttanacncgtacggttgggtggttaccggcggggaaccggtaaccgtaacggttccggtaccgttacccgtaagttaccgaaccggtaccggaaacggtcccgtccggacccccgttcggtacctaccgttcccttccccggtttcccccctcggtttaacccgg

SEQ ID NO: 109071 - DNA, 804 bp, Homo sapiens
  misc_feature: GYAE6OF02FI0HZ.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggacccagtaactgtattttggaaattttgaccttagtctcctggtaccaacactaccccggacaaacgtcccccaaagttaactctactttactaggtacgggtacaacgttaaggccggaccccttacgacgggtacgtttttaccgtacgtaacgtccgtacctttctccggttcgggacctttaccccgaaaggggtcccgttcggggtacccgggacccccggggtacccttccccgtacggaacctaaacttacgttccgtcggggtcctacccgaagggtctacggacggggaacgacgggtcctacctaacgttaccttaaccgtcgtaccgttcgaccgttcgtaacgttaagtcgggttaacgtttaagttacgtacgtaaccggttttagggggttcgtttaccgggggaccgggtaccgggtaaacccgtaaggttaacccggtacccggttacccgtaaacggttcccgaacggaccccgaaacgggtcccttacccggtaccccccggtacgggttaccctaacccgttccgtttacccggttacccccctacccgtttaacccccgg

SEQ ID NO: 109072 - DNA, 670 bp, Homo sapiens
  misc_feature: GYAE6OF02GR6EY.12.71.G05.1.454.CMB.1.raw
  modified_base (285)..(285): a, c, t, g, unknown or other
  misc_feature (285)..(285): n is a, c, g, or t
  modified_base (312)..(312): a, c, t, g, unknown or other
  misc_feature (312)..(312): n is a, c, g, or t
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtggaccagtaatgtattttggaaattttgaccttagtctcctgtaccaacaactaccccgganaaacgtccccaaagttaatctatttangaggcacgtaagccggcctcgaggtatttcttatcgtcttcgtacgtcggcctccgagttccgtcggaccaaaccgccggtccctacccgtacgaacctactcgtcgtcgggcctaccgagtcgtaggacggacggtacgggacgtatttaacgttacgtgttacgtcttacgtagttagtcgggtacgggtagtacgacttacgtttgtacttcgttaccttaggttcgggacgggtaacgggtaaccgaacgtccgtacggtacccggtcggtcgggtacctaccgggacccggtaacggtcccgtacccggtccccggttacggtacccgtaccgttccgttcccggttcccccg

SEQ ID NO: 109073 - DNA, 849 bp, Homo sapiens
  misc_feature: GYAE6OF02ICTLH.12.71.G05.1.454.CMB.1.raw
tcagatacgacgtacacgaccggtgctcgatttagtgtcgtcgcaagagagaggggggggggggtcacaagaggcagcgctctcgggacgcctccaccatggcctgggctctgctgctcctcactctcctcactcaggacacagggtcctcgggcccagtctgccctgactcagcctgcctccgtgtcgtgggtctcctggactagtacgatcaccgtctcctgccacgtgggaccagtaatgtattttaggtaattttcgacttacgtctcctggtaaccaactaactacccgacaaacgtacccctaaagttactactaatttagtaggtacgggacctaacggtaacgtccggacccttcgtaaggggtacttttacgtacgttactccggtaccttttccgttccgttacgggtaccttacccggtaacgggtccggtccggggtacccggtaccccggggtccctaccccggttacgtaaacctaaacgttaccggttccggtagggtcccgtaccggtacgggttccgtacgggaacgggtaaccgggacgggtaccttacgtaacgttaaaccttacgtacgtcgttaccggtaccttagtaacgttaggtagggtaacggtttacgtaacggtcgttacgggtttcggggggttcggtttaccggggaccggggtaacccggggtaaacgtaaacgggttaccgtaacccggttaccgtaacggtcccggtaaccgaccccggtaaacgggtccccggttacccgtaccccccggttaccggttacccggttacccgtttacccgtttaccccggtttaccccctacccctttacccccgg

SEQ ID NO: 109074 - DNA, 837 bp, Homo sapiens
  misc_feature: GYAE6OF02I438Y.12.71.G05.1.454.CMB.1.raw
  modified_base (493)..(493): a, c, t, g, unknown or other
  misc_feature (493)..(493): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacgacgggtcctgggcccagtctcgccctgctcagcctcgcctcgtgtcgtgggtcctcctggacagtcgatccgaccgtctcctagcaacgtcgggaacctaagtaattgtagttttaggtaaattttcgaaccttagtcctccgtaggtaacccaacctaacgtaccccggactaaaccggtacccctaaagttatactaatttagtagtacgggactaacgtaacgcccggtaccctaggtaacggttattacctaggtactcgtcttcgttcgtacgtcctaccgtaacggtgtaccggaccggtaccccggtaccctacgtacgaactaacttacgtcggtaccgggtacnccggacggtacgtacgaacgggtacgtcgtactacgtaacttacccgtactacgtacttacggtccctaggttaaaccgttgggtttaacggtaagtttaacggtacctacggttaaggggttttaggggttcccgggtttcgggggaacccgggttaaacgggtaaacccggttaaaccgggtccgggttaaacccggttacccttaaagggttacccgggaacccggttaaaccccggtacgggtccccgtttaccccggacccccccggttttaacgtcccggtttaaccccgttaccccggtttaaccccgtttacccccccgtaccccggtttaacccc

SEQ ID NO: 109075 - DNA, 701 bp, Homo sapiens
  misc_feature: GYAE6OF02FL4XJ.12.71.G05.1.454.CMB.1.raw
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctgccctgactcagcctgcctcgtgtctgggtctccgtgacagtcatccaccgtctccgtgccacgtcgggaccagtaatgtattttaggtaaatttcgacttagtctctcgtaaccaacaacgtaccccggactaaccgtcccctaaagttatctatttagtaggacggacacgtaaggtcccgaccgtacgagttacgtttctggtactcggtcctttacgtcgtcggtcctacgacgggtcgtaccgggccggacccggtccctccgtacggtaactaacggtacttcggcggtccgtccggagtcgacggtacggacggtacggtctaccgttacttaacccgtctacgtccggttctcgttacgagttaggttaggttaaggttacgtaacggtcgttaccgggttttgggggtccgggttaccgggccgggttaaaaccggtaccgtagggtacccgtaccgttacgacgtacgacggtaccgacggtccgtccgtccccgtcgtaccgtcctcggttaccgtccccgttaccctccg

SEQ ID NO: 109076 - DNA, 838 bp, Homo sapiens
  misc_feature: GYAE6OF02HSKSM.12.71.G05.1.454.CMB.1.raw
  modified_base (215)..(215): a, c, t, g, unknown or other
  misc_feature (215)..(215): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctcgtgtctggtctccgtggacagtcgatccacgtctctncacgtggacagtatgtatttagtaatttcgacttagtctctcggtaaccaacacgtaccccggactaaacgtacccctaaagttaactactaatttacgtaggaacgggtacctaacgtaacggcccggtaccctacggtaggttacgtttactagaactccggttctttcgtcgtacggtacccgtaccggtaacggtccgttccgggacccggtaacccccgggtcccttacccggttacggaaccttaaacgttacgtaccggtacgggtaccctaccgggacgggtacccgttaggggaacgggtacgggtacggtccgttacgttaaacctttaccgttacgtacggtacgttcccggtacttacgtaaggttacgttagggttaagtttacgttacggtaacgtttacgggtttcggggttcggttaccggggacggtacccggggaaaaccttaacgggttaccccgtaacccggtttacccgtacgggttaacccgaacccggttaacccccggtaacgggttcccccgtacccccggtccccggttacccggtttaccctacccgttttcccccgtttaaccccggtttccccccccgtacccgtttaaccccg

SEQ ID NO: 109077 - DNA, 785 bp, Homo sapiens
  misc_feature: GYAE6OF02IA056.12.71.G05.1.454.CMB.1.raw
  modified_base (322)..(322): a, c, t, g, unknown or other
  misc_feature (322)..(322): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctcgccctgactcagcctcgcctcgtgtcgtggtctccgtggacagtcgatccacgtctctgcacgtgggaccagtaatgtattttaaggtaattttcgaccttagtcctcctaggtaaccaacacgtaaccccggataaaccgtacccaaagttactctaattanggacggtacaacgtaagccggtaccctagtaaggtacgtttcgagtacgtccgtcttacgtcgttacggacctacggaacgggtcgtacgggtcccggaaccccgggttccctacccggtagtaacctaaacgttacgccggttcgggcccttcgaagggtcctagggaacgggacggtaaggtccttactaagttaaccgtacgtcgacggtacgtactactagttaaggtacgggttaacgttaacgtaacggtacggttccggtttaaggggggttcggtacccgggggtacggggtaaaccgggtaaacggtaaaccgggtccggttaaaccccgttacgtaaacggttccgaacccgggtaccgtaaaccgttccccggttaaccccggtccccggtttacgttacccgtacccggtttacccggttccccggttacccccggttcccctttaaccgg

SEQ ID NO: 109078 - DNA, 625 bp, Homo sapiens
  misc_feature: GYAE6OF02F2UAE.12.71.G05.1.454.CMB.1.raw
  modified_base (301)..(301): a, c, t, g, unknown or other
  misc_feature (301)..(301): n is a, c, g, or t
  modified_base (330)..(330): a, c, t, g, unknown or other
  misc_feature (330)..(330): n is a, c, g, or t
  modified_base (383)..(383): a, c, t, g, unknown or other
  misc_feature (383)..(383): n is a, c, g, or t
tcagatacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtggaccagtaatgtattttggaatttgaccttagtctctggtacaacaactacccggcaacgtcccaagttaatcatttangaggcacgtaagccgcctgagtagtttcngatcggtcttctctgctaccgaggtctggcgaccggctcctagacaatctcgngggcctcgacggtctggacgtacggacgtcctctacgttactactgtccgtagctactagtagtggtaaggttatacggtcgtagtttgggttacgttcgggaccggtaccgggaaaccgtaaaggtcgtacccggttaccgaacgttaccgaaccggaccccggtagggtcccttccggtaccccccgttcgggtacccttaccgtcccggtttccccgttacccccgtccgttacccccg

SEQ ID NO: 109079 - DNA, 563 bp, Homo sapiens
  misc_feature: GYAE6OF02FK60W.12.71.G05.1.454.CMB.1.raw
  modified_base (313)..(313): a, c, t, g, unknown or other
  misc_feature (313)..(313): n is a, c, g, or t
  modified_base (334)..(334): a, c, t, g, unknown or other
  misc_feature (334)..(334): n is a, c, g, or t
  modified_base (448)..(448): a, c, t, g, unknown or other
  misc_feature (448)..(448): n is a, c, g, or t
  modified_base (470)..(470): a, c, t, g, unknown or other
  misc_feature (470)..(470): n is a, c, g, or t
  modified_base (550)..(550): a, c, t, g, unknown or other
  misc_feature (550)..(550): n is a, c, g, or t
  modified_base (561)..(561): a, c, t, g, unknown or other
  misc_feature (561)..(561): n is a, c, g, or t
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccaatctgccctgactcagcctgcctccgtgtctgggtctcctggacagtcgatcaccatttcctgccaccggaaccaatagtcgacgttggtcgttataaccttttgctcctggtacaaacagcacccaggcaaacgcccccccaaactcctagatttangaggtcactattccggtcctnaggtaattttctaatcgctttctctggttccaagtctggccaacacggcctccctagacctattcctcgtcggggtcccagggcttggaacggacggaggctgaatttattacngcctagttcattatacaagtcnccttccacgttctcggtggttcgtcggcgggtcggaaccagtctagaccgtctaaggcacgcccaggctccgccctgccnctctcgtcccncc

SEQ ID NO: 109080 - DNA, 839 bp, Homo sapiens
  misc_feature: GYAE6OF02HC8SQ.12.71.G05.1.454.CMB.1.raw
  modified_base (231)..(231): a, c, t, g, unknown or other
  misc_feature (231)..(231): n is a, c, g, or t
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacacgggtcctgggcccagtcctcgccctgactcacgcctcgccgtccgtgtcgtcgggtcctccgtggactagtcgatccaccgtctctgcncgtcggacagtatcgttagtttaggtaaactttcgacgttagtcctccgtacggtaacctaacaaccgtacccggacaaaccgttaccccgtaaagttaactctaacgtttagcggagggtacctaacggtacggccggtcccgtacggtacggttacgtttcagtacgtcgttcgttcgtcgtacgtccgtaccgacgtcggtacggtcccggacccggtccctaccgtacggtcctacgtccgtcggtacgtccctcggtacggtcggtacggtaacgggaccggtacgtcgttagtaactttcgttacgtccgtagtaaccggttccttacgtaacttaaccgtacggtccggaaccgaccggtaccgtaccgtacccgtttaccttaccgggttttaccgttacggttaccgggtaacgggttaaccgggttacccgggttaacccgttacccggttaaaccccggttcccgggtttaacccgggtaccccgtaaccccgggttaaaccccgtaaacccccggtacccccgggtttaacccccttacggttaacccccggttaaccccggtttaaccccttccccggggttttaacccccccgg

SEQ ID NO: 109081 - DNA, 652 bp, Homo sapiens
  misc_feature: GYAE6OF02F6DOO.12.71.G05.1.454.CMB.1.raw
  modified_base (200)..(200): a, c, t, g, unknown or other
  misc_feature (200)..(200): n is a, c, g, or t
  modified_base (285)..(285): a, c, t, g, unknown or other
  misc_feature (285)..(285): n is a, c, g, or t
  modified_base (310)..(310): a, c, t, g, unknown or other
  misc_feature (310)..(310): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (621)..(621): a, c, t, g, unknown or other
  misc_feature (621)..(621): n is a, c, g, or t
  modified_base (641)..(641): a, c, t, g, unknown or other
  misc_feature (641)..(641): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctccgtggacngtcgatcaccgtctcctgcactgggaccagtaatgtattttaggaaattttgacctgtctcctggtaccaacaactaccccgganaaacgtccccaagttaatcatttangaggcaactaagcggccctgaggtnttcngatcgcttctctggctaccgagtcgtcggaccgacccggtccctcccgagaacctaagttacgtccgtacgggacctccgaggtctagggaacgggtacgagggtcctacgtacttaaacctcgtcgtcttgacctactaattacggtagggtagtttaacgagtaccgtaacggtttcgggttcggttcggggccggtaacgggaaacctaaggtccggtaacccgttacgtaacgtccgtaccgaacccgtaggcccgtacccggtccccgtggtaaccncttcccgtccgttacccccncccttaccccg

SEQ ID NO: 109082 - DNA, 700 bp, Homo sapiens
  misc_feature: GYAE6OF02HPM76.12.71.G05.1.454.CMB.1.raw
  modified_base (219)..(219): a, c, t, g, unknown or other
  misc_feature (219)..(219): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (304)..(304): a, c, t, g, unknown or other
  misc_feature (304)..(304): n is a, c, g, or t
  modified_base (368)..(368): a, c, t, g, unknown or other
  misc_feature (368)..(368): n is a, c, g, or t
tcagatacgacgtacacgaccggtgctcgatttagtgtcgtcgcaagagagagggggggggtcacaagaggcagcgctctcgggacgccgtccaccatggcctgggctctgctgctcctcactctcctcactcaggacacagggtcctgggcccagtctgccctgactcagcctgcctccgtgtctgggtcctccgtggacaggtcatcaccgtctccngcacgtgggaccagtaatgtatttggaatttgacctatctcctagtaccaanactacccgnaaacgtcccaagttatctaattangaggactacgtaacgcgaccctgaggtagttcagtatccgtcttctcgtgtcctacgacggtcncggaccgacccggtcctaccgtgactatactcgtggcctcgagctacggaggacgacgtcgtacgttaacttacgtaccgtggaccgttgtacctacgtaacgttaaggtgggtaagttaacgtacgtcgttaacgggtttcggggttcggttaccgggaccgggttaaccgggtaaaccgtaaggttacccggtacccggtaacccgtttaacgggtacccgaaccggtaccccgggtaaacggtcccggttacccccggttacccccggtacggtcccttaacccggtttcccgttaaccccgggttccccctacccccggttaccccgg

SEQ ID NO: 109083 - DNA, 750 bp, Homo sapiens
  misc_feature: GYAE6OF02HL66N.12.71.G05.1.454.CMB.1.raw
  modified_base (282)..(282): a, c, t, g, unknown or other
  misc_feature (282)..(282): n is a, c, g, or t
  modified_base (323)..(323): a, c, t, g, unknown or other
  misc_feature (323)..(323): n is a, c, g, or t
  modified_base (374)..(374): a, c, t, g, unknown or other
  misc_feature (374)..(374): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacgagggtcctgggcccagtctcgccctgactcacgcctgcctccgtgtcgtcgggtctccgtggactagtcgactccaccgtctccgtgctacgtggacctagtaatgtatttaggaatttcgacttagtctcgtgtaaccaanaacgtacccgacaaacgtcccaaagttaatctaagtttacnggtacggactaaccgtaacggcccggtaccctagacggttacgttttccgngtaacgttccgtcttccgtcgtcggtacctaccggaacggtcgtacgggccgggtaccccgggtcccttcccgtagtaaccgtaacttacgtccggttcggggtacccctaccggtaaggtccgtacgggtaacgggacccggaaggttccttaacgtaacgtttaacctacgttcggtccgttacgttacttacgtacgttaagggtacggtaagggtttaacgacggttacgttacgggtttcgggttcggtccgggacggtaccgggtaaactaacgggtaccgtaccgttacggtaacgtccgaacggccgtacgtcccggtcccgtcccgtacggtcctaccgttcccgttacctcccccgtacttccccg

SEQ ID NO: 109084 - DNA, 640 bp, Homo sapiens
  misc_feature: GYAE6OF02HGJWO.12.71.G05.1.454.CMB.1.raw
  modified_base (279)..(279): a, c, t, g, unknown or other
  misc_feature (279)..(279): n is a, c, g, or t
  modified_base (294)..(294): a, c, t, g, unknown or other
  misc_feature (294)..(294): n is a, c, g, or t
  modified_base (332)..(332): a, c, t, g, unknown or other
  misc_feature (332)..(332): n is a, c, g, or t
  modified_base (467)..(467): a, c, t, g, unknown or other
  misc_feature (467)..(467): n is a, c, g, or t
  modified_base (479)..(479): a, c, t, g, unknown or other
  misc_feature (479)..(479): n is a, c, g, or t
  modified_base (501)..(501): a, c, t, g, unknown or other
  misc_feature (501)..(501): n is a, c, g, or t
tcagatacgacgtacacgaccggtgctcgatttagtgtcgtcgcaagagagaggggggggggtcacaagaggcagcgctctcgggacgcctccaccatggcctgggctctgctgcctcctcactctcctcactcaggacacagggtcctcgggcccagtctcgccctgactcagcctgcctccgtgtcgtgggtctcctgacagtcgatcaccgtctctgcacgtggaccagtaatgtagtttgaatttgaccttgtctcgtgtaccaacacaccgganaacgtcccaagttanctattatgaggcaacgtaagccgcctacgagtgtttcngtatcgtcttctctggtcaccgaagtcgtcgggacccggtaccgggtccctcctacggtacaaagttcctcggtcgggtccttacccgaggtccgtaggacgggtacgacgggtctaacgtacttacgttaaccncgtcttcgcctntaagttcggtggttaacgttanacgttcgtacggtttcggggtggttcccgggcgggttaccggaaaccgtaagtaccgacccgttacgtacgtacgaccggacccggtacggccttccggtcccctggtccctacgtccgttcccgtccctcccctaccg

SEQ ID NO: 109085 - DNA, 661 bp, Homo sapiens
  misc_feature: GYAE6OF02IFTTM.12.71.G05.1.454.CMB.1.raw
  modified_base (170)..(170): a, c, t, g, unknown or other
  misc_feature (170)..(170): n is a, c, g, or t
  modified_base (326)..(326): a, c, t, g, unknown or other
  misc_feature (326)..(326): n is a, c, g, or t
  modified_base (496)..(496): a, c, t, g, unknown or other
  misc_feature (496)..(496): n is a, c, g, or t
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacgagggtcctgggcccagtctgccctgactnagcctgcctccgtgtcgtgggtcctccgtggacagtcgactcaccgttcctcctgctacgtgggaaccagtaatgtagttttaggaaatttcgactagtctctcggtaaccaacaacgtaccccgacaaacgtccccaaagttactactaatttangagggtactacgtaacgccggtcctacgaggtacgtttctgatccgtacttctcgtcggctaccgaaggtcacggggccgtacccggccctacccgtagaaccaattacgtcgtcgggcctcgaggtcgtagggacggacgagtcctatacttacgacgtgtctcgactntagtgtaggaagttcgagtcgtacgtttgggtcgtacgggccggtacggaacgtaaagtcgggtaaccgttacgtaacggtaccgaacggacccgtacggtcccgtacccgccccgttaccggccttaccggttcccttaccgttacccccctcgtttaaccccg

SEQ ID NO: 109086 - DNA, 723 bp, Homo sapiens
  misc_feature: GYAE6OF02ISVJ8.12.71.G05.1.454.CMB.1.raw
  modified_base (557)..(557): a, c, t, g, unknown or other
  misc_feature (557)..(557): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacgagggtcctgggcccagtctgccctgactcagcctgcctccgtgtctgggtctccgtggacagtcgatcaccgtctcctgcacgtgggaccagtaatgtattttggaaattttgacctagtctctgtacaacactacccgactaacgtccctaagttaactctatttatggtaacggtactaacgtaacggccggtccctacgtacggtagtttcgtagtacgtccgtacgtttctcgtcggtcgtaccgtaacgggtcctcgggaccggtaccccggtccctacccgtacgaaccgtacttacgtcggtcgggtcctaccggacggtcgtagggaacgggacggacggttacgtacgtaacgtttaacgtacgttcgtacctcgtaccttacgtaagttagtaggtaacggtttaanagtaccggttacgtttggggttacggtaccgggtaggtaccgggtaaaccggtaaggtccgtaaccgtacgtaacgtaccggaaccggtaccgtaacggtcccgtacccgtccccggttccgtaccgttccgttacccgttcccgttcccctacccctttacccgg

SEQ ID NO: 109087 - DNA, 772 bp, Homo sapiens
  misc_feature: GYAE6OF02HBZKO.12.71.G05.1.454.CMB.1.raw
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
  modified_base (338)..(338): a, c, t, g, unknown or other
  misc_feature (338)..(338): n is a, c, g, or t
  modified_base (396)..(396): a, c, t, g, unknown or other
  misc_feature (396)..(396): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctggtctcctggacagtcgatcaccgtctcctgcacgtgggaccagtaatgtattttggtaaattttcgactagtctcctggtaccaacaataccccgnaaacgtccccaaagttaatcatttangagggcactacgcggccctcaggtatttcngactcgtcttctcgtggccttaccgaacggctcgggaccgacccgggtccctacccgnacctaatactcgtcgggtcctaccgaggcctggaacgggaccgacgggtcctacgttaactttaacctaacgttcgaccgtttcggaccttaacgtaacgttaacgttacggggtaacggttttaacgtaacggtccgtttaaaccgggtttttgggggttccggggttttcccggggacccggggggttaaccgggggttaaaacccgaaaagggttcccgggtaacccggttaccccgttaaaggttacccggtaaaccgggacccccggtaaaacgggtcccttaccccgggtcccccccggtttaccggtaccccgttaccggtttaccccgttaccccggttttacccccctacccccgttttcccccggg

SEQ ID NO: 109088 - DNA, 750 bp, Homo sapiens
  misc_feature: GYAE6OF02IG4KG.12.71.G05.1.454.CMB.1.raw
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttagtaagtttcgactagttctccgtggtaaccaactaactaccccggactaaaacgtcccctaaattaacgtactatttaagtggaacggtacaacgttaacggccggtccctacgaggttacgttttctagtacgttccgtactttccgtcgtcggtcctaccgaaaggtcgtacggggccgacccgggtccctacccgtagaacctaaacttacgtccggtcggggtcctacccggaggtccgtagggacgggaacgacgggtcctactaacgttaccttaacgtccgtctcgtccttactagttacgaggtaaggttaacgtagtaccttagggttcggggtttacgttcccgggggaacgggtaccgggtaaacggtacgggtaacccggaccggtttaccgtaaccggttacggaacggtacccgtaacgggtcccggttccccggacccccggtttaggtaccccttccggttacccgtttacccggtttcccccccacccgttttccccg

SEQ ID NO: 109089 - DNA, 757 bp, Homo sapiens
  misc_feature: GYAE6OF02HUR0J.12.71.G05.1.454.CMB.1.raw
  modified_base (220)..(220): a, c, t, g, unknown or other
  misc_feature (220)..(220): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacgagggtcctgggcccagtctgccctgactcacgcctcgcctcgtgtctggtctcgtggactagtcgactccaccgtctcgngactacgtcgggaccaagtaagtcgttagttttaggaaacttttcgaccttagtctaccgtggtaaccaacgaacgtaccccggactaaacgtacccctaaaagttactacttaatttacgtacggtaacggacctaacgtaacggacccggtaccctacgaaggtacgttttcgtagtactccgtactttcgcgtacggtaccttaccgaacggtcgtacggtcccggaacccgggttccctacccgtagaaactaagttacgtacgttccggggccttaccgacggtcgtaagggacgacgcgtacgtattaaccgttacgtaacgttcgacttacgtactcgtaaacgttgtagggaacgtttagtacggtcgttaaacggtttcggggtaacggttccggggaccgaaccggggtaaacgtaaacgggttaccgaacccggttaacgttaacggtaccgaaccggtaccgtaaacgcccgtaccgtcccgtcgttacgaccgttacctttcccggtaccctcccgtttacccg

SEQ ID NO: 109090 - DNA, 723 bp, Homo sapiens
  misc_feature: GYAE6OF02H1XJE.12.71.G05.1.454.CMB.1.raw
  modified_base (196)..(196): a, c, t, g, unknown or other
  misc_feature (196)..(196): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctcgtgtctggtctctggacngtcgatcaccgtctcctgcacgtcggaccagtaatgtattttggaattttgactagtctctgtaccaacacgtaccccgacaacgtccccaagttactctatttagtgacggactacgtaagccggtccctgaggtactttctgtacttcgtacttccgtcgtcggccttaccgaggtccgtacgggcccggaccccgggtccctccgtacgaacctaagttacgttcgtcgggacctttaccgaggtccgtagggacgggacggacggtaccttcgtaacttaccgtacgtcgtcgtcgtaccttacgtagttacggtaggtacggtttacgtacgaccggtttacgggtttcggggtttccggttaccgggggaccgggtaccggggtaaaccgtaacgggttaccggtacccggttaccgtaacggttccggaaaccggtcccggtaacgggttccccgtacccggtcccccgttagggtccctacccgttccggtttacccttccccccgtacccgttacccg

SEQ ID NO: 109091 - DNA, 554 bp, Homo sapiens
  misc_feature: GYAE6OF02HWE53.12.71.G05.1.454.CMB.1.raw
  modified_base (309)..(309): a, c, t, g, unknown or other
  misc_feature (309)..(309): n is a, c, g, or t
  modified_base (363)..(363): a, c, t, g, unknown or other
  misc_feature (363)..(363): n is a, c, g, or t
  modified_base (409)..(409): a, c, t, g, unknown or other
  misc_feature (409)..(409): n is a, c, g, or t
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaaactcatgtatttanggaggcactaagccgccctcgtagggtttctatcgtcttctcgtgctcgagtcnggacaacacgcctcctgacactctcgtggctcgagctggaggacgnggcggtattacgttactgttgctacatgtggcgggttagtagcttacgtttcgattcgtcttacgttcgggacggtacggaccaggcgttacgaccgtccggtcggtaccacgcccgaaggtcctcccggtccccgtggtacccg

SEQ ID NO: 109092 - DNA, 931 bp, Homo sapiens
  misc_feature: GYAE6OF02FUWGP.12.71.G05.1.454.CMB.1.raw
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacgagggtcctgggcccagtctgccctgactcagcctgcctcgtgtcgtgggtctccgtggacagtcgactcaccgtctcctgctacgtgggaccagtaatgtagttttaggaaattttgaccttgttacctccgttagggtaacccaacgaacgttaacccccggactaaaacggttacccccgtaaagttaaacttccttaagttttactacggaacggggtacctaaacgttaacgggcccgtacccgtacgtaacgggttaacgtttctacggtaattccggtaccttttcgtccgttcggtacccgttaacccgtaacgggggtccttccggggaccgggtaacccccggggtcccgtttaccccgtaacggtaacctaaacgtttaccggttccggttacggggtacccgttacccgggtaacgggtacccggttacggggtaaaccgggaaccggggttaacgggtcccgtttaccgtaaacgtttaaccccggtttaacgtaccgggttccgtttacgggacccgttttacgtaacgtttaacgggtttacgggtaaaagggttttacgttaaccggtacggttttaccgggtttagggggttcggttaacccgggggtaccgggttaaccggggaaaccgttaaacggggttccgttaacccggttaccggtaaccggttaacgtacccggggtaacctacccgggtaccggtcccggttaccccgttacccgggttccggttaaccttcccggtttaccccgttaccccgtccccgttaccccg

SEQ ID NO: 109093 - DNA, 772 bp, Homo sapiens
  misc_feature: GYAE6OF02JKCL1.12.71.G05.1.454.CMB.1.raw
  modified_base (288)..(288): a, c, t, g, unknown or other
  misc_feature (288)..(288): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctcgccctgactcagcctgcctccgtgtcgtgggtctccgtggactaggtcatccaccgtctcctgcacgtcgggaccagtaatgtatttaggtaaattttgaccttgtctcctgaccaacaactacccganaacgtccctaagttaatctatttacaggacggactaacgtaacggccggccctagaggttacgtttcagtacgtcgtacttcgtcgtaggtcctaccggtaacggtccggtacgggtaccccggaccccggggtcccttacccgtagtaaccgtaaaacgttcgtaccggtccggggtccctacggtaaccggtacgttagggacgggtaaccggtacgtaccgtacgtacttaaccgtactacggtcctacgaccttactaagttacggttagggtaacgggttaactacggttaccgttaccgggttttggggtcggtttcccggggaccgggttaccgggtaaaccgtaacgggttaccgaacccgggtttaccgtaacggttaccgaaccgggtaacccgtaacgggtcccgtacccggtccccggttaccggtccgttacccggttacccgtttacccgttcccctaccccgttccccg

SEQ ID NO: 109094 - DNA, 758 bp, Homo sapiens
  misc_feature: GYAE6OF02GUR06.12.71.G05.1.454.CMB.1.raw
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctcggccctgtacctcacgcctcgcccttccggtgtcgtgggtctccgtggacaggtcgatcaccgtctccgtgcctacgtcgggacctagtaatgtagttttaggaaattttcgacttagtctcctcgtaaccaacaactaccccgacaaacgtccccaagttaactcctaatttagaggacgggactaacgtaacggcccgggtccctaggtacggttagtttcgagtacttcgttacgttcctccgtcggtacctaccgaaggtccgttcgggacccggtacccggtcccttacccgtacggtaacctaagttaccgtccgtacgggtaccgtccggaggtcgttagggacgggaaccggtagtccctaacttaacgttaaccgtacttccggacggttctacctacgtaaacttacggtaggtttaacggttactaagggttcccgtagggttttcgggttcgggtccgggtacgggaaccggtaacgtaaggtcccgtaaccgtaccgtaagtaccgtaccggaaccggtacgtccggtacccgtccccggtacgttccctacggtccctttcccggtaccccgttcccttaccgg

SEQ ID NO: 109095 - DNA, 679 bp, Homo sapiens
  misc_feature: GYAE6OF02HO5FE.12.71.G05.1.454.CMB.1.raw
  modified_base (547)..(547): a, c, t, g, unknown or other
  misc_feature (547)..(547): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtggaccagtaatgtattttggaaatttcgaccttagtctccgtcgtaccaactaactaccccggacaaacgtccccaaagttaactctaactttagtggaacgggtactaacgtaacggccggtccctacgtaaggtacgttttctcgtaattccgttccttcgtccgtcgggtcctacccgaaggccgtcgggccggtacccgggtccttacccgtagaactaaagttcgtccggtacgggtcctaccggaggtaccgtcggaacgggaccgacggtcctacgtaacgttacgtacgtcgtctgactctagtagtggtaagttanacgtcgttaggttcgggtcgtcgggacgggtacggtaaacctaaggtccggtaccgtacgtaggtccgacgtacccgaaggtcctcccggtcccgtcggtacctaccgttcgtcccgttcccgtcccttccg

SEQ ID NO: 109096 - DNA, 713 bp, Homo sapiens
  misc_feature: GYAE6OF02F077Q.12.71.G05.1.454.CMB.1.raw
  modified_base (199)..(199): a, c, t, g, unknown or other
  misc_feature (199)..(199): n is a, c, g, or t
  modified_base (296)..(296): a, c, t, g, unknown or other
  misc_feature (296)..(296): n is a, c, g, or t
  modified_base (326)..(326): a, c, t, g, unknown or other
  misc_feature (326)..(326): n is a, c, g, or t
  modified_base (460)..(460): a, c, t, g, unknown or other
  misc_feature (460)..(460): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctcactcaggacacagggtcctcgggcccagtctcgccctgacctcacgcctcgcctccgtgtcgtgggtctccgtgacncgtcgatccaccgtctcctgcacgtggaccaagtatgtagtttagtaaatttgaccttacgttctccgtacgtaaccaaactaaccgtaccccgganaaacgttaaccccaagttaactctattagnggaacggactacgtaacggccgccgtagtacggttattccgtagtacttccgtacgttctcgtcgtacctacgacggtcgtccggccggaccccggtcctccgtacaaactacgttacgtcgtacggcctccgnggtactaggacggtacgcgacgtactaacttaccgcgtcggtactgtactacgtatacggttaggtaacgttactacggtacttacgggttgggtaccgggttcggggaccggtaaccggaacggtaagttaccgtaacgttacccgtaactaccgggtaactaccccggtaagtccccgttacccgttcccccgggtagttccctacccggttacccgttaccccggtttcccccgtaccccgtttaccccg

SEQ ID NO: 109097 - DNA, 692 bp, Homo sapiens
  misc_feature: GYAE6OF02G1O2S.12.71.G05.1.454.CMB.1.raw
  modified_base (200)..(200): a, c, t, g, unknown or other
  misc_feature (200)..(200): n is a, c, g, or t
  modified_base (374)..(374): a, c, t, g, unknown or other
  misc_feature (374)..(374): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctccgtggacngtcgatccaccgtctcctgcacgtgggaccagtaatgtattttaggaaattttgaaccttagtcctcctacggtaaccaacaacgtaccccggactaaacgtcccctaagttaactctaatttacgtggacgggtacctaacgttaacgccgggtccctacgaggtacgtttcngtacttcgtacttccgtctcggtcctaccgaacggtcgtcgggacccgaccgggtccctaccgtaggaactaagttactcgtcgggtccctcgacggctgggacgaacggtcgtcgtatacttacgtactcgtctacgtctacgtaattagtcggtaagttagtacgtaccgttagggtttcggtacgggtttaccgggcgggtacccgggaacttaaagggccgtaaccgtacctaaggtccggaacggaccctaacggtccgtacccgtccccgtcggtaccttccgtccgtttacccgtcccgtacccttacccg

SEQ ID NO: 109098 - DNA, 774 bp, Homo sapiens
  misc_feature: GYAE6OF02G1LI8.12.71.G05.1.454.CMB.1.raw
  modified_base (278)..(278): a, c, t, g, unknown or other
  misc_feature (278)..(278): n is a, c, g, or t
tcagatacgacgtacacgaccggtgctcgatttagtgtcgtcgcaagagagaggggagtgaggagcagcgctctcgggacgcctccaccatggcctgggctctgctgctcctcactctcctcactcaggacacacgggtcctgggcccagtctcgccctagactcgagtcctgcctccgtgtcgtgggtcctccgtggacacgtcgactccgaccgttctccctgcctaccggtcgggacctaggtaactgttagttttaggtaaatttcgaccgttntcctccgttaggaaccctaacaaccgtaccccggactaaaccggtaccctaaagtttactctaacgtttagtgggaacgggtctaacggttaaccggcccggtacccttacggaagggttcgttttacgtacgggtacttccggttcctttaccgtgttaccggtacctacggacggggtccggtcgggacccggtaccccgggtcctaccgtagaacctattccggcggtacggacctcgtacgtcgtacgggaacggacggtcgtacctacgtacgttaaccgtacgtcgtacgtcgtcttacgtacgttacggtaggttacgttaacgtacgtacggttagggtttacggggttcggttccggggtaccggtaaccgggtaaccgtaaacggttccgtaaccgtacgttaccgtaccggtacggaccggtaacgtcccgttacccgtcccgaccgttaccgtccgttcccggtccgttccctcccgttacccg

SEQ ID NO: 109099 - DNA, 675 bp, Homo sapiens
  misc_feature: GYAE6OF02I3JYV.12.71.G05.1.454.CMB.1.raw
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
tcagatacgacgtacacgaccggtgctcgatttagtgtcgtcgcaagagagagggggggggtcacaagaggcagcgctctcgggacgcctccaccatggcctgggctccgctgctcctcactctcctcactcaggacacaggtcctgggcccagtctgccctgactcagcctgcctccgtgtctgggtctcctggacagtcgatcaccgtctcctgcactgggaccagtaactgtattttaggaaatttgacctagtcctctgtaccaacaactaccccgacaaacgtcccctaagttaactctatttactgaggcaactaaggccgtcctanaggtatttacgtnattcgcttctcgtcggacctaccgaaggtcgtacggaccgacccggtcccttacccgtagaacctaatacgtcgtggtaccctcgacggtctggaacggacgtacggtcctacgtacgttactaacgtcgactcgtactcgtaagttacgtagggttaacgtttagacgtccgttaaggtttcgggtacggttccgggacgggaccgggtaaacgtaaacggttccgtaaccttacgtagtaccgacgtacccggaaggtcctacccggtccccgttacgtaccgtacccgtttccgtcccgttccccctacccgttccgttaacccgg

SEQ ID NO: 109100 - DNA, 719 bp, Homo sapiens
  misc_feature: GYAE6OF02FZ4VK.12.71.G05.1.454.CMB.1.raw
  modified_base (169)..(169): a, c, t, g, unknown or other
  misc_feature (169)..(169): n is a, c, g, or t
  modified_base (223)..(223): a, c, t, g, unknown or other
  misc_feature (223)..(223): n is a, c, g, or t
  modified_base (294)..(294): a, c, t, g, unknown or other
  misc_feature (294)..(294): n is a, c, g, or t
  modified_base (454)..(454): a, c, t, g, unknown or other
  misc_feature (454)..(454): n is a, c, g, or t
tcagatacgacgtacacgaccggtgctcgatttagtgtcgtcgcaagagagaggggggggggtcacaagaggcagcgctctcgggacgcctccaccatggcctgggctctgctgctcctcactctcctcatcaggacacagggtcctgggcccagtctgccctgacctnagcctgcctccgtgtcgtgggtctccgtggacagtcgatccaccgtctcctgcncgtagggaccagtatgtactttggtaaatttgacctagtctccgtacggtaaccaactaacgtaccccganaaaccgtccctaagttaactactatttgaggacggaccaactaacggccgtacctacgaaggttcttcgtgaacttcgtaccttctcgtcggcctaccggaagtccgtacggaccgcccggtcctccgtactaacgtactacgtcggtcggtctaccggnggtcgtagacggtacggtcgtctacggttacttaccgtagttacggtcttacgccttactaaggtggtttacggtagttaacgttgaaccggttagttcggggtcggttccgggacgggtaacccgtaacgtaaacgtccggttaacccttaacggtcccgaaggtaccccgaacccggtacggaccccggttccccggacccccgggtttccaaccgtttaccccgttcccggttacccttacccccggtacccctttacccgg

SEQ ID NO: 109101 - DNA, 744 bp, Homo sapiens
  misc_feature: GYAE6OF02JGQQF.12.71.G05.1.454.CMB.1.raw
  modified_base (313)..(313): a, c, t, g, unknown or other
  misc_feature (313)..(313): n is a, c, g, or t
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctcgccctgactcagcctgcctccgtgtctgggtctccgtggacagtcgatccaccgttctcctgaccacgtgggacctagtatgtatttggaatttgactgtctcagtaccaacactacccggacaacgtacccaaagttactacacttttaagnggaaggtccaacgttaacggcccgtaccgtacgaggtacgtttcagtatccgtcttactcgtagtctaccgagtccgtacgaccggtacccggcctccgtacgaacgtaactgtccgtagggcctaccggaggtcgtaacggacgggacggtacggtccgttaactacgtttaacccacgttggtaccgtggtaccctttagaacgttaacgggttcggttaaacggttacggtaccggttaccgttacgggtttggggtacccggggttacgggccggggtaaacccgggtaaaccgtaacgggttccggttaaccgttaccgttaccggtaaccgggaaccctaccgggtaaccgttccggtacccccgtcccgggttaccgtacctccgtttacccggttacccgttaccccccggttccttccccgg

SEQ ID NO: 109102 - DNA, 833 bp, Homo sapiens
  misc_feature: GYAE6OF02FKJCC.12.71.G05.1.454.CMB.1.raw
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtgggaccagtaatgtattttaggtaaattttcgacctagtcctccgtggtcgaccaaacaacgtacccccggacaaaacgtaccccctaaagttaactacctaagtttagtacggacgggtacaaccgtaaaggcccggaccccttacgtaagggtacgttttctacggtaacttcggttcctttctacgtcggtcgttacccgaagggtccgtcgggacccggtacccggggccccttacccgtacggaacttaacgttccgtcgggtaaccgggtcccgttaccggacgggtacgttacgggacgggtaaccgggacgggtccttaaccgtaactttaaccgtaaccgttcggtacctacgggtcccttaaccgtaagttacgttaggggtaacgtttaagtaccggttacgtaaacgggtttcggggttaccgggtttaccgggaccgggtaccgggtaaaccgtaacgggttaaccggtaccccgttaaccggttaaccggttaccgaaccgggtaccccgtaacgggttcccgtacccggtaccccccggtacggttaccccgtaacccggttcccggttaccccgttcccccggttaacccccgg

SEQ ID NO: 109103 - DNA, 682 bp, Homo sapiens
  misc_feature: GYAE6OF02FXPLF.12.71.G05.1.454.CMB.1.raw
  modified_base (314)..(314): a, c, t, g, unknown or other
  misc_feature (314)..(314): n is a, c, g, or t
  modified_base (354)..(354): a, c, t, g, unknown or other
  misc_feature (354)..(354): n is a, c, g, or t
  modified_base (503)..(503): a, c, t, g, unknown or other
  misc_feature (503)..(503): n is a, c, g, or t
  modified_base (519)..(519): a, c, t, g, unknown or other
  misc_feature (519)..(519): n is a, c, g, or t
tcagatacgacgtacacgaccggtgctcgatttagtgtcgtcgcaagagagaggggggggggtcacaagaggcagcgctctcgggacgcctccaccatggcctgggctctgctgctcctcactctcctcactcaggacacagggtcctgggcccagtctgccctgactcagcctgcctcgtgtctgggtctccgtggacagtcgatcaccgttctcctgcacgtggacctagtaatgtattttggaaattttgacttagtctctcgtacaacaacgtacccgactaaacgtcccctaaagttaatctaatttanagacggctaacgtaacgccggacctacgaggtcgtttacngtactcgtcttacgtcgtgtcctacgaacggcgtcggtccgacccgggcccttccgtacgaacctaattacgttccggtacgggtaccctccgaagggttaccgaggtaacgggaccgacgggtaccttacgaactttaacctaacgtnaccgtacgtccgttanacttagtagggtaagttactaggcttacggttgggtcgttacgggacggtaaccggacgtaaaggtcgtaaccgttcgtaaaccgtcgtaaccggaccgtaacggtacctcccggtccccgttacggcctaaccgttccgtacccgttccccgcccttacccg

SEQ ID NO: 109104 - DNA, 622 bp, Homo sapiens
  misc_feature: GYAE6OF02GJIC1.12.71.G05.1.454.CMB.1.raw
  modified_base (291)..(291): a, c, t, g, unknown or other
  misc_feature (291)..(291): n is a, c, g, or t
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
tcagatacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctcgtgtctggtctcctggacagtcgatcaccgtctcctgcacgtggaccagtatgtatttgaatttgactatctctgtacaacactacccgcaaagtcccaagttatctatttangagggcacgtaagccggcctacaggtatttctgtacgtcgtcttctctcggctaccaagggtctcggccgacccgggccctcctacgacctaaatactcgtcgggtacctccggaggtccgtagacgggacggtacggctcgtaattactacgtntcgtgtctanacttagtggtaagttatacgcgtacggttcgggtttcggtcgggtaccgggtaccggtaaaccgtaagtaccggtacccgttactacgtaccgaaccgacccggtacggtcctccccggtaccctccggtctaccgtccctacccgttacccctacccgttacccg

SEQ ID NO: 109105 - DNA, 684 bp, Homo sapiens
  misc_feature: GYAE6OF02F929S.12.71.G05.1.454.CMB.1.raw
  modified_base (474)..(474): a, c, t, g, unknown or other
  misc_feature (474)..(474): n is a, c, g, or t
tcagatacgacgtacacgaccggtgctcgatttagtgtcgtcgcaagagagagggggggggggtcacaagaggcagcgctctcgggacgcctccaccatggcctgggctctgctgctcctcactctcctcactcaggacacagggtcctgggcccagtctgccctgactcagcctgcctcctgtctgggtctccgtggacagtcgatcaccgtctcctgcacgtgggaccagtatgtatttaggtaatttgacctgtcctcgtacgtaccaacaacgtaccccggacaaacgtccccaagttaactctaactttagaggtacggggacctaacgtaacggcccggtaccctacggacggtacgtttccagtacgtcgtcctttcgtcgtggcctacggacggtcgtcgggccgacccgggtcctccgacgtacctatcgtcgtcggcctacgaggctaggacgacggtacgtcncttacttactcgtagtcttcgcttacgtagtaggtagttacggttagtcacggttcggtttaggggtcggttccgggagggtaacccggaacgtaaacgggttccgacccgttaccggtagtaccggaaccggtacgtaccgggtcccttacccgggtccccgtcggtacccttccgttacccgttcccggttacccctacccgttcccg

SEQ ID NO: 109106 - DNA, 737 bp, Homo sapiens
  misc_feature: GYAE6OF02G93E3.12.71.G05.1.454.CMB.1.raw
  modified_base (184)..(184): a, c, t, g, unknown or other
  misc_feature (184)..(184): n is a, c, g, or t
  modified_base (211)..(211): a, c, t, g, unknown or other
  misc_feature (211)..(211): n is a, c, g, or t
  modified_base (384)..(384): a, c, t, g, unknown or other
  misc_feature (384)..(384): n is a, c, g, or t
  modified_base (481)..(481): a, c, t, g, unknown or other
  misc_feature (481)..(481): n is a, c, g, or t
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
tcagatacgacgtacacgaccggtgctcgatttagtgtcgtcgcaagagagagggggggggtcacaagaggcagcgctctcgggacgcctccaccatggcctgggctctgctgcctcctcactctcctcactcaggacacgacgggtcctgggcccagtccgtcgcccttgaactcagtcctcncctccgtgtcgtgggtctccgtggacngtcgatccaccgtctcctgctacgtcggactaagtactgtagtttagtaattcgtaacctgtcttccgtacgtaaccaacgtaaccgaaccccggtactaacgtaccccgtaaagttaactctaagttcaggacggtactaacgtaacgccggtacctacgtagttgttccgngtacgtcgtctcgtgtcggacctacgacgtcgcggtccggacctccgtacgtagaactagtagccggttcgccgtcggtaacgcggtagaacgggcncgtaacgtctaactaacgtcgtnccgtntacgttataaggttcgtagggtacgttacgtaccgttacttacggggtttcggtaacggttcccgggaacgggttaacccggggaaataaacccgggttccgtaacccgggtttacctaagggtaccctaaacccgggaccgtaacgggtcccgttaaccccggtccgggttaaaccttccgttaaacccggttccttaaccccgttccccgggtaaccctttcccgg

SEQ ID NO: 109107 - DNA, 712 bp, Homo sapiens
  misc_feature: GYAE6OF02IU32Q.12.71.G05.1.454.CMB.1.raw
  modified_base (331)..(331): a, c, t, g, unknown or other
  misc_feature (331)..(331): n is a, c, g, or t
  modified_base (371)..(371): a, c, t, g, unknown or other
  misc_feature (371)..(371): n is a, c, g, or t
tcagatacgacgtacacgaccggtgctcgatttagtgtcgtcgcaagagagagggggggggggtcacaagaggcagcgctctcgggacgcctccaccatggcctgggctctgctgctcctcactctcctcactcaggacacagggtcctcgggcccagtctgccctgacctcagcctgccctccgtgtcgtgggtctcctggacagtcgatccaccgtctcctcgcacgtggaccagtaatgtatttaggtaatttcgaccttagtccttctacgtaacccaacaaccgtaccccggacaaaccgtacccctaaagttaactctatttagnggtacggtacaacgtacgccggtccacgtaggtctttcgngtagtcgtcttctcgtcgtcctacgaggcgtcggaccgacccgggtcctaccgtagaactatcgtcggtcggtacctaccgcgtcgtagggacggacggtacgtcgtactaacttaccgtacgttcgtccgttcgtaccttactagttacggttaggttaacgttagtacggttacgtttacgggttgggttccgggtaccgggtaccggggtaaccggtaaccgtaaaccggtacgtaccgttacgttaacgtccggtaacggtacccgtaaccggtccgttaccccggcccgttacgtcccggtaccttcccgtacccgttcccctaccccgttacccg

SEQ ID NO: 109108 - DNA, 506 bp, Homo sapiens
  misc_feature: GYAE6OF01BFM5X.39.24.C02.1.454.CMB.1.raw
  modified_base (474)..(474): a, c, t, g, unknown or other
  misc_feature (474)..(474): n is a, c, g, or t
tcagtcgcactagtcacgaccggtgctcgatttagtacagatcgttagggaaaggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggccagtcagaccattacctcctatttaagttggtatcagcagaaaccaggaaaacgcccctaaaactcctagatctatgctgcgtccactttgcaagatgggtcccatcaaggttcagtgctagtggatatgggacagatttcactctcaccatcacaggtctgcaacgtgatgtattttgactaacttactactgtacaacagtagttacagagtctaggaaggtactacgttttggaccgtagggaccgaagntaggagagtcaagacgaacgtgtggctgtacc

SEQ ID NO: 109109 - DNA, 526 bp, Homo sapiens
  misc_feature: GYAE6OF01BPPZN.39.24.C02.1.454.CMB.1.raw
  modified_base (429)..(429): a, c, t, g, unknown or other
  misc_feature (429)..(429): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggccagtcagaccattacctcctatttaagttggtatcagcagaaaccaggaaagcccctaaactcctgatctatgctgcgtccactttgcaagatggggtcccatcaaggttcagtgctagtggatatgggacagtatttcactctcaccatcacaggtctgcaacgtgatgtattttgctaacttactactgtacaactagacgttanagagactaggaaggtactacgttttggaccgtaacggggtacccaaggtcgtagggagagtacaaggtaaccgaacgttggtcggtccgtgtacccg

SEQ ID NO: 109110 - DNA, 516 bp, Homo sapiens
  misc_feature: GYAE6OF01DLJXO.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcgggacagagtcaccatcacttgccgggccagtcagaccattacctcctatttaagttggtatcagcagaaaccaggaaacgcccctaaactcctgatctatgctgcgtccactttgacagatgggtcccatcaaggttcagtgcgtagtggatatgggacagtatttcacttctcaccatcacaggtctgacaacgtgatgtattttgactaactttactactcgtacaacagtaagttacagagtactggaacgggtacttacgttttggaccgtaggggaccaaggtcgtaggagatcgaagtacgaactgaggtctgacc

SEQ ID NO: 109111 - DNA, 502 bp, Homo sapiens
  misc_feature: GYAE6OF01DP00H.39.24.C02.1.454.CMB.1.raw
  modified_base (468)..(468): a, c, t, g, unknown or other
  misc_feature (468)..(468): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctcctgtctgcatctgtcggggacagagtcacatcacttgccggcagtcagaccattacctcctatttaagttggtatcagcagaaaccaggaaagcccctaaactcctgatctatgctgcgtccacttttgcaagatcgggtcccatcaaggttcagtgctagtggatagtgggacagatttcacttctcaccatcacaggtctgacaacgtgactgtattttgtctaacttactactcgtcaacagagttacagagctagaggtactacgttttggccgagggaccgaaggntggagagtcaagtacgaactggtggctggtaccg

SEQ ID NO: 109112 - DNA, 606 bp, Homo sapiens
  misc_feature: GYAE6OF01BFJGK.39.24.C02.1.454.CMB.1.raw
tcagtcgcactagtcacgaccggtgctcgatttagtacagatcgttagggaaagggggagtcagtctcagtcaggacacagcatggaccatgagggtccccgctcagctcctggggctcctgctactctggctccgaggtgccagatgtgacatccagatgactgctagtctccagtcctccctgtcctgcatctgtcgggacagagtcaccactcacttgccgggtccagtcagagtattagtagctggttggcctggtactcagtcagaaaccagggaagcccctaagctacctgactgtatgatcgcctccagtttgaaagtgggtccagtcgaaggttccgcggacagtggactctgggacagaacttcactctacaccatcagctagcctgctagcctgagtgtattttcgactaactttacgtttacgttcggtaccctaacgtaacgttaacttaagttaacggtttaagtttaccgttaaccgtaacgtttttacgggaacccgtaacgggggtaacccgtaaacgggtacgttacgggtaacgaacgttaaccgtaaaccggtaacttcggtacgggtccttacgtccgtaaccccg

SEQ ID NO: 109113 - DNA, 552 bp, Homo sapiens
  misc_feature: GYAE6OF01D93G0.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggccagtcagaccattacctcctatttaagttggtatcagcaagaaaccaaggaaaacgacccctaaactcctagatctatgctgcgtcctactttgacaagtagtcgggtcccatacaaggttcagtgctagtggatagtgggactagtatttcacttctcacctatcactaggtctgactaacgtgtatgtattttgactaactttactactgtacaactagtagttacagtagtacgtaggaacggttactacgttttacggaccgtaaggggaccgaaggtcgtaggagtaatacgaagtaaccgtaagtagtcggtcgtcgtaacccg

SEQ ID NO: 109114 - DNA, 512 bp, Homo sapiens
  misc_feature: GYAE6OF01CHIFW.39.24.C02.1.454.CMB.1.raw
  modified_base (438)..(438): a, c, t, g, unknown or other
  misc_feature (438)..(438): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggccagtcagaccattacctcctatttaagttggtatcagcagaaaccaggaaaacgcccctaaactcctgatctatgctgcgtccactttgcaagagtcggggtcccatcaagttcagtgctagtggatagtgggacagtatttcactctcaccatcacagtctgacaacgtgatgtattttgctaacttactactagtacaacagtagttaacagangtagaaggttactacgtttggaccgtagggaaccgaggcgtaggagatacgaggacgaactggagcgtgacccg

SEQ ID NO: 109115 - DNA, 527 bp, Homo sapiens
  misc_feature: GYAE6OF01BG6ZS.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccggccagtcagaccattacctcctatttaagttggtatcagcagaaaccaggaaaagccccctaaactcctgatctatgctgcgtccactttgcaagagtggggtcccatcaaggttcagtgctagtggatagtgggacagtatttcactctcaccatcacaggtctgacaacgtgatgtattttgactaacttactactgtacaacgtagagttacagacgcgtaggaagggttactacgtttgggaccgaacggggtaccaaggcgtagggacgatacgaaggtaccgaacttggtcggcgtggaacc

SEQ ID NO: 109116 - DNA, 517 bp, Homo sapiens
  misc_feature: GYAE6OF01EVJHU.39.24.C02.1.454.CMB.1.raw
  modified_base (510)..(510): a, c, t, g, unknown or other
  misc_feature (510)..(510): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcacatcacttgccggcagtcagaccattacctcctatttaagttggtatcagcagaaaccaggaaagaccccctaaactcctgatctatgctgctccactttgcaagatcgggtcccatcaaggttcagtgctagtggatagtggactagtatttcactctcaccatcactaggtctgacacgtagatgtattttgactaacttacttactatacaactaagtacgttacagagtctagtacggtactacgttttaggccgtagggtaccgaacgagtggagactacgagtaacgacgtaggtcgntgacccg

SEQ ID NO: 109117 - DNA, 494 bp, Homo sapiens
  misc_feature: GYAE6OF01AMV0V.39.24.C02.1.454.CMB.1.raw
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
  modified_base (474)..(474): a, c, t, g, unknown or other
  misc_feature (474)..(474): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggccagtcagaccattacctcctatttaagttggtatcagcagaaaccaggaaaagcccctaaactcctgatctatgctgcgtccactttgcaagatgggtcccatcaagttcagtgctagtggatagtgggacagtatttcactctcaccatcacaggtctgcaacgtgatgtattttgctaacttactactgtacaanagagttacagagntagaaggtactacgtttggccgtagggaccaagctggagatnagacgaactgtggctgaccg

SEQ ID NO: 109118 - DNA, 519 bp, Homo sapiens
  misc_feature: GYAE6OF01EYSY4.39.24.C02.1.454.CMB.1.raw
  modified_base (512)..(512): a, c, t, g, unknown or other
  misc_feature (512)..(512): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggccagtcagaccattacctcctatttaagttggtatcagcagaaaccaggaaaacgaccccctaaactcctagatctatgctgcgtccactttgcaagatgggtcccatcaaggttcagtgctagtggatagtgggacagatttcactctcaccatcacaggtctgctaacgtgatgtatttgactaacttactactgtacaacagtagtacagtagtcgtagaaggtactacgttttacggaccgtaaggggaccgtaaggcgtaggagatcgacgtaacgactggtcggngtgaccg

SEQ ID NO: 109119 - DNA, 583 bp, Homo sapiens
  misc_feature: GYAE6OF01EI9DY.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggccagtcagaccattacctcctatttaagttggtatcagcagaaaccaggaaaacgccccctaaactcctgatctatgctcgcgtacctactttgacaagacgtcggggtacccattacgtaacggttcagtcgcgttagtggaatagtgggacaagtactttcgacttctaccacactcaactaggtctacgactaacgtgtacttgtattttcgaccttaactttacttactagtaaccaacgtaagtagtttacgaagtagtacgtaggtaacgggtacttacggtttcggaccgtaaggggtaccaaggtcgtagggacgtagtacgaacggtacgtaacgtggttaggcgtcgtaccg

SEQ ID NO: 109120 - DNA, 519 bp, Homo sapiens
  misc_feature: GYAE6OF01B11UW.39.24.C02.1.454.CMB.1.raw
  modified_base (432)..(432): a, c, t, g, unknown or other
  misc_feature (432)..(432): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggccagtcagaccattacctcctatttaagttggtatcagcagaaaccaggaaaacgcccctaaactcctgatctaatgctgcgtccactttgcaagatggggtcccatcaaggttcagtgctagtggatagtgggacagtatttcactctcaccatcacagtctgcaacgtgattgtatttgactaacttactactgtacaacagtagttanagtagctaggaacggtactacgttttggccgaaggggaccgaaggacgtagggagagtacgaacgacgaactaggtcggcgtgaccg

SEQ ID NO: 109121 - DNA, 560 bp, Homo sapiens
  misc_feature: GYAE6OF01CDSJI.39.24.C02.1.454.CMB.1.raw
  modified_base (273)..(273): a, c, t, g, unknown or other
  misc_feature (273)..(273): n is a, c, g, or t
  modified_base (394)..(394): a, c, t, g, unknown or other
  misc_feature (394)..(394): n is a, c, g, or t
  modified_base (436)..(436): a, c, t, g, unknown or other
  misc_feature (436)..(436): n is a, c, g, or t
  modified_base (447)..(447): a, c, t, g, unknown or other
  misc_feature (447)..(447): n is a, c, g, or t
tcagtcgcactagtcacgaccggtgctcgatttagtacagatcgttagggaaagggggagtcagtctcagtcaggacacagcatggacatgaggtccccgctcagctcctgggctcctgctactctggctccgaggtgccagatgtgactatccagatgtaatgcagtctccatcctccctgtctgcatctgtcggggacagagtcaccatcacttgccggccagtcagaccattacctctatttaagtgtatcagcaagaaacaggaaaacncccctaaatcctgatctatgctgcgtcctacgtttgacaagagtcgggtcccagtacgtaaaggttcaggtcgacgtagtgggaatagtgggaactagtattcgactctacacctatcacngtctacgacaacgtgactagtatttacgactaacttaacctnttaatactaanaagtagttaacgagtagtacgtaggtaacgtactacggtttacgaccggtaagggtaacccgaagacgttaggacgaacgtacgacgtaacgaactaggtcgcgtcgaacccg

SEQ ID NO: 109122 - DNA, 574 bp, Homo sapiens
  misc_feature: GYAE6OF01E2KDS.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatcgtggtcggggacagagtcaccatcacttgccgggcagtcagacctattacctccttaatttaagttggtatcagcaagaaaaccaggaaaacgccccctaaactcctagatctatgctgcgtccactttgacaagagtcgggtacccatcaagttcagtgctagtgatagtgggacagtatttcactctcaccatcacgtaggtctcgactaacgtgagttgtattttcgacttaaacgtttactaacgttgtaactaacgtaaggtaacgttaacaaggtacgtacgtaggtaaacgggttaccttacggttttcggaccggtaaaggggacccgtaaaggtcgtagggatagtacgaagtacgtaacgtggtcgcgtcgaccc

SEQ ID NO: 109123 - DNA, 534 bp, Homo sapiens
  misc_feature: GYAE6OF01CQAPG.39.24.C02.1.454.CMB.1.raw
  modified_base (415)..(415): a, c, t, g, unknown or other
  misc_feature (415)..(415): n is a, c, g, or t
tcagtcgcactagtcacgaccggtgctcgatttagtacagatcgttagggaaagggtgagtcagtctcagtcaggacacagcatggacatgaggtccccgctcagctcctggggctcctgctactctggctccgaggtgccagatgtgacatccagatgatgcagtctccatcctccctgtctgcatctgtcgggacagagtcaccatcacttgccgggccagtcagaccattacctcctatttaagttggtattcagtcagaaaccaggaaaagcccctaaactcctgatctatgctgcgtccactttgcaagactgggtcccatcaaggttcagtgctagtggatatgggacaggatttcactctcaccatcacaggtctgcaacgtgattgattttgactaacttactactntacaacagtagttacgagtaagctcggaagggttacctacgttttggacccgaagggggtaacccaaggtctgggaaagagttaccaagggaacccgaaacttggtaggcgttaaccgg

SEQ ID NO: 109124 - DNA, 516 bp, Homo sapiens
  misc_feature: GYAE6OF01BG0OJ.39.24.C02.1.454.CMB.1.raw
  modified_base (275)..(275): a, c, t, g, unknown or other
  misc_feature (275)..(275): n is a, c, g, or t
  modified_base (318)..(318): a, c, t, g, unknown or other
  misc_feature (318)..(318): n is a, c, g, or t
tcagtcgcactagtcacgaccggtgctcgatttagtacagatcgttagggaaagggggagtcagtctcagtcaggacacagcatggacatgagggtcccccgctcagctcctggggctcctgctactctggctccgaggtgccagatgtgacatccagatgatgcagtctccatcctccctgtctgcatctgtcggggacagagtcaccatcacttgccggccagtcagaccattacctctatttaagttgtatcagcaagaaaccaggaaaacnccccctaaactcctagatctatgctgcgtccactttgacaagngtcgggtcccatcaaggttcagtgctagtgatagtgggacagtatttcactctcaccatacacagtctgacaacgtgatgtatttgactaacttactactgtacaactagtagttacgagagtacgtaggaggtactacgtttaggccgtaacgggaccgaagtgtaggagatacgagacgtacgtgtggcgtcgtac

SEQ ID NO: 109125 - DNA, 649 bp, Homo sapiens
  misc_feature: GYAE6OF01DJEUL.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctcgaggtgccagatgtgacatccagatgatgcagtctccatcctcctgtctgtcatcgtggtcggggacaggacgtcacctatctacgttcggccgggcaggtccaagaccctacttaccctactttaagtttacgttggtatacagacaacgaaaccaaggaaaacctacccctaaactccgtagactactatgctgtccgttactacgtttcgacgtaagtcgggtccgggttaccagttacgtaaggtcaggtcgtagtaggtaggtataagtacgggacttagtacttacgtactactaccacattaccacgtcgtctacgactaacgtagtacgtattactttacgactttaacttacgtactactaacaacgtaagtacgttaacgagtacgtacgttaaggtacggtaccgtttcgttaaccgggaccgaaggggttaacccctagggtctacggggtactacggaaccgtaacgggtaactacggttagggccggttccgcggtaaaccc

SEQ ID NO: 109126 - DNA, 531 bp, Homo sapiens
  misc_feature: GYAE6OF01EANVV.39.24.C02.1.454.CMB.1.raw
  modified_base (399)..(399): a, c, t, g, unknown or other
  misc_feature (399)..(399): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggcagtcagaccattacctcctatttaagttggtatcagcagaaaccaaggaaaacgcccctaaactcctagatctatgctgctcctactttgacaagagtcgggtcccatcaaggttcagtgctagtggatagtgggacagtatttcacttctcaccatcacgtggtctagacaacgtnatgtatttgactaacttactactgtacaactagtagttacagtacgcgtaggaacggttactagtttcggaccgaagggacctaaggtcgtaggacgactacgaaggtaacgacgtggtacgcgtgtacccg

SEQ ID NO: 109127 - DNA, 903 bp, Homo sapiens
  misc_feature: GYAE6OF01D5QEH.39.24.C02.1.454.CMB.1.raw
tcagtcgcactagtcacgaccggtgctcgatttagtacagatcgttagggaaagggggagtcagtctcagtcaggacacagcatggacatggagggtccccgtctcagctccgtgggctcctgctactctggctccgaggtcgccagtagtgtcgacctacgtccgagatgatcgcagtcctcctactcctccctgtctgctagtcgtggcggggacaggacgtaccacctagtcacgttcggccgggctacgtccacgacctacttacctcctttaagtttacgttggtactcacgacaacgaaaccgtaacggaaaaccgtacccttaaaccgtcgtacggacttacgttacgtcggtaccgtacggtaccgtaccgttacgtttacggaacgtaacgggttacggttacccgggggtacctaacggtaacgttaacgggtttacgtacggttacggtacggttaagggtaaccggttaacgttaacggtaacgggtaacgtttaacgtttaacgttttaccgaaccgttacctaacccgtaaccgttaaccttaaccgttaaacggttaccgggttaccgtaacggtaaccgtaacggttaaccgggttaacgtttaaccggtttaacgttttaacccgttaaccctttaaacccgttttaacggtttaaccgttaaccgtaaccggtaaacgtttaacgggtaaccggttaaccgaacgggttaaccggtaacggttaacgggttaacccgggttaacgttttacccgggtttacgggaaacccgggtaaccggggtaacccgtaacgggttacggtaacgggtaacggtaaccggtaacgtaaccggtaaaccgggtttaacgggtagggttaccgggtaccgttccgggtaaacccg

SEQ ID NO: 109128 - DNA, 596 bp, Homo sapiens
  misc_feature: GYAE6OF01APCT9.39.24.C02.1.454.CMB.1.raw
  modified_base (102)..(102): a, c, t, g, unknown or other
  misc_feature (102)..(102): n is a, c, g, or t
tcagtcgcactagtcacgaccggtgctcgatttagtacagatcgttagggaaagggggagtcagtctcagtcaggacacagcatggacatgagggtccccgntcagctccgtggggctcctgctactctggctccgaggtgccagatgtgacatccagatgatgcagtctccatccctccctgtctgctatctggtcggggacagagtcaccatcacgttgccggcagtcagacctattacctctatttaagtgtatcagcaagaaaccaggaaaacgcccctaaactcctagactctatcgctgcctcctattgacaagcgtcgggtacccagtacgtaaggttcaggtcgtacgtaggtggaagttaggtacgggaactaggttactttcgaacctctacacctatcacgtacgtctacgacgtaacgtgtagttgttatttcgacttaacttactactagtacaacgtagtacgtagtagacgtacgtaaggtacgttacctacggtttacggaccggtaacggggacctaaggtaggtagggacgtacgtacgaacgggtaacgtaacggtaggtacggtacgtcggtaccc

SEQ ID NO: 109129 - DNA, 541 bp, Homo sapiens
  misc_feature: GYAE6OF01EDN0T.39.24.C02.1.454.CMB.1.raw
  modified_base (103)..(103): a, c, t, g, unknown or other
  misc_feature (103)..(103): n is a, c, g, or t
  modified_base (369)..(369): a, c, t, g, unknown or other
  misc_feature (369)..(369): n is a, c, g, or t
  modified_base (391)..(391): a, c, t, g, unknown or other
  misc_feature (391)..(391): n is a, c, g, or t
  modified_base (410)..(410): a, c, t, g, unknown or other
  misc_feature (410)..(410): n is a, c, g, or t
tcagtcgcactagtcacgaccggtgctcgatttagtacagatcgttagggaaagggggagtcagtctcagtcaggacacagcatggacatgagggtcccccgntcagctcctggggcctcctgctactctggctccgaggtgccagatgtgacatccagatgatgcagtctccatcctccctgtctgcatctggtcggggacagagtcaccatcacgttcgccggcagtcagaccattacctcttatttaacgttggtatcagcaacgaaaccaggaaacgacccctaactcctgatctatgactcgcgtctactttgacaagtagtcgggtccagtactaaggttcagtgcgtagtggtatagtgganagtatttcactctaccacctancacgtagtctgactagtanatagtatttgactaacttctactgtacaatgtaactacgtagagtacgtagaggttactacggttcggaccgtaacggggtacacgtagaggtacgacgtagaacgtaacgtacgttggcgtcgtgtaacc

SEQ ID NO: 109130 - DNA, 781 bp, Homo sapiens
  misc_feature: GYAE6OF01BR43P.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctggtacgggacagacgtccacctatcacgttcgccggccagtcagacctattacctaccttatttaagttggtatcagacaaacgaaaaccgaacggaaaacgtaccccctaaaactccgtagtactctatgctgtccgtcctactttgactaaggtacgtcgggtacccagtacgtaacgttcgaacgtgtacgtaggtaggtaagtacggtagggaactaaggttacctttactaacccgttcctaccctaaccctaacgttacccgtaacccggttaacgggttcctaacgggtaaccgtttaaaccgggttagttaacgttttacggtttaagtttttaacccggtaaaccctttaaaccgttttaacccgttacgttaacggttaaacctaaaacggtaacggttaaacgttaaccgaaagggtcgttaaacggttaacgggtaaacgggtttaccgttaacggtttacggggaaaaccccggtaaggggtaaaccccgtaaggggttacccgaaagggtacgttaaacgtacccggaaaagttacccgggtaaacgttggggttaccaccggttccggtaaacccg

SEQ ID NO: 109131 - DNA, 814 bp, Homo sapiens
  misc_feature: GYAE6OF01ALVBJ.39.24.C02.1.454.CMB.1.raw
tcagtcgcactagtcacgaccggtgctcgatttagtacagatcgttaggggaaaggggggagtcagtctcagtcaggacacagcatggacatggagggtccccgctcagctccgtgggggctcctgctactctggctccgaggtgccagattgtgacatccagatgatgctacgtctcctacttccctcccttgtctgctacgtcgtagggtaccggggacaggtacgtaccaacctagtcctacggttcgggcccggggtacctaacggtaccgaacgtaaccctaacttttaaccccttacctttaaggttttaacggttacggtaacttacgaacggaactaaaaccggaaaaaccgaaaccgggaaaacctacccccttaaaatcccgtagtactactacgtcgtcgttacgtacctcgttaacgttagaacgtaaggtaccggttccgggtacccttaaggtaccggttaacgggttactagggttaccggtacggttaacgggtaggttaaacggttacgggtaacggtaacgtttaacgttacctttacctaaccttaccctaacctaacctacgttaccgtaaccgttacgtaccgtacgaccggtaagttcggtaagttacgtttaacttaccgtacttaaccgttactaacgtacgtaacgtaacgttaagtacggttaacgtaggtaacggttacggtaacgggttaaccgttacggttacgggtacggaccgggtaaggaaccggtacggtaggtacgacgtacgtaaggaacggtacgtacgtaggtacgtcgtcgtaccg

SEQ ID NO: 109132 - DNA, 714 bp, Homo sapiens
  misc_feature: GYAE6OF01BILCJ.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatcgtgtcgggacagagtcacatcacgttgccggcagtcagacctattacctcctaatttaagttggtatacagtacaacgaaaaccaaggaaaacgacccctaaaactcctagtaacttactatgtctcgtcgtacctactttcgactaagtagtcggggtacccaagtacgtaaggtttacgaagtacggtacttagggtaggtaagttaacgtagggaacgtaaggttaactttacctaaccttacttacccgtaacctaactacctaacggtaacggttaccgtaacggacgtaaacgtcgttaaattagtttacgttttaggtaaccttaaactttaaccttaacgttacgtaacgtaaccgtaaggtaacgttaacgtaagtaacggtacgttaacggtaaacgggttaaccgttacggttttacggaccggtaaacgggtaaaccggtaacggtaccgttagggtaacgaacgtaaccgaaacgaaccggtaacggttacggtacggtacgtcgtaacccg

SEQ ID NO: 109133 - DNA, 623 bp, Homo sapiens
  misc_feature: GYAE6OF01D5A0K.39.24.C02.1.454.CMB.1.raw
  modified_base (104)..(104): a, c, t, g, unknown or other
  misc_feature (104)..(104): n is a, c, g, or t
  modified_base (143)..(143): a, c, t, g, unknown or other
  misc_feature (143)..(143): n is a, c, g, or t
  modified_base (148)..(148): a, c, t, g, unknown or other
  misc_feature (148)..(148): n is a, c, g, or t
  modified_base (191)..(191): a, c, t, g, unknown or other
  misc_feature (191)..(191): n is a, c, g, or t
  modified_base (283)..(283): a, c, t, g, unknown or other
  misc_feature (283)..(283): n is a, c, g, or t
  modified_base (376)..(376): a, c, t, g, unknown or other
  misc_feature (376)..(376): n is a, c, g, or t
  modified_base (597)..(597): a, c, t, g, unknown or other
  misc_feature (597)..(597): n is a, c, g, or t
tcagtcgcactagtcacgaccggtgctcgatttagtacagatcgttagggaaagggggagtcagtctcagtcaggacacagcatggacatgacgggtcccccgntcagctccgtggggctcctgctactctggctccgaggtnccagntgtgacatccagtatgatgcagtctccatcctcctgtctgacntcgtggtcgggacaggacgtccaccattccacgttcggcccgggaccaggtcacgacctattaccctactttaagtttaggttgtactcganacaagaaaccaaggaaaactcccccttaaactcctagatactagtcgctcgtctcctattgactaagtacggtcgggtaccctatacgagttnagttagcgtagtaggtatagtagggaactagttacttccgtaacttcctacccgtaacctactaccgtacgtaggttacctacggaactacggttaacggtattacggtttaacttttacgaaccttaactttacgtacgtacgtaacaacggtattacgtaccgagtacgagtaaggacgttacctaggttccgacggtaacggtcagtagaggtacganacgaaggtactgtacgtgcgtgtacc

SEQ ID NO: 109134 - DNA, 640 bp, Homo sapiens
  misc_feature: GYAE6OF01ESBJX.39.24.C02.1.454.CMB.1.raw
  modified_base (316)..(316): a, c, t, g, unknown or other
  misc_feature (316)..(316): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatccctccctgtctgctatctggtcggggacaggacgtcaccatcacgttcggcccgggcagtcacgacctacttacctaccttatttaagttggtatcagacaagaaaccaacggaaaacgacccctaaactcctagactctancgtctcgcctcctactttgacgtaagtacggtcgggtacccagtacgtaaggttcaggtcgtagtaggtagagttagtagggactagtacttactacctactcaaccactacgacgtacggtctacgaccgtaacgtgtattagttactttagaccttaacttaccttactacgtaaccaaacgtagtacgtaacgtagacgtacgtaacgggtaacggttacgttacggtttacggaaccgggtaagggtaacccgtaaggtcggtacgggaagacgtaaccgaacggtaaccggtaacgtcggtacggtccgtcgtaacccg

SEQ ID NO: 109135 - DNA, 638 bp, Homo sapiens
  misc_feature: GYAE6OF01A7L6G.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccactccctccctgtctgcatcgtggtcggggacagagtccaccatcacgttcggcccggccagtcacgacctacttacctaccttagtttagttggtactcgagacaacgaaaccgaacggaaacgacccctaaactcctgtactctatgctcgtccgtacctacgtttcgacgaaggtacgtcgggtaccctacgtacgtaacggttcacgtacgtacgtaggtaggtatacggtagggtaacgtacgttacttactacctctacctaccacgtacgacgtacgtcgtagacgtaacgtagtagttagttattacgtacttaacgttactacgtacgtacaacgtaagttacgtacagtagtacgtagtaaccggttacttacgggttacgaccgggacggtaaccgtaggtaccggtaggaagtacgtacggaaacgtacggaacggtaggcggtcgtgtaacccg

SEQ ID NO: 109136 - DNA, 712 bp, Homo sapiens
  misc_feature: GYAE6OF01A4LFF.39.24.C02.1.454.CMB.1.raw
  modified_base (547)..(547): a, c, t, g, unknown or other
  misc_feature (547)..(547): n is a, c, g, or t
  modified_base (682)..(682): a, c, t, g, unknown or other
  misc_feature (682)..(682): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatccctcctgtctgctatcgtggtcggggacagacgtccaccatccgtacgttcggcccgggacctagtccgagaccctaatttacccttaccttaagttttaaaggttcgggtaacttacgaacggacctaaaacggaaaaccgtaaacgggaaaaacccgtacccccttaaaaccttccgtagtaacttacgtaatcgtaccgtcgtacccgttaccttaacgtttcgaacgtaaacggtacggttaccggggtaccctaacggtaccgttaaaggttccgaaggttcgtacgttaaggtgtaacggtaagtacggggaactagttacttcgtactctacaccgtactacgaacgtggtacctcgacgtaagtntacgttagttacgtttactactaactttactaacgtcgtaactaaacgtagtaacgtacgtaaggaagtaccgtaagggttaacgtaccgttacggttacggacggtaagggacgtaacggtcggaaggagacgngtaacgacgtagtggtcgtacgtcgtaacc

SEQ ID NO: 109137 - DNA, 653 bp, Homo sapiens
  misc_feature: GYAE6OF01DMGND.39.24.C02.1.454.CMB.1.raw
  modified_base (277)..(277): a, c, t, g, unknown or other
  misc_feature (277)..(277): n is a, c, g, or t
tcagtcgcactagtcacgaccggtgctcgatttagtacagatcgttagggaaagggggagtcagtctcagtcaggacacagcatggacatgagggtccccgctcagctccgtggggctcctgctactctggctccgaggtgccagatgtgacatccagatgatgcagtctccatcctccctgtctgcatctggtcgggacagacgtcacatcacgtcgccggcagtcacgaccattacctcttaatttaagtgtatcagacaagaaaccaagaaacncccctaaatctagatacgtatgctcgcgtactacgtttacgacgagtacggtcgggtaccctagtacgtaaggttcaggtcgtacgttaaggtaggtaataggtacgggtaactacggttaactttcccaacgtttcctaaccgaacctacttaccgacgtaaggtcctacgaacttaacggtgtacgttagttactttacgaccttaaacgtttactaacgtcgtaacgaaacgtagttaaacgtacgagtacgtacgttaagggtaacgttccgttaacggtttccgggaacccggtaagggtaaccgtaacggtacggtaaggtaacgaaccgttaggaacgtacgtaacgtgggtcctaacggtctaacccg

SEQ ID NO: 109138 - DNA, 687 bp, Homo sapiens
  misc_feature: GYAE6OF01CQD40.39.24.C02.1.454.CMB.1.raw
  modified_base (272)..(272): a, c, t, g, unknown or other
  misc_feature (272)..(272): n is a, c, g, or t
tcagtcgcactagtcacgaccggtgctcgatttagtacagatcgttagggaaagggggagtcagtctcagtcaggacacagcatggacatggacgggtcccccgctcagctccgtggggctcctgctactctggctccgaggtgccagatgtgacatccagatgatgcagtctccactccctccctgtctgctactcgtcggtcgggactaggacgtcacctatctacgtcggccggcagtcagacctattccttctaatttagtgtatcanacaagaaaccgaagaaaccgtaccccaaactcgtacgatctatcgcgtcgtacctcctacttgaacgtagtacggtcgggtaccctaagtacgtaacggtcagtcgacgtaggtacgtagtacggacggtacgtaagttactttcgaaccttcccgtactaacccgtactaacgtacggtaaccggtcttaccggtaacgtaaacggttcgttaattacgggtttaatttaccgaaccttaaactttcctacttacgggtaaactaacgtaggttaacttaaacggtagttaaggtaccgttaagggtacggtttaccgtaaccggtttcggaaaccgggaccggggtaacgtaacggtcggaaggtaagtacgtaacaccggtacgaaacgttggtacggtcccgtgtaacccg

SEQ ID NO: 109139 - DNA, 637 bp, Homo sapiens
  misc_feature: GYAE6OF01BPPZR.39.24.C02.1.454.CMB.1.raw
  modified_base (446)..(446): a, c, t, g, unknown or other
  misc_feature (446)..(446): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatccctcctgtctgcatctgtcggggacagagtcaccatcacttcggcccgggccagtccagacctacttacctcctaatttaagttggtatcagacagaaaccgaggaaaccacccctaactccagtatctatcgctgcctcctactttcgataaggtagtcggggtacccagtacgtaagttcgagttcgacgttagtacggtataggtagggtactaaggttactttcgacctcgtcctaaccactacacgtacgttcacggtactaaggtntagttcgtttaagtttctaaccgttaactttaccgtactacgtacaaacgtagtacgttaacgaagtacgtacgttaaggtaacggtttaacgttacggtttaccgggaaccggaaccgggtaaccgtaacggtcgtaacgggtaacgacgtacggaaggtaaccaagggttgtacggtcgtcggtacccg

SEQ ID NO: 109140 - DNA, 689 bp, Homo sapiens
  misc_feature: GYAE6OF01EW3FE.39.24.C02.1.454.CMB.1.raw
  modified_base (499)..(499): a, c, t, g, unknown or other
  misc_feature (499)..(499): n is a, c, g, or t
  modified_base (518)..(518): a, c, t, g, unknown or other
  misc_feature (518)..(518): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtcgccagatgtgacatccagatggatgcagtctccatcctccctgtcctgctatcgtcggtcggggacagtacgtcacctaatctacgttcggcccgggacacgtcgaactaacctatttaaccctccttaagttttaaaggttcggtaatccgaacgacgaaaacggaaaacctaaacggggaaaaacctaacccccctttaaaaacgtccgtaagtaacttaccgtaattcggactcgtaccgttacccttaagttttagaccgtaaagcggttaaccggggtacctaagtacgtaaggtttcaaggtccggtattagtaggtataaggttagggaacagttacttcactctacactancataggtctagacacgttnagtcgtaagtttgactaacgtttaactctagtaacctaacgtaagttacgtaacaacgtacgtaagttacgggtaaacggttctaaccggtttaggaacccggtaacgggacgtaacggacgttacggaaacacgttagaacgtaacttacggagtacgccgtagtaaccc

SEQ ID NO: 109141 - DNA, 696 bp, Homo sapiens
  misc_feature: GYAE6OF01D06Q4.39.24.C02.1.454.CMB.1.raw
  modified_base (102)..(102): a, c, t, g, unknown or other
  misc_feature (102)..(102): n is a, c, g, or t
tcagtcgcactagtcacgaccggtgctcgatttagtacagatcgttagggaaagggggagtcagtctcagtcaggacacagcatggacatgagggtccccgntcagctccgtggggctcctgctactctggctccgaggtgccagatgtgacatccagatgatgcagtctccatccctcctgtctgcatcgtggtcggggacaggagtccaacctatcacgttcggcccgggtccagtacacgtaccctaattaccctccttaattttaaggttggtactctagacaaagaaaaccgaaggaaaaccgtccccctaaaatccgtagacttctagtcgctcgtccgtacctacgtttgacgaaggtagtcgggtaccaagtacgtaaggtctagtgacgtaagtaggtacttagtacgggactaaggttactttcaacgtctactaccattaccgacgtaggtactgacctaaacggttgagttagttacttttacgaaccttaactttacttaacgttacgtaacgtaacgttaacggtaacgttaacgaggtaacgtacgttaacgggtaacgttaacggttaccggtttacgggaacccggtaacggggtacccgtaagggtacgtaaggggtacgaaacgttaccggaaacggtaaccggttaacgttacggtcggtaccgtcggtaaccccg

SEQ ID NO: 109142 - DNA, 730 bp, Homo sapiens
  misc_feature: GYAE6OF01D99UZ.39.24.C02.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (229)..(229): a, c, t, g, unknown or other
  misc_feature (229)..(229): n is a, c, g, or t
  modified_base (513)..(513): a, c, t, g, unknown or other
  misc_feature (513)..(513): n is a, c, g, or t
  modified_base (589)..(589): a, c, t, g, unknown or other
  misc_feature (589)..(589): n is a, c, g, or t
  modified_base (687)..(687): a, c, t, g, unknown or other
  misc_feature (687)..(687): n is a, c, g, or t
  modified_base (712)..(712): a, c, t, g, unknown or other
  misc_feature (712)..(712): n is a, c, g, or t
  modified_base (720)..(720): a, c, t, g, unknown or other
  misc_feature (720)..(720): n is a, c, g, or t
tcagtcgcactagtcacgaccggtgctcgatttagtacagatcgttaggggaaaggggggagtcagtctcagtcaggacacagcatggacatgagggtcccccgctcagctccgtggggcctcctgctactctggctcggaggtcgccagatggtacgacatccaagtatgatgctagtcctccactccctcctgtcngctactcgnggtacgggactagactacaacntactacgtcggccgcagtcacacctacttaccttacttaagtttagttggtactacgacgtaacgaaacgaaaccgtaacggaaaccctaaccccttaaacgtccgtaagtaccttactagtcgtaccgttaccgtacccgttaccttacggttaacgaacgtaacgggttaccgggttacccgggtaccttaacggtaacggttacggtacgtacggtagttacggtaggtacgtagttaggacggtaattactacttcgacttacctacactaactaccggntaggtaccttacggaccttagggtattacgttgtttaacgttacctaaccttaaccgttaacgttactccgtaaanagttaacgaacgtcgttaagacggttaacggttacggtaccggtttaccgtaggttacccggggaaaggttccggtaacgcggttagacggggtaacncttaaggacggttaggaacgggttnaccggttnaacccggtac

SEQ ID NO: 109143 - DNA, 616 bp, Homo sapiens
  misc_feature: GYAE6OF01CRCRX.39.24.C02.1.454.CMB.1.raw
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
  modified_base (566)..(566): a, c, t, g, unknown or other
  misc_feature (566)..(566): n is a, c, g, or t
tcagtcgcactagtcacgaccggtgctcgatttagtacagatcgttagggaaagggggagtcagtctcagtcaggacacagcatggacatgagggtcccccgctcagctccgtggggctcctgctactctggctccgaggtgccagatgtgacatccagatgatgcagtctccatccctccctgtctgcatcgtggtcgggacagactcaccatcacgttcgccggccagtcacgacctattaccgtcctaatttaagttgtatcagacaacgaaaccaaggaaaaccgtccccctaaactcctagtattactatcgctcgtcctacctactttgactaagtacgtacgggtccctagtacgaaggttcagtcgagttaggtgagttaagngggactagtntttaccactctactaccgataccgagtacgtctagacctaagtgtatacgttattacgtacttaactttaccgtacgttacgtacaacgtaggtaacgttacgagtagtacgtaggtacggtacgttacggtttcgggaccgtacggaacgtacggtgtaagggngttaaccgtacgaggtaacccgttagtacgggtacgtccgtacgtacccg

SEQ ID NO: 109144 - DNA, 685 bp, Homo sapiens
  misc_feature: GYAE6OF01CQ9CL.39.24.C02.1.454.CMB.1.raw
  modified_base (212)..(212): a, c, t, g, unknown or other
  misc_feature (212)..(212): n is a, c, g, or t
  modified_base (534)..(534): a, c, t, g, unknown or other
  misc_feature (534)..(534): n is a, c, g, or t
tcagtcgcactagtcacgaccggtgctcgatttagtacagatcgttagggaaagggggagtcagtctcagtcaggacacagcatggacatgagggtccccgctcagctccgtgggcctcctgctactctggctccggaggtcgccagatgtgacatccagatgatgcagtctcctactccctccgtgtcctgctacgtcgtgggtcgggaanagacgtccaacctagtcctacgtcggcccgggactacgtacacgtacctactttaccctaccttaagttttaacggtgtactaaccgagtaaccaacggaaaaccgaacggtaaacccgtacccccgtaaaactccgtagaacttcctagtacgtccgtcgtaccttccgtaacgttgacgaaggtcggtaccggtacagtacgtagtcagtcgagtaggtacgtagtagtacggatacgttcttacacttcctacacctataccgtacgtacggtctaacgactaacggtattctagttacttagtaacccttaatttacncgttaactaacgaaagttacggtaacgttaacgagtaacggtacgtaagggttaccgttaacggttaccggtacgggacgtaacgggaacgtacggacggtaggtaactacgtaacgtaaggacgttaaccggtggaccgtgaccgtaccc

SEQ ID NO: 109145 - DNA, 675 bp, Homo sapiens
  misc_feature: GYAE6OF01ATSD8.39.24.C02.1.454.CMB.1.raw
  modified_base (102)..(102): a, c, t, g, unknown or other
  misc_feature (102)..(102): n is a, c, g, or t
  modified_base (171)..(171): a, c, t, g, unknown or other
  misc_feature (171)..(171): n is a, c, g, or t
  modified_base (182)..(182): a, c, t, g, unknown or other
  misc_feature (182)..(182): n is a, c, g, or t
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (556)..(556): a, c, t, g, unknown or other
  misc_feature (556)..(556): n is a, c, g, or t
  modified_base (574)..(574): a, c, t, g, unknown or other
  misc_feature (574)..(574): n is a, c, g, or t
tcagtcgcactagtcacgaccggtgctcgatttagtacagatcgttagggaaagggggagtcgagtctcagtcaggacacagcatggacatgaggtccccgntcagctcctgggctcctgctactctggctccgagtcgccagatgtgacactccgagatgactgcagtcnccatccctccngtctacgctagtcgtcgtcggggacngacgtcacctatacncgtcggccgggcaggtcacgacctacttaccgttaccttaagtttacgttacggtactcgaacgtacgaacgaaaaccgtaacggtaaaacccgtaccccgttaaacccgtcctaggtacttacgtactacggtaccgtcgtaaccggttcctagttaccggactaagtacggttacgggaccctagtcgttaaacgtccaagtgcgtaggtacgtaagtccggagggtactaagggtacttacctacgtacgtactaccgtaactgtaaccgtggtacctaggaccgtaagtgtagtacgttcgttacgttaaccagttaccgtatcctaanacgtaaggtacctaaagntacggtacttaaggaacgttcggttacgtcgacgtaacgggtaccaggtacctaggcgaacgtcgaaactaacgggtagttcggtacgcgtaaggtacccg

SEQ ID NO: 109146 - DNA, 725 bp, Homo sapiens
  misc_feature: GYAE6OF01BPQGK.39.24.C02.1.454.CMB.1.raw
  modified_base (312)..(312): a, c, t, g, unknown or other
  misc_feature (312)..(312): n is a, c, g, or t
tcagtcgcactagtcacgaccggtgctcgatttagtacagatcgttagggaaagggggagtcagtctcagtcaggacacagcatggacatgagggtccccgctcagcctccgtggggctcctgctactctggctccggaggtcgccagatgtgacatccagatgatgcagtctccactccctccttgtctgctatcgtggtcggggacaggatccaaccatacctacgttcggcccgggacctaggccaaggtacctactttacctaccttaagttttaagtggtatcagacaacgaaaccagggtaaaacnccccttaaaactccgtagacttactatcgctacggtcctaccgtacttcgactaaggtacggtcgggtaccctagtacgttaacgggttctaggttcgtacgttaggtagggtaataggtacgggaacttagtacttttaccacgttacccttccaacctacgtaccaacggtacggtactacgaacttaacggtagtattacggtttattacggtaacttaactttacttaccgtacgtaacctaaagtacggttaagttacgaacggtacgtagtttaacgggacgggtttaaccgttacggggttttacgggaaaccggaaccgggtaaccgacgggttacggaccgggtaagtaaccgtaccgtaaggtaaccgttaggttaccgggtttcgaccgttccgggtaaccc

SEQ ID NO: 109147 - DNA, 837 bp, Homo sapiens
  misc_feature: GYAE6OF01DS87N.39.24.C02.1.454.CMB.1.raw
  modified_base (102)..(102): a, c, t, g, unknown or other
  misc_feature (102)..(102): n is a, c, g, or t
tcagtcgcactagtcacgaccggtgctcgatttagtacagatcgttagggaaagggggagtcagtctcagtcaggacacagcatggacatgagggtccccgntcagctccgtggggctcctgctactctggcctccggaggtcgccagatgtagacactccaagtatgatggctacgtcctccctacgttccccttccgttcgtcctcgtctacgttccggttcgggtaccggggaactacggtactaaccgacctaacgttccgtaccggttccgggccccgggtactaacgtacgtaacctaaccttaacctttaaccctttaaccgttttaagttttaacggttagttaaccgtaccgtaagtaaccaaaacgggtaaaacccgaaacggtaaaaccccgtaacccccttaaacgttacccgtagtacttaccgttaacgtcggtccgttccggtacccttaaccgttacgttacgacggttaacgggtacggttacccggtaccttaaggtaccggttaacggttacgtacgttacggtacggttaacgggtagtaaggttacgggaacgggtaactttaaccggtttcctttacccgtaccttccgtaacctaccgtacttaaccggtacgtacgttacgtacgaacgtacgtgttactagtttacttacgtacttaacttacgtactaccgtacgtaagtacgtaacgtacgtacgtacgtaggttaacgtaagtccggtttaaccggttacggacccgggtaagtaccggtacggtacggtagtaaccgtcgaacgacggttacgtaggtcggtacgtcgaccgtaaccg

SEQ ID NO: 109148 - DNA, 874 bp, Homo sapiens
  misc_feature: GYAE6OF01CDFE3.39.24.C02.1.454.CMB.1.raw
  modified_base (140)..(140): a, c, t, g, unknown or other
  misc_feature (140)..(140): n is a, c, g, or t
tcagtcgcactagtcacgaccggtgctcgatttagtacagatcgttagggaaagggggagtcagtctcagtcaggacacagcatggacatgagggtccccgctcagctccgtgggctcctgctactctggctccgaggtnccagatgtgacatccaggatgatcggctacgtcctaccactcccttcccgtcgttctacgtctacgttcggttacggggtaccggggaacgtaacggtaccgttacctaacccgtacttaccgtaccgtttccgggaccccgggggtacctaacggtacccgaaacgtaccccgttaaccgttttaaccctttaccgttttaaacggtttttaaggtttacggttaacgtaccgtaacggtaaccgaaaacccggtaaaaacccggtaaaccgggaaaaccccgttaaccccccgttaaacgtttcccgtagtaacgttaccgtagtaccgttacgtaccgttacccgttacgttacgtttaacgacgtaaacggtacggttaccgggtaccctaacgttaacgtaacgggttcctaggtacgttacggtacggtaaggtagttaacgggtacgggtacgttaacggttacctttacccgtacttcccgtaaccacgtacgtccgtaacgtacggttcgtaacgtacgtaacgtgtaacgttagttaacgtttacgtaccttaacctttacgtacctaacgtaacgtaacgaacggtaacgttaccgtaagtaccggtagtttaacgggtcttaacggtacggttccggggaaccgtaaccgggtactaccggtacggttaaggcgttaaaccggtacgacggttactacgggtacggtctaccgtggtaaccc

SEQ ID NO: 109149 - DNA, 792 bp, Homo sapiens
  misc_feature: GYAE6OF01CK7LE.39.24.C02.1.454.CMB.1.raw
  modified_base (102)..(102): a, c, t, g, unknown or other
  misc_feature (102)..(102): n is a, c, g, or t
  modified_base (143)..(143): a, c, t, g, unknown or other
  misc_feature (143)..(143): n is a, c, g, or t
  modified_base (169)..(169): a, c, t, g, unknown or other
  misc_feature (169)..(169): n is a, c, g, or t
  modified_base (782)..(782): a, c, t, g, unknown or other
  misc_feature (782)..(782): n is a, c, g, or t
tcagtcgcactagtcacgaccggtgctcgatttagtacagatcgttagggaaagggggagtcagtctcagtcaggacacagcatggacatgagggtcccccnctcagctccgtggggctcctgctactctggcctcggaggtnccagatgtgacatccagatgatgacngtcctccacttcctcccgtgtctgacctagttcgtagggtaccgggactacgtacgtaccctaaccctattccgtaccggttcggggacccgggacctaaggtccaacgtacctactttacccttaacctttagtttaaacggttgtactactaagaaccgaaacggtaaaacccgaaacggtaaaacccgtaaccccctaaacgtcccgtagtacgttacttacgtcgtcgtaccggttaccgttacccgtttaacgtttacgaacgtaaaggttacgggttacccgggtaccctaacgttacgggtaacgttacgtaacgggttgttaccggtaaggttacggaggttaacggacgggtaatacggtttaacttttcccacttacccttacacccttaacgtaccgtacgtacggtacccgtacggtactaaacgggtcgtaagtttcgttaacgtttacgtaaccgttacctttactaacgtactaacgtaataacggtaacgtacgtagtacgaggttacggtacgtacggttacgttccgggaaacggtagggtaaccggtcggtaggtagtaacggaacgtagaaccgtaggtaaccgtgttacggnggtcccaacg

SEQ ID NO: 109150 - DNA, 778 bp, Homo sapiens
  misc_feature: GYAE6OF01AHSSM.39.24.C02.1.454.CMB.1.raw
  modified_base (146)..(146): a, c, t, g, unknown or other
  misc_feature (146)..(146): n is a, c, g, or t
  modified_base (216)..(216): a, c, t, g, unknown or other
  misc_feature (216)..(216): n is a, c, g, or t
  modified_base (348)..(348): a, c, t, g, unknown or other
  misc_feature (348)..(348): n is a, c, g, or t
tcagtcgcactagtcacgaccggtgctcgatttagtacagatcgttagggaaagggggagtcagtctcagtcaggacacagcatggacatgagggtcccccgctacagcctccgtggggctcctgctactctggcctcggaggtcnccagatgtagactatccagatgatgctacgtctcctactcctcctgtctgacacgttcgtcggcgggacngacgtccacgatcctacgtcggcccggactacggtacacgtacctacttaccttaccttagtttaacgttgtactcacgaccgaaacgtaaaccgaacggtaaaccacccctaacgtccgtagtactacgtntcgctcggtcctaccgtacgttacgcgtaacggtcggtacggtacctacgtacgtaacggttcgtaggtacggtgtaggtagagttacgagggtactagttaccgtctaccgtcctaaccgtactactaccgtaacgtcggtaccgtcgtaaccggtaagttacgagtttacgttaccgtttacggtaacctttaacgttacgttaaccttaacgtaacccgttaaggtaccgttaaggtaaccgtacgggttaactaaccgggttaacgggttaaccgttaacccgggtttacgggttacccgggtaaaccgggttaaccggggaaaccgttaacgggtcccgggttaaaggtaacccgggttaaagtaacccggggtaacccgttaaaggtacccggtacgggttaccgtaccgtacccgggttaccc

SEQ ID NO: 109151 - DNA, 483 bp, Homo sapiens
  misc_feature: GYAE6OF02IUO5X.39.24.C02.1.454.CMB.1.raw
  modified_base (462)..(462): a, c, t, g, unknown or other
  misc_feature (462)..(462): n is a, c, g, or t
tcagtcgcactagtcacgaccggtgctcgatttagtacagatcgttagggaaaggggagtcagtctcagtcaggacacagcatggacatgagggtccccgctcagctcctgggctcctgctactctggctccgaggtgccagatgtgacatccagatgatgcagtctccatcctccctgtctgcatctgtcgggacagagtcaccatcacttgccggccagtcagaccattacctcctattaagttggtatcagcagaaaccaggaaaagccctaaaactcctgatctatgctgcgtccactttgcaagatgggtccatcaaggttcagtgctagtggatatggacagatttcactctcaccatcacaggtctgcaacgtgactgattttgacaacttactactgtcaaacagagttacagagctggaaaggtacatttggacagggtaccaaagctagganatcagtacgaactgtgctgac

SEQ ID NO: 109152 - DNA, 500 bp, Homo sapiens
  misc_feature: GYAE6OF02IXSHC.39.24.C02.1.454.CMB.1.raw
  modified_base (388)..(388): a, c, t, g, unknown or other
  misc_feature (388)..(388): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcgggacagagtcaccatcacttgccgggccagtcagaccattacctcctatttaagttggtatcagcagaaaccaggaaaagcccctaaactcctgatctatgctgcgtccactttgcaagatggggtcccatcaaggttcagtgctagtggatatggacagatttcactctcaccatcacaggtctgctaacgtnatgattttgctaacttactactgtcaacagagttacagagctagaaggtaactacgtttaggccgaggggaccaaggcctaggagatacgagacgaacgtgtggactgaccg

SEQ ID NO: 109153 - DNA, 488 bp, Homo sapiens
  misc_feature: GYAE6OF02HGMNR.39.24.C02.1.454.CMB.1.raw
  modified_base (470)..(470): a, c, t, g, unknown or other
  misc_feature (470)..(470): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggccagtcagaccattacctcctatttaagttggtatcagcagaaaccaggaaaagcccctaaactcctgatctatgctgcgtccactttgcaagatggggtcccatcaaggttcagtgctagtggatatgggacagatttcactctcaccatcacaggtctgcaacgtgatgattttgctaacttactactgtcaacagagttacagtagctgaaggtacacttttggctagggaccaagctggagatanagacgactgtggctgacc

SEQ ID NO: 109154 - DNA, 486 bp, Homo sapiens
  misc_feature: GYAE6OF02IRR6L.39.24.C02.1.454.CMB.1.raw
  modified_base (389)..(389): a, c, t, g, unknown or other
  misc_feature (389)..(389): n is a, c, g, or t
  modified_base (469)..(469): a, c, t, g, unknown or other
  misc_feature (469)..(469): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggccagtcagaccattacctcctatttaagttggtatcagcagaaaccaggaaaagcccctaaaactcctgatctatgctgcgtcactttgcaagatggggtccatcaaggttcagtgctagtggatatgggacagatttcactctcacccatcacaggtctgcaacgtnatgattttgcaacttactactgtcaacagagttacagagctagaaggtacacgttttgcagggaccaagcctggagatanagacgactgaggctgac

SEQ ID NO: 109155 - DNA, 499 bp, Homo sapiens
  misc_feature: GYAE6OF02G0D6K.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggccagtcagaccattacctcctatttaagttggtatcagcagaaaccaggaaaagcccctaaactcctgatctatgctgcgtccactttgcaagatgggtccatcaagttcagtgctagtggatatggacagatttcactctcaccatcacagtctgcaacgtgatgtattttgactaacttactactagtcaaactagaagttacagagactagaaggtactacgttttggaccgagggaccaaggcgtaggagactacagacgaatggtggctgacc

SEQ ID NO: 109156 - DNA, 507 bp, Homo sapiens
  misc_feature: GYAE6OF02FJHKD.39.24.C02.1.454.CMB.1.raw
  modified_base (275)..(275): a, c, t, g, unknown or other
  misc_feature (275)..(275): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggccagtccagaccattacctcctatttaagttggtatcagcagaaaccaggaaancccctaaactcctgatctatgctgcgtccactttgcaagatgggtcccatcaaggttcagtgctagtggatagtgggacagatttcactctcaccatcacaggtctgcaacgtgattgtatttgactaacttactactgtacaacagtagttacagagtactagaacggtactacgttttggccgtaggggacctaaggctaggagtatcgacgacgacgtgtcggctgacc

SEQ ID NO: 109157 - DNA, 554 bp, Homo sapiens
  misc_feature: GYAE6OF02H3WDR.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggcagtcagaccattacctcctatttaagttggtatcagcagaaaccaggaaaagacccctaaaactccctagatctatgctgcgttccacttttgctaagatcggggtaccatcaaggttcagtgctagtggatagtgggacagtatttcacttctcaccatcacaggtctgcaacgtgattgtattttgactaactttactactgtacaacgtagtagttacagacgtacgtaggaaaggttactacgttttacggaccgtaacggggtaccgaaggtacgtacgggaagtaacgtacgaacggtaacgaacgttggtggtccgtgtaacccg

SEQ ID NO: 109158 - DNA, 538 bp, Homo sapiens
  misc_feature: GYAE6OF02FF58A.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctcctgtctgcatctgtcggggacagagtcaccatcacttgccggcagtcagaccattacctcctatttaagttggtatcagcagaaaccaggaaaacgcccctaaactcctagactctatgactgcgtccactttgacaagtacgtgggtcccatcgaaggtttcagtcgactagtggatagtgggacagtatttcactctacacatcacagtctgacacgtgattgtatttgactaacttactactctacaacagtagttacagtagtacgtagtaaggtacgtacgttttcggaccgtacgggacgaacggacgtacggagtagtaccgtacgacgtaacgtggtacggacgtgtaacccg

SEQ ID NO: 109159 - DNA, 498 bp, Homo sapiens
  misc_feature: GYAE6OF02F5H9L.39.24.C02.1.454.CMB.1.raw
  modified_base (429)..(429): a, c, t, g, unknown or other
  misc_feature (429)..(429): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccggccagtcagaccattacctcctatttaagttggtatcagcagaaaccaggaaaagcccctaaactccctgatctatgctgcgtccactttgcaagatggggtcccatcaaggttcagtgctagtggatatgggacagatttcactctcaccatcacagtctgcaacgtgatgattttgctaacttactactgtcaacagagttacagagntagaaggttactacgttttggaccgtaggggaccaaggctaggagatcgagacgaactggtggctgacc

SEQ ID NO: 109160 - DNA, 706 bp, Homo sapiens
  misc_feature: GYAE6OF02JJHKH.39.24.C02.1.454.CMB.1.raw
tcagtcgcactagtcacgaccggtgctcgatttagtacagatcgttagggaaagggggaggtcgagtctcagtcaggacacagcatggacatgagggtccccgctcagctcctggggctcctgctactctggctccgaggtgccagatgtgacatccagatgatgcagtctccatcctcctgtctcgcatctgtcggggacagagttcaccatcacttgcccgggcagtcagaccacttacctccttactttaagttggttatctagcaagtaaacccgaaggaaaactacccccgtaaaacttacccgtacgtaacttacctaagtcgacgttacgtccggtaccctacttttacgacctaagtacggttacggggttaccccaacgttacgtaaacggtttccgaacgttcgaccgtttaaggttggtaagttaggttacggggaacgtaagttacttttacgtaccttacttaccgacctaacctactaacgtacggttctacgtacgtaacgtaggtactggttaatttcgttactaaccgttacttactacgtactaacctagtaacgttactacgtacgtctaaggtaacggtaacgtacgttttacggacccgttacggggaaccgtaacggtacggttaggtaacggaacgttacgaacggtacggtaacgtacggtttacggacgttacgtaacccg

SEQ ID NO: 109161 - DNA, 585 bp, Homo sapiens
  misc_feature: GYAE6OF02GDWDZ.39.24.C02.1.454.CMB.1.raw
  modified_base (400)..(400): a, c, t, g, unknown or other
  misc_feature (400)..(400): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcgggacagagtcaccatcacttgccgggccagtcagaccattacctcctatttaagttggtatcagcagaaaccaggaaaacgcccctaaactcctagatctatgctgcgtccactttgctaagagtcgggtcccagtccgtaaaggttcagtgactagtggatagtgggacagtatttcactctacaccatcacagtctgcaacgtnattgtattttgactaacgttactactacgtacaacgtagtacgttaacgagtacgtacgtaggtaaacgggttaactacgttttacggaccgtaacgggggaacccgtaaggtaccggttacgggtaacggtaacgttaccgaaggtaaccggtaaaccgttcggtacggtcgtacggtaacccg

SEQ ID NO: 109162 - DNA, 516 bp, Homo sapiens
  misc_feature: GYAE6OF02F1DDP.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggccagtcagaccattacctcctatttaagttggtatcagcagaaaccaggaaaacgcccctaaactcctgatctatgctgcgtccactttgacaagatggggtcccatcaaggttcagtgctagtgatagtggacagatttcactctcacatcacagtctgacaacgtgatgttatttcgctaacttactactgtacaacgagtagttacagtagtacgtagtaaacggtactacgttttggaccgagggaccgtaagcgtaggagtagtcgagacgtacgtgtcgtcgtgtaccg

SEQ ID NO: 109163 - DNA, 716 bp, Homo sapiens
  misc_feature: GYAE6OF02JDG44.39.24.C02.1.454.CMB.1.raw
  modified_base (219)..(219): a, c, t, g, unknown or other
  misc_feature (219)..(219): n is a, c, g, or t
  modified_base (705)..(705): a, c, t, g, unknown or other
  misc_feature (705)..(705): n is a, c, g, or t
tcagtcgcactagtcacgaccggtgctcgatttagtacagatcgttaggaaagggggaggtcgagtctcagtcaggacacagcatggacatgaggtcccgctcagctcctgggctcctgctactctggctccgaggtgccagatgtgacatccagatgatgcagtctccatcctccctgtctagcattctgtcggggacagagttcaccatcaccgttnccggggtccacgtcacggacctacttacctccttactttaacgtttggttaattaccagcagaaaaccgtaaggaaaaacgacccctaaaactccctagagttacctaatggacctcgaccgtcctacgtttcgactaacgacgttacggggtacctacgtactaaggttacctagtcgtcgtaagtcgggtatagtacgggtactacggtactttcgtaaccttctacgtacccctaagtacctacgtaccggttacgtacggtaccctaaacggtcggtaacttggttaaacgtttttcgtaaccgttaaccttaaccttaccgttacgtaacctaaacggaaccttacggttaacgtagtacgttaaagtacgggtaaacgggttaactaccggtttttaacgggcccgttaaccggggaccgtaacgggtctaacgggtagaccgttaacgaacggtaacgtacccggttaggtccggtacnccgggttaacc

SEQ ID NO: 109164 - DNA, 538 bp, Homo sapiens
  misc_feature: GYAE6OF02FJPSK.39.24.C02.1.454.CMB.1.raw
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatccctccctgtctgcatctgtcggggacagagtcaccatcacttgccggcagtcagaccattacctcctatttaagttggtatcagcagaaaccaggaaacgcccctaaactcctgatctatgctgcgtccactttgcaagacgtgggtcccatcaaggttcagtgctagtgatagtggacagatttcactctcacatcacngtctgacagtnatgtatttgctaacttactactgtacaacgagtacgttaacagagtacgtagtaaacggttacttaacgttttcgggaccgaacggggtacctaaaggcggtagggaacgtatacggaaggtaacggtaaaccgttggtcggctcggtaaccc

SEQ ID NO: 109165 - DNA, 944 bp, Homo sapiens
  misc_feature: GYAE6OF02H8VQN.39.24.C02.1.454.CMB.1.raw
tcagtcgcactagtcacgaccggtgctcgatttagtacagatcgttaagggaaagggggagtcagtctcgagtcctaggaccgacacgacgacttcggactagtgagggtccccgcgtcagtctccgtggggcctccgtggctactcctggcgtccggtagggtcgccgaaggatggtcgttacctagttccgagtattgagtgcagtctcagtcctcccgtgtcgtgactagtcgggtacggttcggggacaggtacgtccggacctagtacgtaccgttccggcccgggtctacggtaccgacgtaccttacgtttaccgttaccgttttaaggttttaaggttttacgggtaacttaccgtacggtaccgtaaacggtaaaaccggtaaacggtaaaacccgggtaacccccttaaaacgtccccggttacgtaacgttacgggttaaggtcggtaccggttacggtccggttaccgttaccgtttacggaaccgtaaacgggtacggtaacccgggggtaacccgtacggttaacggtaaacgggttttaccgtaaggtttcggtaacgggtttacgggttacggttaacggttaacggggttacgggtaaacggttacgtttacgttttacccgtaccgtttacctaaccgtaacccgtaacgttaacccgaaacgggttacggttaaccgtaagaacccgttaaggttgttaacgtttaccgttagtttaccgaaccttaacgtttacgtacgtaccgttaacgaacgtaggtttaccggaacgtagggtaacgtacgttacgggttaacggttaacgttttaccgggttacggaaccgggttaccgggaacgtaacgggtacgttacgggaaacctaacgttaaccgggtaggtaaacccggtttgtttcccggggtaagtcccgtaaggttaaccc

SEQ ID NO: 109166 - DNA, 616 bp, Homo sapiens
  misc_feature: GYAE6OF02H3OS2.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctcatcctccctgtctgcatctgtcgggacagagtcaccatcacttcgccggcagtcagaccattacctcctatttaacgttggtatcagctagaaaccaaggaaaacgcccctaaactccctgatctatgctgccgtcctactttgactaagatcggggtacccatacgtaacggttcacgtgcgttagtcggatagtggactaggtactttcgacttacctacaccctataccacgacgttctagactaacgtgtagttgttagttttacacgttaaaccttacttactcgtaacaacctaggtacttaacgtaagacgtacgttacgggtaaacggttaacgttacgttttacggacccgtaacggggtaccaaacgggtccggtaggtaacggtacgtacgtaacggaaccgtaacggttcggtacggtaccgtagtaacccccg

SEQ ID NO: 109167 - DNA, 666 bp, Homo sapiens
  misc_feature: GYAE6OF02FXY24.39.24.C02.1.454.CMB.1.raw
  modified_base (311)..(311): a, c, t, g, unknown or other
  misc_feature (311)..(311): n is a, c, g, or t
tcagtcgcactagtcacgaccggtgctcgatttagtacagatcgttagggaaagggggagtcagtctcagtcaggacacagcatggacatgagggtccccgctcagctccgtggggctcctgctactctggctccgaggtgccagatgtgacatccagatgatgcagtctccatccctcctgtctgctatcgtggtcgggacagatcaccatcacttcggccggccagtccagacccattaccctctaattttaagttggtactcgagcaagaaaaccaaggaaaaccgacccctaaactcctagatctangctgccgtcctactttgacaagtcgtacgggtccagttacaaggttcagtgacttaggtaggtaataggtgggaactaggtactttccgacttctaccgaacctataccaacgttcggtacctacggtaaccgtaacgtgtaagtttacggtttaattttaccgtaacgtttaaacctttaccttaacgttacggttaacctaaagtaacgttacgtttaaaccgagtacggttacgttaaggaaaccgggtttaactacggttttacgggaccgtaacggggtaaccctaaggtcgtagggaacgtaagtaccgaaggtaacggttacgtagggtccggtacgtacgtaacccg

SEQ ID NO: 109168 - DNA, 691 bp, Homo sapiens
  misc_feature: GYAE6OF02HXC08.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccggaggtgccagatgtgacatccagatgatgcagtcctccactccctccctgtctgcatcgtggtcgggacagagtcacctatctacgttcggcccgggcagtcacgacctacttaccttccttattttaagttggtatcagtacaaagaaaccgaaggaaaaccgaccccttaaactcctagtacttacgtatcgtctcgtcctaccgtcttacgacgaagtacggtacgggtacctagtacggtaacgttcgacgtgtacgttagtaggtaagtaggtacggtaactacgttactttacaccgttacctaacctaccgtaactaccgtaacggtacgggttaccttacggaaccgttaaacggtcgtaacgttagtttacgttttacgaacctttaaaccgtttacgtaacttaacgtactaaacgtaacgttacgtaacgtcggtaacgtacgttaacgggtaaaggttacctttacgggttacgggaccgtaacgggtaccaaggtcgtaggtagtacgtacgacggtacggtagtcggacgtacctacgtacc

SEQ ID NO: 109169 - DNA, 562 bp, Homo sapiens
  misc_feature: GYAE6OF02H0TBA.39.24.C02.1.454.CMB.1.raw
  modified_base (354)..(354): a, c, t, g, unknown or other
  misc_feature (354)..(354): n is a, c, g, or t
tcagtcgcactagtcacgaccggtgctcgatttagtacagatcgttagggaaagggggagtcagtctcagtcaggacacagcatggacatgagggtccccgctcagctcctgggctcctgctactctggctccgaggtgccagatgtgacatccagatgatgcagtctccatccctccctgtctgcatctgtcgggacagagtcaccatcacttcgccggccagtcagaccattacctcctatttaagttggtatcagacaagaaaccaggaaaacgcccctaaaactcctagatctatgctgcgtctacttgacagtagtcgggtccatacgaagttcagtgctagtgatagnggacagtattcacttctcacgtactacacgtagtcgtcgtacgaacgtgattaagttacgttttagacttaacctttaagtacctagtacaagagtaacgtaacgagagtacgtaggtaacggtacttagtttcgaccggtaagggaccgaagtacgtaggtaagtacgtacggacgacgtaacgttaggacggtacgtagtaacccg

SEQ ID NO: 109170 - DNA, 705 bp, Homo sapiens
  misc_feature: GYAE6OF02HTFTP.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagactgatgcagtctccatcctcctgtctgcatctggtcggggacagagtccaccatcacttggccggcagtcagacctattacctccttatttaagttgtatcagcaagaaaccgaggaaaacgacccctaaactcctagactacgtatcgctacgccgttacctacgtttcgacgaagtacgtcggggtaccctagtaccgtaacggttcgtaggttacgtacgttaacggtaggtaacttaggtagggtaaccgtagttacttttacctaaccgttcctacccaacctaacgttacctacgtaacggttcgttacgtaccgtaaacgttagtaacgttgttaacgttttacgaaccgttaaaccgtttaactaccgttacgtaacctaacgtaaggttacgttaacgaagttacgtaacgttaagggtaaacggttaaaccgtttacggtttaccgggacccggtaaccgggaaccgtaaggtaccgttagggaacgtacgtaacgaaccggtaacgtaaccgttgggtacggtcgtacgtaacccg

SEQ ID NO: 109171 - DNA, 766 bp, Homo sapiens
  misc_feature: GYAE6OF02IO2VO.39.24.C02.1.454.CMB.1.raw
  modified_base (154)..(154): a, c, t, g, unknown or other
  misc_feature (154)..(154): n is a, c, g, or t
  modified_base (160)..(160): a, c, t, g, unknown or other
  misc_feature (160)..(160): n is a, c, g, or t
tcagtcgcactagtcacgaccggtgctcgatttagtacagatcgttagggaaagggggagtcagtctcagtcaggacacagcatggacatgagggtccccgctcagctccgtggggctcctgctactctggctccgaggtcgccagatgtgacntccagntggtgcagtcctccactccctccctgttcctgcattcgtggtcgggacagacgtcacactcacgtcggccggccagtcgaacgtacctaacttacctaccttaatttaaaggttggtaatcaacgcaaagaaaaccgaaaggggtaaaacctacccctaaaactccgtagactacctaatgaccgtcgtaccgtcctactttacgacgaacggtaaccggtcggggtccctaaggttacccgtaaaggttacccgagttacggtccgtaaggggtttacgtaaagtttcgggaaccggggtaaattaacgtaacggttttcctaacctttaccgtacctaacctacgtaacccgaagttaccgttcgttaacgtaccgtaaacgtacgtacgttagttaacgtttaccgtaacttaacttaacgttacgttaacgtaaccgtaaagtaacggttaataccggtaaagtcgtaacggttacggtaaaccgggttaacgtttacccgtttaagggtaaccgggaccgggtaaacgtaacggtacgacggttaagaaccgttaagacgttaaaacggcggtagggttacggactacggtaccctaacgg

SEQ ID NO: 109172 - DNA, 644 bp, Homo sapiens
  misc_feature: GYAE6OF02GDZ24.39.24.C02.1.454.CMB.1.raw
  modified_base (492)..(492): a, c, t, g, unknown or other
  misc_feature (492)..(492): n is a, c, g, or t
tcagtcgcactagtcacgaccggtgctcgatttagtacagatcgttagggaaaggggagtcagtctcagtcaggacacagcatggacatgagggtccccgctcagctcctgggctcctgctactctgctcgaggtgccagatgtgacatccagatgatgcagtctccatccctccctgtctgcatcgtggtcgggacaggagtcgaccatcaacgttcggccggccagtcagaccattacctcctatttaagttgtattcagctaagaaaccgagaaaacgacccctaaaactcctagatactatgctgccgtctactttgacgtaagtgtcggggtaccagtacgaagttcacgtgtcgtaggtagagtagtagggtacaggtattactacgtcttacgaccctatacctaacgacgtactcgactaacgttcgattcgttatttacgacttaacttactacttactacgtaaacgtagtaacgttaacgngtaacgtacgttaaggaacggtttaacctaaccggttttacggacccggtaaggggtaaccctaagggtaccggtttagggaaacgttacggtaaccgtaacggtaacccgggtaacgttacgggttaacgggtacccgtacgggtaacccc

SEQ ID NO: 109173 - DNA, 656 bp, Homo sapiens
  misc_feature: GYAE6OF02IWNBI.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgagtgccagatgtgacatccagatgatgcagtctccatcctcctgtctgcatctggtcgggacagacgtcaccatcacgttcggcccggaccagtcacgacctactttacctacttatttaagttgtatcagtcaacgaaaccgaaggaaaactcccctaaaatcctagacttctatcgcttcgccgttactacgtttacgactaaggtacggttcgggtacccagtacgtaaggttcaaggttcgtacgttaggtggtaaagtaggtacggaacgtagttacgtttaccacgttctaccgtactatacgacgtacggtctagtaccgtaacgtgtaagttcgttaattttaccgaacttaaccgtttactaacgtactaactaacgtaacgttattaacgagtaacgacgttaaggtaacggtaccttacggtttacggaccggtaacgggtaacgtacggtacgtagggaacgtacgtacgtaacggtaacggtacgttggacgtaccgtacgtaacccg

SEQ ID NO: 109174 - DNA, 614 bp, Homo sapiens
  misc_feature: GYAE6OF02JFFXI.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatcctccctgtctgcatctggtcggggacagagtcaccatcacgttcgccggccaggtcagaccattaccctccttaatttaaggttgtatcagacaagaaaccaaggaaaactcccctaaactcctagatctatcgctgcgtctacgtttgacgagtagtcgggtaccctatacgtaaggttcagtcgtcgttaggtggtataggtacgggactaacgttacttcgacttcgtacctaacctatacgaacgtagtctacgactaacgtcgattgttattttcaccttaacttactacgtgtacctaaagtagttacgtaacagacgtacgtaaggtaacggttaacgttacgttttacggaccggtaacgggaaccgtaacggtacgtagggaacgttacgtacggaacgtacggtaaccgtggtacggtcgttacgtaccg

SEQ ID NO: 109175 - DNA, 725 bp, Homo sapiens
  misc_feature: GYAE6OF02JS79U.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctcgaggtgccagatgtgacatccagatgatgcagtctccatcctccctgtctgcatcgtggtacgggacagacgtccaccatcacgttcggccggccagtcacgacctacttacctccttatttaaggttcgtatcacgacaacgaaaccaaggaaaaccgcccctaaactcctagactctatcgtctcgtccgttcctagtttacgactaaggtcggtacgggtccctaagtaccgtaagggttactacggttagtaccggttaaggtagggttaacttagggtacgggtaaccgttaagttaccttttacctaccttacctaccgtaacctactaccgtaaccgtacggttcgtaacgtaccgtaacgtagttacgttacgttacgttttacgaacctttaaccttaaccttaccgtttacgttaacctaaacgtacggttaaacgtttacgaaggtacgttaacgttaacgggtaaacggttaaccgttacggttttaaccgggacggtaacgggtaccgtaacggtaccggttaggtaacgttacgtacgtaacggtaacggtaacggtggtacgtacgtacgtaacccg

SEQ ID NO: 109176 - DNA, 777 bp, Homo sapiens
  misc_feature: GYAE6OF02IGKKV.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgactgcagtctccactccgtcccttgtctgacctatccggtggtaccggggaacagtacgtcccaaccctagtcctaacggttcggcccgggtacacgtcgaacgtaaccctactttaccctacctttaagttttaaacggttggtaacgtactaacgacgtaaacgaaaacccgaaaggtaaaacccgtacccccttaaaacttccgtaccgtaattaaccgtacgtcgtccgtacgtccgttacccttaaacgtttggaaccaacgggtccggttcgggtaacctacgttacgtaagggttacctaggtacgttacgtacggttaggtattacgggtaggtaacctaggttactttacgaccttacgtaccacgttaaccacgaacgttcggtcttagaccgtacgttacgtgttacttagtttcctaaacgttaaccttacgtacggtaccttaaacgaaacgttacgagtttaacccgagttacggtacgtttaaacggaacgtttaccgttacgggtttaccggacccgggttaagggaccttaaggtacccgttaggtaacggtacgtacctaagggtaccccgttagtacgggtccctagaccggttaacc

SEQ ID NO: 109177 - DNA, 746 bp, Homo sapiens
  misc_feature: GYAE6OF02IXZ4I.39.24.C02.1.454.CMB.1.raw
  modified_base (203)..(203): a, c, t, g, unknown or other
  misc_feature (203)..(203): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccatccctccctgtctgcatctggtcgggacagntcaccatctacgttcgccgggcagtcacgacctacttaaccttccttaagtttaagttgtactcacgtacaaggaaaaccgaacggaaaaccgtaccccctaaacttaccctagtacttacctagtcgtacgtcgtaccgttcctacgtttacgaacgtaacggtacggttccgggtacctaacgtaccgttaacggttaccgtaacggttacgcggttttaagggtaggtaagttaggggttaacggggtaactacggtttaacgttttaccctacccttacccgtttaacccacccgttaacttaccgacgttaaccggttcgttaaccggtaacttaacgggttcgtacggttagtttaacgttttaccgtaacttaaacctttaccgttactacggtactaaacgtacgtaactaacgtaagtgaccgttaagtacggttacttcgggtttacgaccggtaacgggtaccaaggtcgtaacgggactaacggtaccgaacggtaacggaaccgtttcgggacgttaccggacgtacccg

SEQ ID NO: 109178 - DNA, 754 bp, Homo sapiens
  misc_feature: GYAE6OF02INQAY.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctccgtggggctcctgctactctggctcgaggtcgccagatgtgacatccagatgatgcagtctcatcctcctgtctgctatcgtggtacgggataggacgtccaccatcctacgttcggcccgggacctaggtccaacggacctacttaccttaccgttaattttaacgtggttactacgagacaacgaaaccgaaggaaaacctaccccttaaatcccgtagtacttacttagtcgtctcgtaccgttaccttaacgtttcgacgtaaacggtacggttaccggggtaccctagtaccgttaacggtcgtacggtgtaccgttaggttacggtaagttaggtacgggtaaactacggttaacttttaccgacctttaccgtaccgtaacctaacgtaaccgacgtaacgggttaccgtacgaaaccgttacggttagttaaggtttacgtttaaacgttttacgaaccctttaaactttaaccgtacgtttaacgaacgttaacgtaacggttacgtaacgtagggtaacgtacggtaaggttaaccggttacgttacggttaccggaccggtacgggtaacgtcggtaacgggcgtaacgtacggtaacgaacgggtacgttagtacggtacggtcacggtaacc

SEQ ID NO: 109179 - DNA, 734 bp, Homo sapiens
  misc_feature: GYAE6OF02FZZY2.39.24.C02.1.454.CMB.1.raw
  modified_base (257)..(257): a, c, t, g, unknown or other
  misc_feature (257)..(257): n is a, c, g, or t
tcagtcgcactagtcacgaccggtgctcgatttagtacagatcgttagggaaagggggagtcagtctcagtcaggacacagcatggacatgagggtccccgctcagctcctggggctcctgctactctggctccgaggtgccagatgtgacatccagatgatgcagtctccactccctcctgtctgactattcgtggtacggggacagtacgtccaccactcacgttcggccgggacagtccagaccctattacctnttaatttagtgtatacagacaacgaaaccgaaggaaacctacccctaaatccgtagtactacgtacgtagctacgtccgtacctacttgaaccgtagtacggttacgggtacctacgtaagtacggttcaggttcgtacgttaaggtggtaaacgtagggttacggtaacgtaggttaccttacctaaccgttcctaccaacccgtataccgtactacggttcaccgtacgtaacggtagtagttaacggtttaacttttaccggacttaaacctttacccgttaacgttaccgtaaacccgttaaacggaaagttaccgtaagtacgggtaacgacgttaacggtaaacggttacgtttaccgggtttacggaaccgggtaacggggtaacctacgggtaacgtttacggggaacgttaacgtaaccggtaacgtaacccgggttaagttacgggtaccggtacgttcccgaacgg

SEQ ID NO: 109180 - DNA, 634 bp, Homo sapiens
  misc_feature: GYAE6OF02F6J21.39.24.C02.1.454.CMB.1.raw
  modified_base (477)..(477): a, c, t, g, unknown or other
  misc_feature (477)..(477): n is a, c, g, or t
  modified_base (506)..(506): a, c, t, g, unknown or other
  misc_feature (506)..(506): n is a, c, g, or t
  modified_base (528)..(528): a, c, t, g, unknown or other
  misc_feature (528)..(528): n is a, c, g, or t
tcagtcgcactagtcacgaccggtgctcgatttagtacagatcgttagggaaaggggagtcagtctcagtcaggacacagcatggacatgagggtccccgctcagctcctgggctcctgctactctgctccgaggtgccagatgtgacatccagatgatgcagtcctcactcctccctgtctgacatctggtcgggacagagtaccaccatactacttcggaccggcagtcacgaccattacctcttagtttaagtgtatcagcaacgaaaccgaaggaaacccgtacccctaaacttccgtagtacgtacctagtcgtaccgtcggtccgttaccgtactttagaccgtaacgtcggttaccgggtcccaagttacgtaaggttccaggttcgtacgttaggtacgtaagtagtacggactacgttacttccacgtcctactaacctactacgacgtcggtcacgaccgtacgtanagttattagttacgaacttactcttactntaacaactagtagtacagtacncgtaagacgttacgtacggtttacgacgggtacggtacgtacggtacgtacggtaagtaccgtaggaaccggtacgtaccggtagtaccggtacgtacgtaacccg

SEQ ID NO: 109181 - DNA, 768 bp, Homo sapiens
  misc_feature: GYAE6OF02FTW2B.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctgggctcctgctactctggctccgaggtgccagatgtgacatccagatgatgcagtctccatcctcctgtctgcatctggtcgggacacgtacgtcaccgtatccgacgtcggccggtacctacgtcacgtacctacttacccgtaccttaagttttaagttcggtatacacgacaacggaaaaccgtaacggaaaaccgtacccccttaaaacgtcccgttacgaactacttagcgtactcgtaccggttacctaccgtttacgaaccgtaaggtacggttacggggtacccctacgttaccggtaacggttacgtaaggttcgtaacgttacggtaggtaacgttaacgtaacggggaacgaacgtttaacgtttacccgtaccttaaccaccggttaacccacgtacctacggtacggtacggttacgaaccgttaacggtagtacgttaattacggtttacgaaccttaaaccggttacttaacgtacctaacgtaacggtaacgtaggttaaacacggtacgttacgggtacggtaaacggttaccgttaacggttaccggaaccgggaacgggtaaccgtaacggtaccggtacggaacgttacgtacgtaacggtacggtaacttaggggaccgttacgtaccgtaacccg

SEQ ID NO: 109182 - DNA, 722 bp, Homo sapiens
  misc_feature: GYAE6OF02GD3CC.39.24.C02.1.454.CMB.1.raw
tcagtcgcactagtcacgaccggtgctcgatttagtacagatcgttagggaaagggggagtcagtctcagtcaggacacagcatggacatgagggtccccgctcagctcctggggcctcctgctgctctggctcccaggtgccaaatgtgacatccagatgacccagtctccttccaccctgtctgcatctgtggagacagagtcaccatcagttcgccgggaccagtcagagttattagtagcgtggttgccgtggtatcagacaagaaaccgagggaaacgacccctaagcctcctgatgtatgtatcgacctaccgtaaggtttacgtaaacgggtcgggtaccctaagtaccgtaacggttacccggacggtacgaggtaggtacgttacggtagggtaacgaagtaaacttcgtacctacctaccgaacccgtataccggaggtaccaacggtaccccgtagtaaccgacgtacccgtagaacgttgtttaacgttttacgtaaccgttaaactttaacttaccgttaacgaacctaaaccgtaagttaaagttaaacttaacgttttaacctttaacccggtttaaaccttaccggttttacgggaacccggttaacgggtacccgtaaacggtcgtaacggggtaacgtaacgtaaacccgttaaaaccgtacggtaggtacggtacgttaccggaaccgtaccctagttacccg

SEQ ID NO: 109183 - DNA, 450 bp, Homo sapiens
  misc_feature: GYAE6OF01CB2VN.2.80.H03.1.454.CMB.1.raw
  modified_base (339)..(339): a, c, t, g, unknown or other
  misc_feature (339)..(339): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (412)..(412): a, c, t, g, unknown or other
  misc_feature (412)..(412): n is a, c, g, or t
  modified_base (437)..(450): a, c, t, g, unknown or other
  misc_feature (437)..(450): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaagggacggcgggggcgacactagctggtactatcctcgtgtctggttcgacacctggggccaggggaatactggtcaccgtctcctcagcctccaccaagggcccatcggtcttccccctggcnccctgctccaggancacctcgagngcacagcggccctggctgcctggtcaaggactacttcctgtcgagcgtntgagcgggctggcaaggcgcatagnnnnnnnnnnnnnn

SEQ ID NO: 109184 - DNA, 451 bp, Homo sapiens
  misc_feature: GYAE6OF01CPW1B.2.80.H03.1.454.CMB.1.raw
  modified_base (440)..(451): a, c, t, g, unknown or other
  misc_feature (440)..(451): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaaggggacggcgggggcacactagctggtactatcctcgtgtctggttcgacacctggggccagggaatactggtcaccgtctcctcagcctccaccaagggcccatcggtcttccccctggcgccctgctccaggacgcacctccgagacgcacagcgccctgggctgcctggtcaaggactacttcctgtcgagcgtctgagcgggctggcaaggcgcatacgnnnnnnnnnnnn

SEQ ID NO: 109185 - DNA, 444 bp, Homo sapiens
  misc_feature: GYAE6OF01AR169.2.80.H03.1.454.CMB.1.raw
  modified_base (437)..(444): a, c, t, g, unknown or other
  misc_feature (437)..(444): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaaggggacggcgggggcgacactagctggtactatcctcgtgtctggttcgacacctggggccagggaatactggtcaccgtctcctcagcctccaccaagggcccatcggtcttccccctggcaccctcctccaagacgcacctctggggcacagcggccctgggctgcctggtcaaggctacttcctgtcgagcgtctgagcgggctggcaggcgcatagnnnnnnnn

SEQ ID NO: 109186 - DNA, 447 bp, Homo sapiens
  misc_feature: GYAE6OF01CUU9J.2.80.H03.1.454.CMB.1.raw
  modified_base (417)..(417): a, c, t, g, unknown or other
  misc_feature (417)..(417): n is a, c, g, or t
  modified_base (439)..(447): a, c, t, g, unknown or other
  misc_feature (439)..(447): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaaggggacggcgggggcgacactagctggtactatcctcgtgtctggttcgacacctggggccagggaatactggtcaccgtctcctcagcctccaccaagggcccatcggtcttccccctggcgcccctgctccaggagccacctccgagagcacagcggccctgggctgcctggtcaaggctacttctgtcgagcgtctgngcgggctggcaaggcgcatagnnnnnnnnn

SEQ ID NO: 109187 - DNA, 534 bp, Homo sapiens
  misc_feature: GYAE6OF01D3V3G.2.80.H03.1.454.CMB.1.raw
  modified_base (512)..(534): a, c, t, g, unknown or other
  misc_feature (512)..(534): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcgaaggggacggcgggggcacactagctggtactatcctcgtgtctggttcgacaccgtggggccaggggaatactggtcaccgtctcctcacgcctccaccgaacgggcccatccggtccttcccccgtggccgcccctgcctccgaggacgccacctccgagacgccacgacggccgggccccgtgggcctcggtcccgtagggtaccgaaacgggtacccttaccgtttcccgtggtcccgacgtccgttcgtacggacgggcgggtcgtcgggacgaacgggcgactagtacggnnnnnnnnnnnnnnnnnnnnnnn

SEQ ID NO: 109188 - DNA, 463 bp, Homo sapiens
  misc_feature: GYAE6OF01B96JT.2.80.H03.1.454.CMB.1.raw
  modified_base (448)..(463): a, c, t, g, unknown or other
  misc_feature (448)..(463): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacttccagagacaacgccaagaacacggtgtatctgcagatccatggtctgacagtcgaggacacggctgtttattactgtgcaaggggacggcgggggcgacactagctggtactatcctcgtgtctggttcgacacctggggccaggggaatactggtcaccgtctcctcagcctccaccaacgggcccatccggtccttccccctgggccgcccctgcctccgaggacgcacctccgagacgcacagcggcctgggctgcctgtcaaggcctacttcctgtcgagcgtctgagcgggctggcaaggcgcatagnnnnnnnnnnnnnnnn

SEQ ID NO: 109189 - DNA, 501 bp, Homo sapiens
  misc_feature: GYAE6OF01EZNXH.2.80.H03.1.454.CMB.1.raw
  modified_base (476)..(501): a, c, t, g, unknown or other
  misc_feature (476)..(501): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaagggacggcgggggcacactagctggtactatcctgtgtctggttcgacacctggggccagggaatactggtcaccgtctcctcacgcctccaccaacgggcccatccggtccttcccccgtggccgcccctgcctccgaggacgccaccctccgagacgccacgacgccggcccctggggcctcggcccgtgggtaccaacgggtacctaccttccgtgtccgagtcgtctgacggcgggctggcgaaggcgacagtagnnnnnnnnnnnnnnnnnnnnnnnnnn

SEQ ID NO: 109190 - DNA, 518 bp, Homo sapiens
  misc_feature: GYAE6OF01BD0IV.2.80.H03.1.454.CMB.1.raw
  modified_base (237)..(237): a, c, t, g, unknown or other
  misc_feature (237)..(237): n is a, c, g, or t
  modified_base (494)..(518): a, c, t, g, unknown or other
  misc_feature (494)..(518): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacgctgtatctgcaaatgaacagtctgagagccgaggacacggctgtgtattactgtgcaagagatagcagcagctggtacnccgactacgtggggccagggaaccctggtcaccgtctcctcacgcctccaccaacgggcccagtccggtccttcccccgtggcccgccctcgcctcccgaggacgccaccctccggagacgcaccgacgccggccccgtggggcctcggcccgtcgggtaccgaaacgggtaccttaccgtttcccgtggttaccgacggtccgttcgtcggaacggccggggtccgtgggaccgtaacgggccgactaagtaggcnnnnnnnnnnnnnnnnnnnnnnnnn

SEQ ID NO: 109191 - DNA, 500 bp, Homo sapiens
  misc_feature: GYAE6OF01AOHQ1.2.80.H03.1.454.CMB.1.raw
  modified_base (339)..(339): a, c, t, g, unknown or other
  misc_feature (339)..(339): n is a, c, g, or t
  modified_base (362)..(362): a, c, t, g, unknown or other
  misc_feature (362)..(362): n is a, c, g, or t
  modified_base (478)..(500): a, c, t, g, unknown or other
  misc_feature (478)..(500): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaagggacggcgggggcacactagctggtactatcctcgtgtctggttcgacaccgtggggccagggaatactggtcaccgtctcctcagcctccaccgaacgggcccatccggtccttcccccgnggccgcccctgcctccgaggacnccaccctcggagacgcacgacggccggccctggggcctggcccgtgggtacaaggtacctaccgttcctgtccgagcgtctggacgccgggcgtcggacgaacgggcgcgagtagnnnnnnnnnnnnnnnnnnnnnnn

SEQ ID NO: 109192 - DNA, 459 bp, Homo sapiens
  misc_feature: GYAE6OF01DIQ26.2.80.H03.1.454.CMB.1.raw
  modified_base (441)..(441): a, c, t, g, unknown or other
  misc_feature (441)..(441): n is a, c, g, or t
  modified_base (447)..(459): a, c, t, g, unknown or other
  misc_feature (447)..(459): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaaggggacggcggggcacactagctggtactatcctgtgtctggttcgacacctggggccagggaatactggtcaccgtctcctcagcctccaccaaggcccagtccggtccttccccctggccgcccctgcctccaggacgccacctccgagagcacagccggccctgggctgcctggtcaacggcttacttcctgtccgagcgtctgagcgggctggcaagggcncatagnnnnnnnnnnnnn

SEQ ID NO: 109193 - DNA, 569 bp, Homo sapiens
  misc_feature: GYAE6OF01CHOQ6.2.80.H03.1.454.CMB.1.raw
  modified_base (544)..(569): a, c, t, g, unknown or other
  misc_feature (544)..(569): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaaggccgattcaccacctccagagacaacgccaagaacacggtgtatctgcagatccatggtctgacagtcgaggacacggtcttgttttattacgtgtgacgaaggggacgggcgggggcacacgtagctggtactatcctgtgtcgtggttccgacgaccgtgggaccagggtaactacgtcggtccaccgtctcctcgacgccctaccgaccgaacgggcccctagttcccggttccccttcccccgtggccccgtccctcggccctaccgaggaccgaccgtacccgtcgacgacgccaacgacggcccggtcccgtaggcctcggcccgttagggtacctaacgggtaccctttaccgttccgtcggtacgacggtccggtctgggacggtcgggtacgtcggacgacgggcgacgaatcggnnnnnnnnnnnnnnnnnnnnnnnnnn

SEQ ID NO: 109194 - DNA, 544 bp, Homo sapiens
  misc_feature: GYAE6OF01BMZMX.2.80.H03.1.454.CMB.1.raw
  modified_base (286)..(286): a, c, t, g, unknown or other
  misc_feature (286)..(286): n is a, c, g, or t
  modified_base (499)..(499): a, c, t, g, unknown or other
  misc_feature (499)..(499): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (514)..(517): a, c, t, g, unknown or other
  misc_feature (514)..(517): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(528): a, c, t, g, unknown or other
  misc_feature (524)..(528): n is a, c, g, or t
  modified_base (530)..(541): a, c, t, g, unknown or other
  misc_feature (530)..(541): n is a, c, g, or t
  modified_base (543)..(544): a, c, t, g, unknown or other
  misc_feature (543)..(544): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaaggggcggcgggggcacactagctggtactatcctgtgtctggttcgacaccgtggggccagggaatacgnggtccaccgtctcctcacgccctccaccgaacgggcccatccggtccttcccccgtggcctcccctgcctccgaggacgcaccgtccgagacgccacgacggccgggcccgtggggcctcggcccttgggtaccaaacgggtaccttaccgttccgtcggtccggacggtccgttccgtaggacgggtccgggctcgggaccgaacgggcccncgaagtacgncncgnnnngcncngnnnnngnnnnnnnnnnnngnn

SEQ ID NO: 109195 - DNA, 730 bp, Homo sapiens
  misc_feature: GYAE6OF01C2K81.2.80.H03.1.454.CMB.1.raw
  modified_base (125)..(125): a, c, t, g, unknown or other
  misc_feature (125)..(125): n is a, c, g, or t
  modified_base (535)..(535): a, c, t, g, unknown or other
  misc_feature (535)..(535): n is a, c, g, or t
  modified_base (691)..(691): a, c, t, g, unknown or other
  misc_feature (691)..(691): n is a, c, g, or t
  modified_base (693)..(693): a, c, t, g, unknown or other
  misc_feature (693)..(693): n is a, c, g, or t
  modified_base (695)..(695): a, c, t, g, unknown or other
  misc_feature (695)..(695): n is a, c, g, or t
  modified_base (697)..(698): a, c, t, g, unknown or other
  misc_feature (697)..(698): n is a, c, g, or t
  modified_base (700)..(700): a, c, t, g, unknown or other
  misc_feature (700)..(700): n is a, c, g, or t
  modified_base (703)..(703): a, c, t, g, unknown or other
  misc_feature (703)..(703): n is a, c, g, or t
  modified_base (707)..(707): a, c, t, g, unknown or other
  misc_feature (707)..(707): n is a, c, g, or t
  modified_base (709)..(711): a, c, t, g, unknown or other
  misc_feature (709)..(711): n is a, c, g, or t
  modified_base (713)..(718): a, c, t, g, unknown or other
  misc_feature (713)..(718): n is a, c, g, or t
  modified_base (720)..(723): a, c, t, g, unknown or other
  misc_feature (720)..(723): n is a, c, g, or t
  modified_base (725)..(725): a, c, t, g, unknown or other
  misc_feature (725)..(725): n is a, c, g, or t
  modified_base (727)..(727): a, c, t, g, unknown or other
  misc_feature (727)..(727): n is a, c, g, or t
  modified_base (729)..(729): a, c, t, g, unknown or other
  misc_feature (729)..(729): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaggcggctntcacctccacgagaacaacgaccaacgaaacgaacgtacggtatactcgcgagaatacctacgtaggttcgtcgtacgaacgtcggacggaacgaccggccgttgttttattttaacttagtggtcgaacggggaacggggccgggggccgggacacgtagacgtgtacgtactccgtcgtgtcgtcggttcggtaccaccgtcggggtccgaacggtaagtaactcggtcgaccccgtcgttccctccgaacgcccgtccctaacccgaaacgggtccccgtacttaccggttcccgttttcccccccgtccgggccggcccctttccgacgttaccccgaggaacggccctacccgttaccccgaacggagaacccgacgaaccggtccgggtccccgtaccggggtntcccggtcccggttcgggtaccggtaaaccggtaaccgttaacccgttttcccgttacggttaccgggtacggtaccggtccgtacgtaccgggggtaccgggtccgggttaccggacgggtaaaccgggtaccggacccgtagttaacggagcgngngngnngncgngcgngnnngnnnnnncnnnncngngng

SEQ ID NO: 109196 - DNA, 579 bp, Homo sapiens
  misc_feature: GYAE6OF01DBGJ2.2.80.H03.1.454.CMB.1.raw
  modified_base (207)..(207): a, c, t, g, unknown or other
  misc_feature (207)..(207): n is a, c, g, or t
  modified_base (384)..(384): a, c, t, g, unknown or other
  misc_feature (384)..(384): n is a, c, g, or t
  modified_base (549)..(549): a, c, t, g, unknown or other
  misc_feature (549)..(549): n is a, c, g, or t
  modified_base (554)..(564): a, c, t, g, unknown or other
  misc_feature (554)..(564): n is a, c, g, or t
  modified_base (566)..(579): a, c, t, g, unknown or other
  misc_feature (566)..(579): n is a, c, g, or t
tcagacgctcgacacacgaccggtgctcgatttagctgtgcgtcgaaagggaaggggctgatgtgggtcgcgcgcagtcatattgatgggactgtcacaggctacggggactccgtgaagggccgattcaccacctcagagacaacgccaagaacacggtgtatctgcagatccatggtctgacagcgagacacggctgtttattangtgacgaaggggacggcgggggcaacacgtagctggtaacacttcctgttgtcgttggttaccgaactaccgtggggaccaagggaacttacgtggtaccacccggttctaccgtcacgtccctaccgaaccgtaaacggggccctaagtccggttaccccttcccccgtgggcccnccccgtcgtccaccgaggtaccgccaacccgtccggagaaccgcaacgacgggccggtccccgtgggcttcgaccgttcggtacgaacgtaccttaccgttcgtaggcgtagccggttatcggacggcgggtcctagggaccgtaaaggcctaacgacttaagcnacgannnnnnnnnnngnnnnnnnnnnnnnn

SEQ ID NO: 109197 - DNA, 579 bp, Homo sapiens
  misc_feature: GYAE6OF01B6NHZ.2.80.H03.1.454.CMB.1.raw
  modified_base (185)..(185): a, c, t, g, unknown or other
  misc_feature (185)..(185): n is a, c, g, or t
  modified_base (371)..(371): a, c, t, g, unknown or other
  misc_feature (371)..(371): n is a, c, g, or t
  modified_base (388)..(388): a, c, t, g, unknown or other
  misc_feature (388)..(388): n is a, c, g, or t
  modified_base (550)..(550): a, c, t, g, unknown or other
  misc_feature (550)..(550): n is a, c, g, or t
  modified_base (552)..(554): a, c, t, g, unknown or other
  misc_feature (552)..(554): n is a, c, g, or t
  modified_base (556)..(579): a, c, t, g, unknown or other
  misc_feature (556)..(579): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacngtcgaggacacggtcttgtttacttactgtgacgaaggggaccgggcgggggcacactagctggtactatcctgtgtcgtggttcgacaccgtggggccaagggaacttcgtcggtccacccgtctaccctcacgtccctaccgaaccgaacgggcccctagtccggttccttcccccgtggcccnccctgcctccgaggacncccacgtccggagacgtccacgacggcccggccgttgggccttcggcccgttaggggtacccgaacgggtacccttaccgttacccgttgggtaccgacggtccggttgtacggacgggtccgggtccggtacggaccgtaacgggccgacgtaagtacggngnnngnnnnnnnnnnnnnnnnnnnnnnnn

SEQ ID NO: 109198 - DNA, 672 bp, Homo sapiens
  misc_feature: GYAE6OF01DYPCW.2.80.H03.1.454.CMB.1.raw
  modified_base (431)..(431): a, c, t, g, unknown or other
  misc_feature (431)..(431): n is a, c, g, or t
  modified_base (638)..(638): a, c, t, g, unknown or other
  misc_feature (638)..(638): n is a, c, g, or t
  modified_base (640)..(640): a, c, t, g, unknown or other
  misc_feature (640)..(640): n is a, c, g, or t
  modified_base (644)..(644): a, c, t, g, unknown or other
  misc_feature (644)..(644): n is a, c, g, or t
  modified_base (646)..(649): a, c, t, g, unknown or other
  misc_feature (646)..(649): n is a, c, g, or t
  modified_base (651)..(651): a, c, t, g, unknown or other
  misc_feature (651)..(651): n is a, c, g, or t
  modified_base (653)..(656): a, c, t, g, unknown or other
  misc_feature (653)..(656): n is a, c, g, or t
  modified_base (659)..(672): a, c, t, g, unknown or other
  misc_feature (659)..(672): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaaggccgattccaccacctcagagacaacgccaaagaacacggtgtatctgcagatccatggtctgacagtcgaggacacggcttagttttattactggtagacgaaaggggccgggcggggggaccaaccgacgtagtccgttagggtaacttacgttccgtttggtcgttaccgttgggttacccgaaccgaccggttcgggggacccaaaggggtaacttacgtcgggtacctacccggttcctccgtccacgtcccctaccgaaaccgtaacgggcccctacgttcccggttcccttccccccgtggcccncccgtcgcgttacccgaggtacaccctaccccgtacgaacgacggaccaacggccggcccgcccgttacggggcctaccggtccgtacgggtaacctaacgggtacctttaaccgttccgttaggtaacccggacggtccggttacgtaacgggtcgggcccggggttaacgtcgggtaaccgaacgggtcccgaagtaagtcggangngcgngnnnngngnnnnagnnnnnnnnnnnnnn

SEQ ID NO: 109199 - DNA, 677 bp, Homo sapiens
  misc_feature: GYAE6OF01APZFS.2.80.H03.1.454.CMB.1.raw
  modified_base (633)..(633): a, c, t, g, unknown or other
  misc_feature (633)..(633): n is a, c, g, or t
  modified_base (668)..(668): a, c, t, g, unknown or other
  misc_feature (668)..(668): n is a, c, g, or t
tcagacgctcgacacacgaccggtgctcgatttagctgtgcgtcgaagggaagggctgatgtggtcgcgcgcagtcatattgatgggactgtcacaggctacgggactccgtgaaggccattcaccactcagagacaacgccaagaacacggtgtatctgcagatccagtggtctgacagtcgaggacagtcgcttgtttatacgtgtcgacgaagggcggcggggcactacgtagcgtaggtactgtcctcggttcgtcgttcggtcgacctaccggtgggaccagggtaacttcgtcggttaccgacccgttcctccgtaccgtacgaccccttaacccgaccggtaaccgggtcccctacggtttcccggttacccctttcccccggtcggccccgtacccgtcgtcccgttaccggaacggtcccgtaccgacccgttaccggaaggtaccgacgaaccggtacgggccccggtcccggtggacccgttaccggccgtacggtaccgtaacggtaccttaccgttccgtacgtaccggtacgttccggtacgtagggacccggtcggggtacgtcgggaacggtacgacccgtacgaagtccggatcgcggcgtctcgtgagcgcgacncgtcgcgtccgtgacgtcgtcgtcgtcgtctacgngctgcgtcg

SEQ ID NO: 109200 - DNA, 552 bp, Homo sapiens
  misc_feature: GYAE6OF01DIHSF.2.80.H03.1.454.CMB.1.raw
  modified_base (139)..(139): a, c, t, g, unknown or other
  misc_feature (139)..(139): n is a, c, g, or t
  modified_base (331)..(331): a, c, t, g, unknown or other
  misc_feature (331)..(331): n is a, c, g, or t
  modified_base (372)..(372): a, c, t, g, unknown or other
  misc_feature (372)..(372): n is a, c, g, or t
  modified_base (413)..(413): a, c, t, g, unknown or other
  misc_feature (413)..(413): n is a, c, g, or t
  modified_base (512)..(512): a, c, t, g, unknown or other
  misc_feature (512)..(512): n is a, c, g, or t
  modified_base (532)..(552): a, c, t, g, unknown or other
  misc_feature (532)..(552): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaaggccgattcaccacctcaganacaacgccaagacacggtgtatctgacagatccatggtctgacagtcgaggaccaggcttgtttattactgtgaccggaaggggccgggcgggggcaacacgtagcgttaggtacttacttcccgtggttcgtcgttgggttccgaccgtaccggtggggaccaagggtatacgtgtccaccgtctcctacncgtccctaccaccgaacggccctagtccggtccttccccgnggccctccctcgtcctccgacggacgcctacccgtccgganacgaccgacgacggcccggtcccgtcggcctccggccgtcggtacgaacgtaccttaccgttccgtacgtcgacggtccgtcgtggacggcgggtccgngggacgacggcgacgatcgnnnnnnnnnnnnnnnnnnnnn

SEQ ID NO: 109201 - DNA, 682 bp, Homo sapiens
  misc_feature: GYAE6OF01C397E.2.80.H03.1.454.CMB.1.raw
  modified_base (138)..(138): a, c, t, g, unknown or other
  misc_feature (138)..(138): n is a, c, g, or t
  modified_base (159)..(159): a, c, t, g, unknown or other
  misc_feature (159)..(159): n is a, c, g, or t
  modified_base (183)..(183): a, c, t, g, unknown or other
  misc_feature (183)..(183): n is a, c, g, or t
  modified_base (635)..(635): a, c, t, g, unknown or other
  misc_feature (635)..(635): n is a, c, g, or t
  modified_base (640)..(640): a, c, t, g, unknown or other
  misc_feature (640)..(640): n is a, c, g, or t
  modified_base (642)..(642): a, c, t, g, unknown or other
  misc_feature (642)..(642): n is a, c, g, or t
  modified_base (649)..(649): a, c, t, g, unknown or other
  misc_feature (649)..(649): n is a, c, g, or t
  modified_base (652)..(653): a, c, t, g, unknown or other
  misc_feature (652)..(653): n is a, c, g, or t
  modified_base (663)..(663): a, c, t, g, unknown or other
  misc_feature (663)..(663): n is a, c, g, or t
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
  modified_base (671)..(673): a, c, t, g, unknown or other
  misc_feature (671)..(673): n is a, c, g, or t
  modified_base (676)..(677): a, c, t, g, unknown or other
  misc_feature (676)..(677): n is a, c, g, or t
  modified_base (679)..(679): a, c, t, g, unknown or other
  misc_feature (679)..(679): n is a, c, g, or t
  modified_base (681)..(681): a, c, t, g, unknown or other
  misc_feature (681)..(681): n is a, c, g, or t
tcagacgctcgacacacgaccggtgctcgatttagctgtgcgtcgaaagggaagggctgatgtgggtcgcgcgcagtcatattgatgggactgtcacaggctacggggactccgtgaaggccattcaccacctcaganacaacgccaaagaacacggtntatctgcagatccatggtctgacngtacggaggacacggtcttgtttacttactgtgacgaaggggacggcgggggacacacgtagctggtactctcctgtgtcgtcgttcgacgaccgtgggggacctaaggggaacttacgtcggtccaccccgttcttccctcgacgccctacccgaaccgaaccggggacccctaagtttcccgggttcccctttccccccggtggccccgtccccgttacggccgttacccgaagggacccgtacccgaaccccggtacgaacggtaaccgccgaaccgtaccgggtcccgggtaccccgtcggggtacccgttccggtaccccggtttacgggtaaaccggtaaaccggttacccgttaacccgtttccggtcgggttaaccgaacggttccgttaacgcggtaacgggccgggtacgtacgggaccgtaaggcgtacgaagtacgcagnacgtncngcgactncgnngacgacgcgncncncgannncanngngng

SEQ ID NO: 109202 - DNA, 714 bp, Homo sapiens
  misc_feature: GYAE6OF01B0BO2.2.80.H03.1.454.CMB.1.raw
  modified_base (191)..(191): a, c, t, g, unknown or other
  misc_feature (191)..(191): n is a, c, g, or t
  modified_base (687)..(689): a, c, t, g, unknown or other
  misc_feature (687)..(689): n is a, c, g, or t
  modified_base (691)..(693): a, c, t, g, unknown or other
  misc_feature (691)..(693): n is a, c, g, or t
  modified_base (696)..(714): a, c, t, g, unknown or other
  misc_feature (696)..(714): n is a, c, g, or t
tcagacgctcgacacacgaccggtgctcgatttagctgtgcgtcgaagggaaggggctgatgtgggtcgcgcgcagtcatattgatgggactgtcacaggctacgggggactccgtggaagggccgattccaccacctccagagacaacgccaaagaacacggtgtatctggcagatccagtggtctgacnggtcggaggaccgacgggtcttaggtttattacgtggtcgacggaagggggccggggcggggggaccacacgtaggcgtaggtaacctacgttcccgtcggtagttccgttggggttaccgaaccgtaccgggtaggggggacccaaagggggtaacttaacccggtcgggtacccctaaccccggttccctaccgtccaccgtccccgtacccgaacccggaaccggggtcccctacggttcccgggtttcccccttccccccgggagggtcccccgtccccgtacggccccgtaccgggaacggccggtacccctaacccggtaccggtaacgggacgacccgaccggtaccgggccccgggtccccggtggggtccctggtccccggttagggtaccgaaccggtaaccgtttcccgttacggttcggtaccgtaccggtcggtaccgtacgggaccgggcgggtacggtccggacgacgggccgagactggnnngnnngannnnnnnnnnnnnnnnnnn

SEQ ID NO: 109203 - DNA, 698 bp, Homo sapiens
  misc_feature: GYAE6OF01BMIV3.2.80.H03.1.454.CMB.1.raw
  modified_base (200)..(200): a, c, t, g, unknown or other
  misc_feature (200)..(200): n is a, c, g, or t
  modified_base (650)..(650): a, c, t, g, unknown or other
  misc_feature (650)..(650): n is a, c, g, or t
  modified_base (654)..(654): a, c, t, g, unknown or other
  misc_feature (654)..(654): n is a, c, g, or t
  modified_base (666)..(667): a, c, t, g, unknown or other
  misc_feature (666)..(667): n is a, c, g, or t
  modified_base (672)..(673): a, c, t, g, unknown or other
  misc_feature (672)..(673): n is a, c, g, or t
  modified_base (675)..(675): a, c, t, g, unknown or other
  misc_feature (675)..(675): n is a, c, g, or t
  modified_base (681)..(681): a, c, t, g, unknown or other
  misc_feature (681)..(681): n is a, c, g, or t
  modified_base (685)..(685): a, c, t, g, unknown or other
  misc_feature (685)..(685): n is a, c, g, or t
  modified_base (691)..(691): a, c, t, g, unknown or other
  misc_feature (691)..(691): n is a, c, g, or t
  modified_base (693)..(695): a, c, t, g, unknown or other
  misc_feature (693)..(695): n is a, c, g, or t
tcagacgctcgacacacgaccggtgctcgatttagctgtgcgtcgaaagggaaggggctgatgtgggtcgcgcgcagtcatattgatgggactgtcacaggctacggggactccgtgaggccgattcaccacctccagagacaacgccaaagaacacggtgtattctgacagatccaagtggtctagacaggtcgagacncggtcttgtttattacgtgtcggacggaagggggccgggccggggacgaactaacgtgtcgttacggtaaccttacgttccgtcggttcgttcgttcgggttccgaaccgaccggtcggggaccgtaaggaacttaccgtcggtcccacccgttctcccgtcgacgccctccgaaccggaccggtccctaccggttccgtcccctttcccccggtggtccccgtccccgtcgtcccgtaccgacggaccgtacccgaacccgtccgaagaaccgccgaaacggtaccggcccggcccggttgggtcccgtccggttaccggttacgggtaacccgtaaacggttcccgttaacccgttccgttaggttcccggtaacgggtccgttacggtccgggtaacgggccgggtacgtaccgggtacccggagggccgtacggtaatacggtganccgngcgcgactgacnncacgnncnctgtgnacgncgcgcngnnngac

SEQ ID NO: 109204 - DNA, 830 bp, Homo sapiens
  misc_feature: GYAE6OF01A0LQH.2.80.H03.1.454.CMB.1.raw
  modified_base (181)..(181): a, c, t, g, unknown or other
  misc_feature (181)..(181): n is a, c, g, or t
  modified_base (772)..(772): a, c, t, g, unknown or other
  misc_feature (772)..(772): n is a, c, g, or t
  modified_base (783)..(783): a, c, t, g, unknown or other
  misc_feature (783)..(783): n is a, c, g, or t
  modified_base (788)..(788): a, c, t, g, unknown or other
  misc_feature (788)..(788): n is a, c, g, or t
  modified_base (790)..(790): a, c, t, g, unknown or other
  misc_feature (790)..(790): n is a, c, g, or t
  modified_base (822)..(823): a, c, t, g, unknown or other
  misc_feature (822)..(823): n is a, c, g, or t
  modified_base (825)..(825): a, c, t, g, unknown or other
  misc_feature (825)..(825): n is a, c, g, or t
tcagacgctcgacacacgaccggtgctcgatttagctgtgcgtcgaagggaagggctgatgtgggtcgcgcgcagtcatattgattggactgtcacaggctacggggactccgtgaagggccgattcaccacctccagagacaaccgcaagaacacggtgtatctgcagatccagtggtcngacagtccgaggaccacggtcttgtttattacgtgtagacgtaacggggacgggcgggggccaacgtacgtaggccgttagggtaaccttacttccgtacggttgttaccgttgggtttaccgaaccgtacccggtgggggtaccctaaagggggaaacttacccggttggggtacccctaaccccggttccttaccccgtacgtaaccggtaccccttacccgaaaccccggaacggggtcccctaacggtttccccggggttacccctttcccccgtcggggtccccgtacccccgttcggaccccttaccgggaacgggtaaccgtccccggttaacccccgtaaccgggaaggtaaccccggtacgaaacccgggtccgggtaccccggggttccccgggtcgggggttcctacggggtaccccggttttcggggtaaccgtaaacccggggttaacccgtttaaccggttttaccccggttacgggttaaccccggaccggttacccggttaaccggttcgggaacggggtcccgggtacgggttaccgaccggtaccggtaccgaacgtacggttaagcgtacgntacgctacgcncgtangngcgacgtgcgcgcgacgcgtctcacgtcgacnncngtgcg

SEQ ID NO: 109205 - DNA, 449 bp, Homo sapiens
  misc_feature: GYAE6OF02HG24R.2.80.H03.1.454.CMB.1.raw
  modified_base (438)..(449): a, c, t, g, unknown or other
  misc_feature (438)..(449): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaagggacggcgggggcgacactagctggtactatcctcgtgtctggttcgacacctggggccagggaatactggtcaccgtctcctcagcctccaccaagggcccatcggtcttccccctggcgcccctgctccaggagcacctccgagagcacagcgccctgggctgcctggtcaaggactacttcctgtcgagcgtctgagcgggctggcaaggcgcatagnnnnnnnnnnnn

SEQ ID NO: 109206 - DNA, 443 bp, Homo sapiens
  misc_feature: GYAE6OF02F594E.2.80.H03.1.454.CMB.1.raw
  modified_base (436)..(443): a, c, t, g, unknown or other
  misc_feature (436)..(443): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaagggacggcgggggcacactagctggtactatcctcgtgtctggttcgacacctggggccagggaatactggtcaccgtctcctcagcctccaccaagggcccatcggtcttccccctggcgccctgctccaggagcacctccgagagcacagcggccctgggctgcctggtcaaggctacttcctgtcgagcgtctgagcgggctggcaaggcgcatagnnnnnnnn

SEQ ID NO: 109207 - DNA, 449 bp, Homo sapiens
  misc_feature: GYAE6OF02HTGAU.2.80.H03.1.454.CMB.1.raw
  modified_base (403)..(403): a, c, t, g, unknown or other
  misc_feature (403)..(403): n is a, c, g, or t
  modified_base (438)..(449): a, c, t, g, unknown or other
  misc_feature (438)..(449): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaaggggacggcgggggcgacactagctggtactatcctcgtgtctggttcgacacctggggccagggaatactggtcaccgtctcctcagcctccaccaagggcccatcggtcttcccctggcgccctgctccaggacgcacctccgagagcacagccgccctgggctgcctggtcaggactacttccngtcgagcgtctgagcgggctggcaaggcgcatagnnnnnnnnnnnn

SEQ ID NO: 109208 - DNA, 445 bp, Homo sapiens
  misc_feature: GYAE6OF02HDQYP.2.80.H03.1.454.CMB.1.raw
  modified_base (437)..(445): a, c, t, g, unknown or other
  misc_feature (437)..(445): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgagggcacggctgtttattactgtgcaagggacggcgggggcacactagctggtactatcctcgtgtctggttcgacacctggggccagggatactggtcaccgtctcctcagcctccaccaagggcccatcggtcttccccctggccgccctgctccaggagcacctccgagagcacagcggccctgggctgcctggtcaaggctacttcctgtcgagcgtctgagcgggctgggcaaggcgcatagnnnnnnnnn

SEQ ID NO: 109209 - DNA, 477 bp, Homo sapiens
  misc_feature: GYAE6OF02HV4ZR.2.80.H03.1.454.CMB.1.raw
  modified_base (336)..(336): a, c, t, g, unknown or other
  misc_feature (336)..(336): n is a, c, g, or t
  modified_base (357)..(357): a, c, t, g, unknown or other
  misc_feature (357)..(357): n is a, c, g, or t
  modified_base (462)..(477): a, c, t, g, unknown or other
  misc_feature (462)..(477): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaaggggacggcgggggcgacactagctggtactatcctcgtgtctggttcacacctggggccagggaatactggtcaccgtctcctcagcctccaccaagggcccatccggtccttcccccnggccgcccctgcctccaggcnccaccgtccgagagcacacgccggcccctggggcctcggccttggtcaacggtacctaccgttcctggtcgagcgtctgacgcgggctgggcaacggcgcatagnnnnnnnnnnnnnnnn

SEQ ID NO: 109210 - DNA, 465 bp, Homo sapiens
  misc_feature: GYAE6OF02F7FD9.2.80.H03.1.454.CMB.1.raw
  modified_base (445)..(465): a, c, t, g, unknown or other
  misc_feature (445)..(465): n is a, c, g, or t
tcagacgctcgacacacgaccggtgctcgatttagctgtgcgtcgaagggaaggggctggatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaagggacggcgggggcacactagctggtactatcctcgtgtctggttcgacacctggggccagggaatactggtcaccgtctcctcagcctccaccaagggcccatccggtccttcccccgtgggccgccctgcctccaggacgccacctccgagagcacagccggccctgggctgcctggtcaaggctacttcctgtcgagcgtctgagcggctggcaaggcgcatagnnnnnnnnnnnnnnnnnnnnn

SEQ ID NO: 109211 - DNA, 446 bp, Homo sapiens
  misc_feature: GYAE6OF02GG8K7.2.80.H03.1.454.CMB.1.raw
  modified_base (413)..(413): a, c, t, g, unknown or other
  misc_feature (413)..(413): n is a, c, g, or t
  modified_base (436)..(446): a, c, t, g, unknown or other
  misc_feature (436)..(446): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaaggggacggcgggggcacactagctggtactatcctcgtgtctggttcgacacctggggccagggaatactggtcaccgtctcctcagcctccaccaagggcccatcggtcttccccctggccgccctgctccaggacgcacctccgagacgcacagccgccctgggctgcctgtcaggctactcctgtcgagcgtcngagcgggctggcaggcgcatagnnnnnnnnnnn

SEQ ID NO: 109212 - DNA, 450 bp, Homo sapiens
  misc_feature: GYAE6OF02FV61Q.2.80.H03.1.454.CMB.1.raw
  modified_base (433)..(433): a, c, t, g, unknown or other
  misc_feature (433)..(433): n is a, c, g, or t
  modified_base (439)..(450): a, c, t, g, unknown or other
  misc_feature (439)..(450): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaaggggacggcgggggcgacactagctggtactatcctcgtgtctggttcgacacctggggccagggaatactggtcaccgtctcctcagcctccaccaagggcccatcggtcttccccctggcgcccctgctccaggagcacctccgagagcacagcgccctgggctgcctggtcaaggctacttcctgtcgagcgtctgagcgggctggcaagggcncatagnnnnnnnnnnnn

SEQ ID NO: 109213 - DNA, 472 bp, Homo sapiens
  misc_feature: GYAE6OF02IYPH9.2.80.H03.1.454.CMB.1.raw
  modified_base (343)..(343): a, c, t, g, unknown or other
  misc_feature (343)..(343): n is a, c, g, or t
  modified_base (372)..(372): a, c, t, g, unknown or other
  misc_feature (372)..(372): n is a, c, g, or t
  modified_base (420)..(420): a, c, t, g, unknown or other
  misc_feature (420)..(420): n is a, c, g, or t
  modified_base (449)..(472): a, c, t, g, unknown or other
  misc_feature (449)..(472): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaagggcggcgggggcacactagctggtactatccgtcgtgttctggttcgacaccgtggggccagggaatactggtcaccgtctcctcacgcctccaccgaagggcccatcggtccttccccctggccnccctgcctccaggacgccactccgagacncacagcggccctgggctcgcctggtcaaggtctactctgtcgagcgtntgagcgggctgggacacgggcacagtagnnnnnnnnnnnnnnnnnnnnnnnn

SEQ ID NO: 109214 - DNA, 515 bp, Homo sapiens
  misc_feature: GYAE6OF02H1W5S.2.80.H03.1.454.CMB.1.raw
  modified_base (370)..(370): a, c, t, g, unknown or other
  misc_feature (370)..(370): n is a, c, g, or t
  modified_base (499)..(515): a, c, t, g, unknown or other
  misc_feature (499)..(515): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaaagaacacggtgtatctgcagatccatggtctgacagtcgaggacacggctgtttattactgtgcaagggacggcgggggcacactagctggtactatcctcgtgtcttggttcgacaccgtggggaccagggtaatacgtggtcacccgtctccctcacgccctccaccaagggccccagtccggtccttcccccgtggccgcccctgcctccgaggcnccacctccgagacgcacacgccggccctggggcctcggcccttgggtaccaacgggtacccttacgtttcccgtggtccgtaggtccgtcgtggacgggtccgggcgttgggacgaagggcgcagtagnnnnnnnnnnnnnnnnn

SEQ ID NO: 109215 - DNA, 483 bp, Homo sapiens
  misc_feature: GYAE6OF02F6ESY.2.80.H03.1.454.CMB.1.raw
  modified_base (332)..(332): a, c, t, g, unknown or other
  misc_feature (332)..(332): n is a, c, g, or t
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
  modified_base (411)..(411): a, c, t, g, unknown or other
  misc_feature (411)..(411): n is a, c, g, or t
  modified_base (453)..(453): a, c, t, g, unknown or other
  misc_feature (453)..(453): n is a, c, g, or t
  modified_base (456)..(458): a, c, t, g, unknown or other
  misc_feature (456)..(458): n is a, c, g, or t
  modified_base (460)..(483): a, c, t, g, unknown or other
  misc_feature (460)..(483): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaaggggacggcgggggcacactagctggtactatcctcgtgtctggttcgacacctggggccagggaatactggtcaccgtctcctcagcctccaccaaggccatcggtcttcccccngccgccctgctccaggacgcacctccgagcgcacagcgcccngggctgcctgcaaggctacttccgngtcgacgcgtcnggacggcgggctgggaccgtaaacgggcgaccaagttacggnagnnngnnnnnnnnnnnnnnnnnnnnnnnn

SEQ ID NO: 109216 - DNA, 617 bp, Homo sapiens
  misc_feature: GYAE6OF02JVO6B.2.80.H03.1.454.CMB.1.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (580)..(580): a, c, t, g, unknown or other
  misc_feature (580)..(580): n is a, c, g, or t
  modified_base (598)..(598): a, c, t, g, unknown or other
  misc_feature (598)..(598): n is a, c, g, or t
  modified_base (600)..(617): a, c, t, g, unknown or other
  misc_feature (600)..(617): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcacacctccagagacaacgccaagaacacggtgtatctgcagatccatggtctgacagtcgagacacggctgtttattacngtgcaagggacggngggggcacactaggctgggtactatccgtcgtcgtcgtggtttcgacaccgttcggggccaggggtaatacgtgggtaccaccgttccgtcccgtccaggccccttaccaccggtaacgggccccgtagtccggttcccttacccccgtgggccccgtcccctcggccgttccccgaacggtcgtcccaccgtcccggaacgacgtcccagaccgaccgggccccgtacggggcctacggtcccgttcgggttaccgaaacgggtacccttaacgtttcccggtacgtcggttaaccggcggttcctacgggcggtaccgggccgttacgggacgaacgggcctggaccgtaggtccngaccgtgccagctgacgncnnnnnnnnnnnnnnnnnn

SEQ ID NO: 109217 - DNA, 541 bp, Homo sapiens
  misc_feature: GYAE6OF02IDFJE.2.80.H03.1.454.CMB.1.raw
  modified_base (372)..(372): a, c, t, g, unknown or other
  misc_feature (372)..(372): n is a, c, g, or t
  modified_base (515)..(541): a, c, t, g, unknown or other
  misc_feature (515)..(541): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgagacacggctgtttatactgtgcaagggacggcgggggcgacacgtagctggtactatcctcgtgtctggttcgacaccgtggggccagggaatacgtggtcaccgtctccctcagccctccaccgaacgggccccagtccggttccttccccccgtgggccgtcccctggcctcccgaggcnccaccctccgagacgcaacgacgccgcccgtggggcctggcccgtgggtacaacggtaccttacctttccgtcgttcggaacggtcgtccgttcggacggtcggggtccgtcgggtaccgaagggtccgacgaattagactgnnnnnnnnnnnnnnnnnnnnnnnnnnn

SEQ ID NO: 109218 - DNA, 468 bp, Homo sapiens
  misc_feature: GYAE6OF02FIGAL.2.80.H03.1.454.CMB.1.raw
  modified_base (355)..(355): a, c, t, g, unknown or other
  misc_feature (355)..(355): n is a, c, g, or t
  modified_base (447)..(447): a, c, t, g, unknown or other
  misc_feature (447)..(447): n is a, c, g, or t
  modified_base (449)..(468): a, c, t, g, unknown or other
  misc_feature (449)..(468): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaagggacggcgggggcacactagctggtactatcctcgtgtctggttcgacacctggggccagggaatactggtcaccgtctcctcagcctccaccaagggccccatccggtcttccccctggccgccctgcctccaggancacctccgagagcacaggccggccctgggctgcctggtcaaggactacctcctgtccgagccgtctgacgcggggctggcaaggcgcatagnannnnnnnnnnnnnnnnnnnn

SEQ ID NO: 109219 - DNA, 457 bp, Homo sapiens
  misc_feature: GYAE6OF02H0DI1.2.80.H03.1.454.CMB.1.raw
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (434)..(457): a, c, t, g, unknown or other
  misc_feature (434)..(457): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcacacctccagagacaacgcaagaacacggtgtatctgcagatccatggtctgacagtcgaggacacggctgtttattactgtgcgaagggcggcgggggcacactagctggtactatcctgtgtctggttcgacaccgtggggccagggaatactggtcaccgtctcctcagcctccaccgaagggtccatcggtcttccccnggcnccctgctccaggngcacctcgagngcacgngcgccctgggctgcctggcaaggactacgttctgtcgagcgtctgagcgggtctggcaaggcgcagtgnnnnnnnnnnnnnnnnnnnnnnnn

SEQ ID NO: 109220 - DNA, 582 bp, Homo sapiens
  misc_feature: GYAE6OF02HHDB2.2.80.H03.1.454.CMB.1.raw
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
  modified_base (556)..(557): a, c, t, g, unknown or other
  misc_feature (556)..(557): n is a, c, g, or t
  modified_base (563)..(564): a, c, t, g, unknown or other
  misc_feature (563)..(564): n is a, c, g, or t
  modified_base (567)..(567): a, c, t, g, unknown or other
  misc_feature (567)..(567): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(577): a, c, t, g, unknown or other
  misc_feature (576)..(577): n is a, c, g, or t
  modified_base (579)..(579): a, c, t, g, unknown or other
  misc_feature (579)..(579): n is a, c, g, or t
  modified_base (581)..(582): a, c, t, g, unknown or other
  misc_feature (581)..(582): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccattcaccacctcagagacaacgccaagaacacggtgtatctgcagatccatggtctgacagtcgaggacacggctgtttatactgtgcaagggcgcggggcacactagctggtactntcctgtgtctggttcgacnccgtgggccagggatacgtggtcaccgtctcctcacgccctccgaccgaacggcccagttccggtcctttccccgtggacccgtcccctggcctaccgacggacgccacccgtccggaacgcgaccaaccgacggcccgggaccccgttggggaccttcgggtcccgttgggtaccaaaggggtacccttaacgttttcccgtaggtccggacgtccgttcgtaggacggtcggggtaccttagggccgaaaggggccgaccgtaagtacggcgacgtcncngcgngcgngcgcgcnngcgtcnncgngcngncncnncngnn

SEQ ID NO: 109221 - DNA, 518 bp, Homo sapiens
  misc_feature: GYAE6OF02JGOQW.2.80.H03.1.454.CMB.1.raw
  modified_base (354)..(354): a, c, t, g, unknown or other
  misc_feature (354)..(354): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (490)..(491): a, c, t, g, unknown or other
  misc_feature (490)..(491): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (498)..(500): a, c, t, g, unknown or other
  misc_feature (498)..(500): n is a, c, g, or t
  modified_base (502)..(502): a, c, t, g, unknown or other
  misc_feature (502)..(502): n is a, c, g, or t
  modified_base (504)..(506): a, c, t, g, unknown or other
  misc_feature (504)..(506): n is a, c, g, or t
  modified_base (508)..(510): a, c, t, g, unknown or other
  misc_feature (508)..(510): n is a, c, g, or t
  modified_base (512)..(518): a, c, t, g, unknown or other
  misc_feature (512)..(518): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaagggacggcggggcacactagctggtactatcctgtgtctggttcgacacctggggccagggatacgtggtcaccgtctcctcagcctccaccaagggccccagtccggtccttccccgtggccgccctgcctcacggnccacctccgagagccacagccgccctgggctgccgtggtcaaggtacttaccttccgtggtaccgagtccgtcgtcggaggccgggtcgtacgggacgaaacgggtccgacgtaacgttaacggngngngngngcnngcngngnnngngnnngnnncnnnnnnn

SEQ ID NO: 109222 - DNA, 526 bp, Homo sapiens
  misc_feature: GYAE6OF02GU85L.2.80.H03.1.454.CMB.1.raw
  modified_base (495)..(495): a, c, t, g, unknown or other
  misc_feature (495)..(495): n is a, c, g, or t
  modified_base (497)..(499): a, c, t, g, unknown or other
  misc_feature (497)..(499): n is a, c, g, or t
  modified_base (501)..(502): a, c, t, g, unknown or other
  misc_feature (501)..(502): n is a, c, g, or t
  modified_base (505)..(526): a, c, t, g, unknown or other
  misc_feature (505)..(526): n is a, c, g, or t
tcagacgctcgacacacgaccggtgctcgatttagctgtgcgtcgaaagggaaggggctgatgtgggtcgcgcgcagtcatattgatgggactgtcacaggctacggggactccgtgaagggccgattcaccacctccagagacaacgccaaagaacacggtgtatctgcagatccatggtctgacagtcgaggacacggctgtttattactgtgcaaagggacggcgggggcacactagctggtactatcctgtgtctggttcgacaccgtggggccagggaatactggtcaccgtctcctcacgccctccaccaacgggcccagtccgtccttccccccgtggcccgtccctcgcctcccgaacggacgtccaaccctccggagacgtccacgacgcccgggcccgtgggcctcgcccgtggtacggacgtactttcctggtcgacgtcgttcgtgacggtcgggcgtcgggacgtaaggccgtacgagtagngnnngnnagnnnnnnnnnnnnnnnnnnnnnn

SEQ ID NO: 109223 - DNA, 510 bp, Homo sapiens
  misc_feature: GYAE6OF02G49ZB.2.80.H03.1.454.CMB.1.raw
  modified_base (313)..(313): a, c, t, g, unknown or other
  misc_feature (313)..(313): n is a, c, g, or t
  modified_base (357)..(357): a, c, t, g, unknown or other
  misc_feature (357)..(357): n is a, c, g, or t
  modified_base (393)..(393): a, c, t, g, unknown or other
  misc_feature (393)..(393): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (481)..(485): a, c, t, g, unknown or other
  misc_feature (481)..(485): n is a, c, g, or t
  modified_base (487)..(491): a, c, t, g, unknown or other
  misc_feature (487)..(491): n is a, c, g, or t
  modified_base (493)..(495): a, c, t, g, unknown or other
  misc_feature (493)..(495): n is a, c, g, or t
  modified_base (497)..(510): a, c, t, g, unknown or other
  misc_feature (497)..(510): n is a, c, g, or t
tcagacgctcgacacacgaccggtgctcgatttagctgtgcgtcgaaggggaagggggctgatgtgggtcgcgcgcagtcatattgatgggactgtcacaggctacggggactccgtgaaggccgattcacacctcagagacaacgccaagaacacggtgtatctgcagatccatggtctgacaggtcgaggacacggtcttgtttattacgtgtaggacgaaggggacgggcgggggacacacgtagcgtggtactatcctgtgtcgtggtcactacggtcggggccagggtatacgtggcctacgtctccnacgccctaccgaaccgaacggccctagtccggtcccttccccgnggtccgcctacgcctcgaggacacaccgtcgagacncagacggcgccgtgggactcgcgtgtacgacgtactcgtcgtagcgtagtcgtacgtggacggcggtcgtgacgacgcganagngngnnnnngnnnnngnnngnnnnnnnnnnnnnn

SEQ ID NO: 109224 - DNA, 473 bp, Homo sapiens
  misc_feature: GYAE6OF02FQB7R.2.80.H03.1.454.CMB.1.raw
  modified_base (343)..(343): a, c, t, g, unknown or other
  misc_feature (343)..(343): n is a, c, g, or t
  modified_base (432)..(432): a, c, t, g, unknown or other
  misc_feature (432)..(432): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
  modified_base (459)..(473): a, c, t, g, unknown or other
  misc_feature (459)..(473): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaaagaacacggtgtatctgcagatccatggtctgacagtcgaggacacggcttgtttattactgtgcaaggggacgggcgggggcacacgtagctggtactatcctgtgtctggttcgacacctggggccagggatactggtcaccgtctcctcagcctccaccaagggcccatccggtcttcccccgtggccncccctgcctccgaggacgcacctccgagagcacacgcggcccgtgggcctcgccgtggtcaaggctacttcctgtcgagtcgtctcggngcgggctgggcacgggcncagtagnannnnnnnnnnnnnnn

SEQ ID NO: 109225 - DNA, 581 bp, Homo sapiens
  misc_feature: GYAE6OF02H1I5O.2.80.H03.1.454.CMB.1.raw
  modified_base (229)..(229): a, c, t, g, unknown or other
  misc_feature (229)..(229): n is a, c, g, or t
  modified_base (375)..(375): a, c, t, g, unknown or other
  misc_feature (375)..(375): n is a, c, g, or t
  modified_base (542)..(542): a, c, t, g, unknown or other
  misc_feature (542)..(542): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (560)..(580): a, c, t, g, unknown or other
  misc_feature (560)..(580): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcaccacctccagagacaacgccaaagaacacggtgtatctgcagactccatggtctgacagtcgaggacacggcttgtttatactgtgacgaaggggcgggnggggcacacgtagcgtggtactctcctggtgttctggttaccaccacggtggggaccaagggtacttacgtcggtacctacccgttctccctcgacgtcccctaccgaaccggaaccgggcctacggttccgttccccttccccgnggacccgtcccctgcccctacgaacggacgtccctaccgtacggacgacaccgacgacggtcccggccgtacgggctcggcccgttaggtaccgaacggttaccttaccgtttcccgtggtacggcggtccgtcgtacggcgggcggtcgtaggacctaagggcctnaacggtncnacgncgncnnnnnnnnnnnnnnnnnnnnnc

SEQ ID NO: 109226 - DNA, 671 bp, Homo sapiens
  misc_feature: GYAE6OF02GP9JW.2.80.H03.1.454.CMB.1.raw
  modified_base (621)..(621): a, c, t, g, unknown or other
  misc_feature (621)..(621): n is a, c, g, or t
  modified_base (643)..(643): a, c, t, g, unknown or other
  misc_feature (643)..(643): n is a, c, g, or t
  modified_base (645)..(645): a, c, t, g, unknown or other
  misc_feature (645)..(645): n is a, c, g, or t
  modified_base (653)..(653): a, c, t, g, unknown or other
  misc_feature (653)..(653): n is a, c, g, or t
  modified_base (660)..(660): a, c, t, g, unknown or other
  misc_feature (660)..(660): n is a, c, g, or t
  modified_base (666)..(669): a, c, t, g, unknown or other
  misc_feature (666)..(669): n is a, c, g, or t
tcagacgctcgacacacgaccggtgctcgatttagctgtgcgtcgaagggaaggggctgatgtgggtcgcgcgcagtcatattgatgggactgtcacaggctacgggactccgtgaagggccgattcaccacctccagagacaacgccaagaacacggtgtatctgcagatccatggtctgacagtcgagacacggctgtttattactgtgcgaagggacggcgggggcaacacgtacgctaggtactactccgtcgtgtcgtggttcgaccaccgtggggaccaagggtaactacgtggtccaccggttcctcctcgacgccctaccgaaccgaacgggccccaacgttccggttcccctttcccccgtgggccccgtcccccttacggccccttaccggaacggtaccgacctaaccccggtccggaaggaccgaccgaaccggaaccggcccggaccccggttcggggccctcgggtccccgttaggggttaacccgaaacgggttaacccttaccggttttcccgtagggttaccgtacgggtccgtttccgacgggtccgggccggggttccgtacgggtaaccggaacgggcccgtacgtaaagttcggactggngagcgcgacgcgcgcgacgcgngngcgcgcgngcgagangcgctnnnncg

SEQ ID NO: 109227 - DNA, 489 bp, Homo sapiens
  misc_feature: GYAE6OF02HZEXY.2.80.H03.1.454.CMB.1.raw
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (469)..(470): a, c, t, g, unknown or other
  misc_feature (469)..(470): n is a, c, g, or t
  modified_base (472)..(489): a, c, t, g, unknown or other
  misc_feature (472)..(489): n is a, c, g, or t
tcagacgctcgacacacgaccggtgctcgatttagctgtgcgtcgaagggaaggggctgatgtgggtcgcgcgcagtcatattgatgggactgtcacaggctacggggactccgtgaagggccgattcacacctccagagacaacgccaagaacacggtgtatctgcagatccatggtctgacagtcgaggacacggctgtttattactgtgcaaggggcggcgggggcacactagctggtactatccgtgtgtctggttcacaccgtggggccaagggaatacgtggtcaccgtctcctcagcctccaccaagggcccatccggtccttcccccgtggccgccctgcctccgaggcnccacccgtcgagcgcacncggccggccctgggcctgccgtgggtacaacgggtccttaccgttccgtgtcgagtcgtctggacggcgggtctgggacaagggcgcagtagnngnnnnnnnnnnnnnnnnnn

SEQ ID NO: 109228 - DNA, 559 bp, Homo sapiens
  misc_feature: GYAE6OF02HZDUI.2.80.H03.1.454.CMB.1.raw
  modified_base (141)..(141): a, c, t, g, unknown or other
  misc_feature (141)..(141): n is a, c, g, or t
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (387)..(387): a, c, t, g, unknown or other
  misc_feature (387)..(387): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
  modified_base (527)..(530): a, c, t, g, unknown or other
  misc_feature (527)..(530): n is a, c, g, or t
  modified_base (532)..(533): a, c, t, g, unknown or other
  misc_feature (532)..(533): n is a, c, g, or t
  modified_base (535)..(535): a, c, t, g, unknown or other
  misc_feature (535)..(535): n is a, c, g, or t
  modified_base (540)..(541): a, c, t, g, unknown or other
  misc_feature (540)..(541): n is a, c, g, or t
  modified_base (545)..(545): a, c, t, g, unknown or other
  misc_feature (545)..(545): n is a, c, g, or t
  modified_base (548)..(549): a, c, t, g, unknown or other
  misc_feature (548)..(549): n is a, c, g, or t
  modified_base (551)..(551): a, c, t, g, unknown or other
  misc_feature (551)..(551): n is a, c, g, or t
  modified_base (553)..(554): a, c, t, g, unknown or other
  misc_feature (553)..(554): n is a, c, g, or t
  modified_base (556)..(556): a, c, t, g, unknown or other
  misc_feature (556)..(556): n is a, c, g, or t
  modified_base (558)..(559): a, c, t, g, unknown or other
  misc_feature (558)..(559): n is a, c, g, or t
tcagacgctcgacacacgaccggtgctcgatttagctgtgcgtcgaagggaaggggctgatgtgggtcgcgcgcagtcataattgatgggactgtcacaggctacggggactccgtggaaggccgattcaccacctccagngaacaacgccaaagaacacggtgtatctgacagatccatggtctgacagtcgaggacacggcttgttttatactgtgcgaagggcggcgggggcaacncgtagctgtactntcctgtntcgtgttccgacnccgtgggccaggtaatcgtcgtcaccgtctccgtcacgtccctaccgaccgacggcccngtcccgttccctcccgngccgcctgcctaccgnggaccnccgtcccgtagacgacncgacgaccgccgtacccgtggcctcgggccgttagacgtaacgtccttacgttccgtgtacgtcgtcgtcgtacggacggtccggtcggtacggtaccggacgttaccgacgtacggttaagcgtagngtcgtncgacgnnnncnncncgtcnngcgngtnncncnngngnn

SEQ ID NO: 109229 - DNA, 149 bp, Homo sapiens
  misc_feature: GYAE6OF01AE96H.51.45.E01.1.454.CMB.1.raw
tcagcgatcgtatacacgaccggtgctcgatttagtgagtcagtaagggaaggacacgactggagattaaacgaactgtggctgcaccatctgtcttcatcttccgccatctgatcgtagcactctgagcgggctggcaaggcgcatag

SEQ ID NO: 109230 - DNA, 115 bp, Homo sapiens
  misc_feature: GYAE6OF01CHW5A.51.45.E01.1.454.CMB.1.raw
  modified_base (115)..(115): a, c, t, g, unknown or other
  misc_feature (115)..(115): n is a, c, g, or t
tcagcgatcgtatacacgaccggtgctcgatttagtgagtcagtaagggaaggcagcgtcactctgttcccaccctcctctcgtagcactctgagcggctggcaaggcgcatagn

SEQ ID NO: 109231 - DNA, 153 bp, Homo sapiens
  misc_feature: GYAE6OF01AVBDD.51.45.E01.1.454.CMB.1.raw
  modified_base (153)..(153): a, c, t, g, unknown or other
  misc_feature (153)..(153): n is a, c, g, or t
tcagcgatcgtatacacgaccggtgctcgatttagtgagtcagtaagggaagggacacgactggagattaaacgaactgtggctgcaccatctgtcttcatcttcccgccatctgatcgtagcacttctgagcgggctggcaaggcgcatagn

SEQ ID NO: 109232 - DNA, 114 bp, Homo sapiens
  misc_feature: GYAE6OF01B6CEW.51.45.E01.1.454.CMB.1.raw
  modified_base (114)..(114): a, c, t, g, unknown or other
  misc_feature (114)..(114): n is a, c, g, or t
tcagcgatcgtatacacgaccggtgctcgatttagtgagtcagtaaggaaggcagcgtcactctgttcccgccctcctctcgtagcactctgagcggctggcaaggcgcatagn

SEQ ID NO: 109233 - DNA, 159 bp, Homo sapiens
  misc_feature: GYAE6OF01B6FYL.51.45.E01.1.454.CMB.1.raw
  modified_base (153)..(159): a, c, t, g, unknown or other
  misc_feature (153)..(159): n is a, c, g, or t
tcagcgatcgtatacacgaccggtgctcgatttagtgagtcagtaagggaaagggacacgactggagattaaacgaactgtggctgcaccatctgtcttcatcttcccgccatctgatcgtagcactctgagcgggctggcaaggcgcatagnnnnnnn

SEQ ID NO: 109234 - DNA, 118 bp, Homo sapiens
  misc_feature: GYAE6OF01A4WAP.51.45.E01.1.454.CMB.1.raw
  modified_base (118)..(118): a, c, t, g, unknown or other
  misc_feature (118)..(118): n is a, c, g, or t
tcagcgatcgtatacacgaccggtgctcgatttagtgagtcagtaagggaaagggcagcgtcactctgttcccaccctcctctcgtagcactctgagcgggctggcaaggcgcatagn

SEQ ID NO: 109235 - DNA, 134 bp, Homo sapiens
  misc_feature: GYAE6OF01EF7JD.51.45.E01.1.454.CMB.1.raw
  modified_base (116)..(134): a, c, t, g, unknown or other
  misc_feature (116)..(134): n is a, c, g, or t
tcagcgatcgtatacacgaccggtgctcgatttagtgagtcagtaagggaaagggcagcgtcactctgttcccgcctcctctcgtagcactctgagcggctggcaaggcgcatagnnnnnnnnnnnnnnnnnnn

SEQ ID NO: 109236 - DNA, 153 bp, Homo sapiens
  misc_feature: GYAE6OF01DVXUS.51.45.E01.1.454.CMB.1.raw
  modified_base (153)..(153): a, c, t, g, unknown or other
  misc_feature (153)..(153): n is a, c, g, or t
tcagcgatcgtatacacgaccggtgctcgatttagtgagtcagtaagggaaagggacacgactggagattaaacgaactgtggctgcaccatctgtcttcatcttcccgccatctgatcgtagcactctgagcgggctggcaaggcgcatagn

SEQ ID NO: 109237 - DNA, 175 bp, Homo sapiens
  misc_feature: GYAE6OF01AFIO2.51.45.E01.1.454.CMB.1.raw
  modified_base (155)..(175): a, c, t, g, unknown or other
  misc_feature (155)..(175): n is a, c, g, or t
tcagcgatcgtatacacgaccggtgctcgatttagtgagtcagtaagggaaagggacacgacgtggagattaaacgaactgtggctgcaccatctgtcttcatcttcccgccatctgatcgtagcactctgagcgggctggcaagggcgcatagnnnnnnnnnnnnnnnnnnnnn

SEQ ID NO: 109238 - DNA, 153 bp, Homo sapiens; identical to SEQ ID NO: 109236
  misc_feature: GYAE6OF01EKCCU.51.45.E01.1.454.CMB.1.raw
  modified_base (153)..(153): a, c, t, g, unknown or other
  misc_feature (153)..(153): n is a, c, g, or t

SEQ ID NO: 109239 - DNA, 153 bp, Homo sapiens; identical to SEQ ID NO: 109236
  misc_feature: GYAE6OF01AHI7B.51.45.E01.1.454.CMB.1.raw
  modified_base (153)..(153): a, c, t, g, unknown or other
  misc_feature (153)..(153): n is a, c, g, or t

SEQ ID NO: 109240 - DNA, 153 bp, Homo sapiens; identical to SEQ ID NO: 109236
  misc_feature: GYAE6OF01BMTS2.51.45.E01.1.454.CMB.1.raw
  modified_base (153)..(153): a, c, t, g, unknown or other
  misc_feature (153)..(153): n is a, c, g, or t

SEQ ID NO: 109241 - DNA, 152 bp, Homo sapiens
  misc_feature: GYAE6OF01BVVLE.51.45.E01.1.454.CMB.1.raw
  modified_base (152)..(152): a, c, t, g, unknown or other
  misc_feature (152)..(152): n is a, c, g, or t
tcagcgatcgtatacacgaccggtgctcgatttagtgagtcagtaagggaaagggacacgactggagattaaacgaactgtggctgcaccatctgtcttcatcttcccgccatctgatcgtagcactctgagcggctggcaaggcgcatagn

SEQ ID NO: 109242 - DNA, 152 bp, Homo sapiens
  misc_feature: GYAE6OF01DVZ50.51.45.E01.1.454.CMB.1.raw
tcagcgatcgtatacacgaccggtgctcgatttagtgagtcagtaagggaaagggacacgactggagattaaacgaactgtggctgcaccatctgtcttcatcttcccgccatctgatcgtagcactctgagcgggctggcaaggcgcatag

SEQ ID NO: 109243 - DNA, 154 bp, Homo sapiens
  misc_feature: GYAE6OF01EC9Y7.51.45.E01.1.454.CMB.1.raw
  modified_base (153)..(154): a, c, t, g, unknown or other
  misc_feature (153)..(154): n is a, c, g, or t
tcagcgatcgtatacacgaccggtgctcgatttagtgagtcagtaagggaaagggacacgactggagattaaacgaactgtggctgcaccatctgtcttcatcttcccgccatctgatcgtagcactctgagcgggctggcaaggcgcatagnn

SEQ ID NO: 109244 - DNA, 169 bp, Homo sapiens
  misc_feature: GYAE6OF01BLML6.51.45.E01.1.454.CMB.1.raw
  modified_base (155)..(169): a, c, t, g, unknown or other
  misc_feature (155)..(169): n is a, c, g, or t
tcagcgatcgtatacacgaccggtgctcgatttagtgagtcagtaagggaaaggggacacgactggagattaaacgaactgtggctgcaccatctgtcttcatcttcccgccatctgatcgtagcactctgagcgggctgggcaaggcgcatagnnnnnnnnnnnnnnn

SEQ ID NO: 109245 - DNA, 171 bp, Homo sapiens
  misc_feature: GYAE6OF01EJ152.51.45.E01.1.454.CMB.1.raw
  modified_base (154)..(171): a, c, t, g, unknown or other
  misc_feature (154)..(171): n is a, c, g, or t
tcagcgatcgtatacacgaccggtgctcgatttagtgagtcagtaagggaaagggacgacgactggagattaaacgaactgtggctgcaccatctgtcttcatcttcccgccatctgatcgtagcactctgagcgggctggcaaggcgcatagnnnnnnnnnnnnnnnnnn

SEQ ID NO: 109246 - DNA, 155 bp, Homo sapiens
  misc_feature: GYAE6OF01BU72V.51.45.E01.1.454.CMB.1.raw
  modified_base (153)..(155): a, c, t, g, unknown or other
  misc_feature (153)..(155): n is a, c, g, or t
tcagcgatcgtatacacgaccggtgctcgatttagtgagtcagtaagggaaagggacacgactggagattaaacgaactgtggctgcaccatctgtcttcatcttcccgccatctgatcgtagcactctgagcgggctggcaaggcgcatagnnn

SEQ ID NO: 109247 - DNA, 168 bp, Homo sapiens
  misc_feature: GYAE6OF01B1LKI.51.45.E01.1.454.CMB.1.raw
  modified_base (128)..(128): a, c, t, g, unknown or other
  misc_feature (128)..(128): n is a, c, g, or t
  modified_base (147)..(147): a, c, t, g, unknown or other
  misc_feature (147)..(147): n is a, c, g, or t
  modified_base (154)..(168): a, c, t, g, unknown or other
  misc_feature (154)..(168): n is a, c, g, or t
tcagcgatcgtatacacgaccggtgctcgatttagtgagtcagtaagggaaagggacacgactggagattaaacgaactgtggctgcaccatctgtcttcatcttcccgccatctgatcgtagcactntgagcgggctggcaaggcncaatgcnnnnnnnnnnnnnnn

SEQ ID NO: 109248 - DNA, 155 bp, Homo sapiens; identical to SEQ ID NO: 109246
  misc_feature: GYAE6OF01D79R5.51.45.E01.1.454.CMB.1.raw
  modified_base (153)..(155): a, c, t, g, unknown or other
  misc_feature (153)..(155): n is a, c, g, or t

SEQ ID NO: 109249 - DNA, 140 bp, Homo sapiens
  misc_feature: GYAE6OF01AWKTV.51.45.E01.1.454.CMB.1.raw
  modified_base (121)..(140): a, c, t, g, unknown or other
  misc_feature (121)..(140): n is a, c, g, or t
tcagcgatcgtatacacgaccggtgctcgatttagtgagtcagtaagggaaagggtcgaggcgtcactctgttcccgccctcctctcgtagcactctgagcgggctggcaaggcgcatagnnnnnnnnnnnnnnnnnnnn

SEQ ID NO: 109250 - DNA, 152 bp, Homo sapiens; identical to SEQ ID NO: 109242
  misc_feature: GYAE6OF01D54EU.51.45.E01.1.454.CMB.1.raw

SEQ ID NO: 109251 - DNA, 166 bp, Homo sapiens
  misc_feature: GYAE6OF01BJXPU.51.45.E01.1.454.CMB.1.raw
  modified_base (154)..(166): a, c, t, g, unknown or other
  misc_feature (154)..(166): n is a, c, g, or t
tcagcgatcgtatacacgaccggtgctcgatttagtgagtcagtaagggaaagggacgacgactggagattaaacgaactgtggctgcaccatctgtcttcatcttcccgccatctgatcgtagcactctgagcgggctggcaaggcgcatagnnnnnnnnnnnnn

SEQ ID NO: 109252 - DNA, 119 bp, Homo sapiens
  misc_feature: GYAE6OF01EYC9O.51.45.E01.1.454.CMB.1.raw
  modified_base (118)..(119): a, c, t, g, unknown or other
  misc_feature (118)..(119): n is a, c, g, or t
tcagcgatcgtatacacgaccggtgctcgatttagtgagtcagtaagggaaagggcagcgtcactctgttcccgccctcctctcgtagcactctgagcgggctggcaaggcgcatagnn

SEQ ID NO: 109253 - DNA, 157 bp, Homo sapiens
  misc_feature: GYAE6OF01A21OC.51.45.E01.1.454.CMB.1.raw
  modified_base (153)..(157): a, c, t, g, unknown or other
  misc_feature (153)..(157): n is a, c, g, or t
tcagcgatcgtatacacgaccggtgctcgatttagtgagtcagtaagggaaagggacacgactggagattaaacgaactgtggctgcaccatctgtcttcatcttcccgccatctgatcgtagcactctgagcgggctggcaaggcgcatagnnnnn

SEQ ID NO: 109254 - DNA, 154 bp, Homo sapiens; identical to SEQ ID NO: 109243
  misc_feature: GYAE6OF01BKJ22.51.45.E01.1.454.CMB.1.raw
  modified_base (153)..(154): a, c, t, g, unknown or other
  misc_feature (153)..(154): n is a, c, g, or t

SEQ ID NO: 109255 - DNA, 135 bp, Homo sapiens
  misc_feature: GYAE6OF01DGHB7.51.45.E01.1.454.CMB.1.raw
  modified_base (117)..(118): a, c, t, g, unknown or other
  misc_feature (117)..(118): n is a, c, g, or t
  modified_base (120)..(135): a, c, t, g, unknown or other
  misc_feature (120)..(135): n is a, c, g, or t
tcagcgatcgtatacacgaccggtgctcgatttagtgagtcagtaagggaaagggcagcgtcactctgttcccaccctcctctcgtagcactctgagcggctggcaaggcgcatagnncnnnnnnnnnnnnnnnn

SEQ ID NO: 109256 - DNA, 151 bp, Homo sapiens
  misc_feature: GYAE6OF02IFMQP.51.45.E01.1.454.CMB.1.raw
  modified_base (151)..(151): a, c, t, g, unknown or other
  misc_feature (151)..(151): n is a, c, g, or t
tcagcgatcgtatacacgaccggtgctcgatttagtgagtcagtaagggaaagggacacgactggagattaaacgaactgtggctgcaccatctgtcttcatcttccgccatctgatcgtagcactctgagcggctggcaaggcgcatagn

SEQ ID NO: 109257 - DNA, 155 bp, Homo sapiens; identical to SEQ ID NO: 109246
  misc_feature: GYAE6OF02IEOTO.51.45.E01.1.454.CMB.1.raw
  modified_base (153)..(155): a, c, t, g, unknown or other
  misc_feature (153)..(155): n is a, c, g, or t

SEQ ID NO: 109258 - DNA, 153 bp, Homo sapiens; identical to SEQ ID NO: 109236
  misc_feature: GYAE6OF02IMXOQ.51.45.E01.1.454.CMB.1.raw
  modified_base (153)..(153): a, c, t, g, unknown or other
  misc_feature (153)..(153): n is a, c, g, or t

SEQ ID NO: 109259 - DNA, 154 bp, Homo sapiens; identical to SEQ ID NO: 109243
  misc_feature: GYAE6OF02H5J1A.51.45.E01.1.454.CMB.1.raw
  modified_base (153)..(154): a, c, t, g, unknown or other
  misc_feature (153)..(154): n is a, c, g, or t

SEQ ID NO: 109260 - DNA, 118 bp, Homo sapiens; identical to SEQ ID NO: 109234
  misc_feature: GYAE6OF02GNAR3.51.45.E01.1.454.CMB.1.raw
  modified_base (118)..(118): a, c, t, g, unknown or other
  misc_feature (118)..(118): n is a, c, g, or t

SEQ ID NO: 109261 - DNA, 153 bp, Homo sapiens; identical to SEQ ID NO: 109236
  misc_feature: GYAE6OF02GMIIC.51.45.E01.1.454.CMB.1.raw
  modified_base (153)..(153): a, c, t, g, unknown or other
  misc_feature (153)..(153): n is a, c, g, or t

SEQ ID NO: 109262 - DNA, 152 bp, Homo sapiens
  misc_feature: GYAE6OF02GL5MP.51.45.E01.1.454.CMB.1.raw
  modified_base (152)..(152): a, c, t, g, unknown or other
  misc_feature (152)..(152): n is a, c, g, or t
tcagcgatcgtatacacgaccggtgctcgatttagtgagtcagtaagggaagggacacgactggagattaaacgaactgtggctgcaccatctgtcttcatcttcccgccatctgatcgtagcactctgagcgggctggcaaggcgcatagn

SEQ ID NO: 109263 - DNA, 165 bp, Homo sapiens
  misc_feature: GYAE6OF02GY2R8.51.45.E01.1.454.CMB.1.raw
  modified_base (156)..(165): a, c, t, g, unknown or other
  misc_feature (156)..(165): n is a, c, g, or t
tcagcgatcgtatacacgaccggtgctcgatttagtgagtcagtaagggaaagggacgacgactggagattaaacgaactgtggctgcaccatctgtccttcatcttcccgccatctgatcgtagcactctgagcgggctggccaaggcgcatagnnnnnnnnnn

SEQ ID NO: 109264 - DNA, 153 bp, Homo sapiens; identical to SEQ ID NO: 109236
  misc_feature: GYAE6OF02FYZ0L.51.45.E01.1.454.CMB.1.raw
  modified_base (153)..(153): a, c, t, g, unknown or other
  misc_feature (153)..(153): n is a, c, g, or t

SEQ ID NO: 109265 - DNA, 153 bp, Homo sapiens; identical to SEQ ID NO: 109236
  misc_feature: GYAE6OF02FSDM5.51.45.E01.1.454.CMB.1.raw
  modified_base (153)..(153): a, c, t, g, unknown or other
  misc_feature (153)..(153): n is a, c, g, or t

SEQ ID NO: 109266 - DNA, 164 bp, Homo sapiens
  misc_feature: GYAE6OF02G7FC6.51.45.E01.1.454.CMB.1.raw
  modified_base (153)..(164): a, c, t, g, unknown or other
  misc_feature (153)..(164): n is a, c, g, or t
tcagcgatcgtatacacgaccggtgctcgatttagtgagtcagtaagggaaagggacacgactggagattaaacgaactgtggctgcaccatctgtcttcatcttcccgccatctgatcgtagcactctgagcgggctggcaaggcgcatagnnnnnnnnnnnn

SEQ ID NO: 109267 - DNA, 154 bp, Homo sapiens
  misc_feature: GYAE6OF02JLLQ9.51.45.E01.1.454.CMB.1.raw
  modified_base (153)..(154): a, c, t, g, unknown or other
  misc_feature (153)..(154): n is a, c, g, or t
tcagcgatcgtatacacgaccggtgctcgatttagtgagtcagtaagggaaagggacacgactggagattaaacgaactgtggctgcaccatctgtcttcatcttcccgccatctaatcgtagcactctgagcgggctggcaaggcgcatagnn

SEQ ID NO: 109268 - DNA, 153 bp, Homo sapiens; identical to SEQ ID NO: 109236
  misc_feature: GYAE6OF02FNK84.51.45.E01.1.454.CMB.1.raw
  modified_base (153)..(153): a, c, t, g, unknown or other
  misc_feature (153)..(153): n is a, c, g, or t

SEQ ID NO: 109269 - DNA, 156 bp, Homo sapiens
  misc_feature: GYAE6OF02FI9CH.51.45.E01.1.454.CMB.1.raw
  modified_base (153)..(156): a, c, t, g, unknown or other
  misc_feature (153)..(156): n is a, c, g, or t
tcagcgatcgtatacacgaccggtgctcgatttagtgagtcagtaagggaaagggacacgactggagattaaacgaactgtggctgcaccatctgtcttcatcttcccgccatctgatcgtagcactctgagcgggctggcaaggcgcatagnnnn

SEQ ID NO: 109270 - DNA, 206 bp, Homo sapiens
  misc_feature: GYAE6OF02JZI3N.51.45.E01.1.454.CMB.1.raw
  modified_base (150)..(150): a, c, t, g, unknown or other
  misc_feature (150)..(150): n is a, c, g, or t
  modified_base (157)..(158): a, c, t, g, unknown or other
  misc_feature (157)..(158): n is a, c, g, or t
  modified_base (160)..(206): a, c, t, g, unknown or other
  misc_feature (160)..(206): n is a, c, g, or t
tcagcgatcgtatacacgaccggtgctcgatttagtgagtcagtaagggaaagggacgacggactggagattaaacgaactgtggctgcacatctgtctcatcttccgccatctgatcgtagcactcgtgagcgggctggccaaagggcnctatagnncnnnnnnnnnnnnnnnnnnnnnnnnnnnnnnnnnnnnnnnnnnnnnnn

SEQ ID NO: 109271 - DNA, 152 bp, Homo sapiens; identical to SEQ ID NO: 109242
  misc_feature: GYAE6OF02GF7CE.51.45.E01.1.454.CMB.1.raw

SEQ ID NO: 109272 - DNA, 154 bp, Homo sapiens; identical to SEQ ID NO: 109243
  misc_feature: GYAE6OF02HI0RU.51.45.E01.1.454.CMB.1.raw
  modified_base (153)..(154): a, c, t, g, unknown or other
  misc_feature (153)..(154): n is a, c, g, or t

SEQ ID NO: 109273 - DNA, 155 bp, Homo sapiens; identical to SEQ ID NO: 109246
  misc_feature: GYAE6OF02HTN41.51.45.E01.1.454.CMB.1.raw
  modified_base (153)..(155): a, c, t, g, unknown or other
  misc_feature (153)..(155): n is a, c, g, or t

SEQ ID NO: 109274 - DNA, 155 bp, Homo sapiens; identical to SEQ ID NO: 109246
  misc_feature: GYAE6OF02GHZX9.51.45.E01.1.454.CMB.1.raw
  modified_base (153)..(155): a, c, t, g, unknown or other
  misc_feature (153)..(155): n is a, c, g, or t

SEQ ID NO: 109275 - DNA, 168 bp, Homo sapiens
  misc_feature: GYAE6OF02JC02D.51.45.E01.1.454.CMB.1.raw
  modified_base (154)..(168): a, c, t, g, unknown or other
  misc_feature (154)..(168): n is a, c, g, or t
tcagcgatcgtatacacgaccggtgctcgatttagtgagtcagtaagggaaagggacacggactggagattaaacgaactgtggctgcaccatctgtcttcatcttcccgccatctgatcgtagcactctgagcgggctggcaaggcgcatagnnnnnnnnnnnnnnn

SEQ ID NO: 109276 - DNA, 162 bp, Homo sapiens
  misc_feature: GYAE6OF02I07CG.51.45.E01.1.454.CMB.1.raw
  modified_base (137)..(137): a, c, t, g, unknown or other
  misc_feature (137)..(137): n is a, c, g, or t
  modified_base (156)..(162): a, c, t, g, unknown or other
  misc_feature (156)..(162): n is a, c, g, or t
tcagcgatcgtatacacgaccggtgctcgatttagtgagtcagtaagggaaagggacacgactggagattaaacgaactgtggctgcaccatctgtcttcatcttcccgcatctgatcgtagcactcgtgagcgggntggacaaggcgcagttagnnnnnnn

SEQ ID NO: 109277 - DNA, 397 bp, Homo sapiens
  misc_feature: GYAE6OF01C51S2.33.70.G04.1.454.CMB.1.raw
  modified_base (394)..(397): a, c, t, g, unknown or other
  misc_feature (394)..(397): n is a, c, g, or t
tcagtacacacactcacgaccggtgctcgatttagtgtagtgtgaagggaaggccaccctctcttgtagggccagtcagagtgttagcagcaactacttagcctggccaggtgtctgctggtaccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgaagtgtgtgtactgagcgggctgggcaaggcgcatagnnnn

SEQ ID NO: 109278 - DNA, 522 bp, Homo sapiens
  misc_feature: GYAE6OF01AHIMF.33.70.G04.1.454.CMB.1.raw
  modified_base (200)..(200): a, c, t, g, unknown or other
  misc_feature (200)..(200): n is a, c, g, or t
  modified_base (510)..(510): a, c, t, g, unknown or other
  misc_feature (510)..(510): n is a, c, g, or t
tcagtacacacactcacgaccggtgctcgatttagtgtagtgtgaagggaaaggggaggaactgctcagttaggacccagagggaaccatggaagccccagctcagcttctcttcctcctgctactctggctcccagataccaccggggaaattgtgttgacacagtctccagccaccctgtctttgtctccaggggaanagccaccctctcctgcagggccagtcagagtgctggcagcaacttagcctggtaccaacaaaacctggccagactcccaggctcctcatctatgatgcatccaccaggccactggcatcccagccaggttcagtggcagtgggtctgggacagacttcactctcaccatcagcagcctagacgcctagaagtattttgctagtttatactgtctgcagcgtagcaacgtgacctaacaccgttcggaccaagggacacgactggagtaagttaaacgacgtgtaggctgaccacgtatctagtaccttcncgttccgtcccg

SEQ ID NO: 109279 - DNA, 501 bp, Homo sapiens
  misc_feature: GYAE6OF01DWGOF.33.70.G04.1.454.CMB.1.raw
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
tcagtacacacactcacgaccggtgctcgatttagtgtagtgtgaagggaaaggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactccaggctcctcatctatgatgcatccaccagggccactggcatcccagccaggttcagtggcagtgggtctgggacagacttcactctcaccatcagcagcctagagcctgaagattttgctagtttattactgtctgcagcgtagcaactggcctaacaccttcggccaagggacacgactggagattaaacgactgtgctgcacatctgtnttcntctcccg

SEQ ID NO: 109280 - DNA, 503 bp, Homo sapiens
  misc_feature: GYAE6OF01AIHK0.33.70.G04.1.454.CMB.1.raw
  modified_base (424)..(424): a, c, t, g, unknown or other
  misc_feature (424)..(424): n is a, c, g, or t
  modified_base (466)..(466): a, c, t, g, unknown or other
  misc_feature (466)..(466): n is a, c, g, or t
  modified_base (496)..(496): a, c, t, g, unknown or other
  misc_feature (496)..(496): n is a, c, g, or t
tcagtacacacactcacgaccggtgctcgatttagtgtagtgtgaagggaaaggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactcccaggctcctcatctatgatgcatccaccaggccactggcatcccagccaggttcagtggcagtgggtctgggacagacttcactctcaccatcagcagcctagacgcctgaagtattttgctagtttatactgtctgcagcgtancaactggacctaacaccttcggaccaagggacacgactgganattaaacgagtgtgctgcacatctgtctcntctcccg

SEQ ID NO: 109281 - DNA, 497 bp, Homo sapiens
  misc_feature: GYAE6OF01DWGWI.33.70.G04.1.454.CMB.1.raw
  modified_base (477)..(477): a, c, t, g, unknown or other
  misc_feature (477)..(477): n is a, c, g, or t
  modified_base (486)..(486): a, c, t, g, unknown or other
  misc_feature (486)..(486): n is a, c, g, or t
  modified_base (494)..(497): a, c, t, g, unknown or other
  misc_feature (494)..(497): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagattttgctagtttattactgtcagcagcgtagcaactggtcttggacgttcggccaagggaccaaaggtggaaatacaaacgactgtggctgcaccatctgtcttcatcttccgcatctgagtgtgtgtactgagcgggtntggcaaggngacatagnnnn

SEQ ID NO: 109282 - DNA, 530 bp, Homo sapiens
  misc_feature: GYAE6OF01DS9XX.33.70.G04.1.454.CMB.1.raw
  modified_base (521)..(521): a, c, t, g, unknown or other
  misc_feature (521)..(521): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagacctcccaggctcctcatctatgatgcatccaccagggccactggcatcccagccaggttcagtggcaggtgggtctgggacagacttcactctcaccatcagcagcctagacgcctagaagtattttgacttagtttattactgttctgcagtcgtagccaacgtcggaccctaacaccgttcggaccaagggaccacgacgtggaataagttaaacgacgtgtggctgcacattctcgtcttcnttcctcccg

SEQ ID NO: 109283 - DNA, 571 bp, Homo sapiens
  misc_feature: GYAE6OF01D7X94.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagngccaccctctcctgcagggccagtcagagtgctggcagcaacttagcctggtaccaacaaaaacctggccagactcccaggctcctcatctatgatgcatccaccagggccactggcatcccagccaggttcagtggcagtgggtctgggacagacttcactctcaccatcagcagcctagacgcctgaagtattttgactagttttattactgttctgcagcgtagcaactcggaccctaacgacccgttcggaccctaagggaccacggactagggaagtaacgtttaaaacggaacgttggtagggaccttggacccaaccctaacgttccttacggttacctttcaacgttcccgttacccccg

SEQ ID NO: 109284 - DNA, 625 bp, Homo sapiens
  misc_feature: GYAE6OF01C052R.33.70.G04.1.454.CMB.1.raw
  modified_base (200)..(200): a, c, t, g, unknown or other
  misc_feature (200)..(200): n is a, c, g, or t
  modified_base (428)..(428): a, c, t, g, unknown or other
  misc_feature (428)..(428): n is a, c, g, or t
tcagtacacacactcacgaccggtgctcgatttagtgtagtgtgaagggaaaggggaggaactgctcagttaggacccagagggaaccatggaagccccagctcagcttctcttcctcctgctactctggctcccagataccaccggggaaattgtgttgacacagtctccagccaccctgtctttgctccaggggaaancgccacctctcctgcgacgggccagtcagagtgctggcagctaacttgcctaggtaaccaaaacaaaaacctggaccaagacctccgaggcctcctacatctatgatgcaactccacgaggcccacgtggcactcccagccgtaggttccaggtcggctaggtgggtcgtagggactacgtacttcaactctacacatcacgcacgtacctaagacgcctagaacgtnttttagacttagttttacttactgtctgtcaggtcgtagcctaacgtcggtaccctaacgtacccgttacggaaccgaagggtaccacggtaacgttaggaaacgtaaacgtttaaaacgacgttcgggtaggtacctacggaccctaaccgtaagttcccttaggttacccttacctacgtttccccgttaccccg

SEQ ID NO: 109285 - DNA, 516 bp, Homo sapiens
  misc_feature: GYAE6OF01AI3I3.33.70.G04.1.454.CMB.1.raw
  modified_base (491)..(491): a, c, t, g, unknown or other
  misc_feature (491)..(491): n is a, c, g, or t
  modified_base (513)..(513): a, c, t, g, unknown or other
  misc_feature (513)..(513): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaagagccaccctctcctgcagggccagtcagagtgctggcagcaacttagcctggtaccaacaaaaacctggccagactcccaggctcctcttctatgatgcatccaacagggccactggcatcccagccaggttcagtggcggtgggtctgggacagacttcactctcaccatcagcagcctagacgcctgaagtattttgctagtttatactgtcagcagcgtagctaactggtcttggacgttcggaccaagggaccaaagggtggaaatcgaaacgatgtgctgccacntctgtcttcatccttcccgctntcg

SEQ ID NO: 109286 - DNA, 575 bp, Homo sapiens
  misc_feature: GYAE6OF01AOGGC.33.70.G04.1.454.CMB.1.raw
  modified_base (202)..(202): a, c, t, g, unknown or other
  misc_feature (202)..(202): n is a, c, g, or t
  modified_base (403)..(403): a, c, t, g, unknown or other
  misc_feature (403)..(403): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaaccaaacaaaacctggaccagactcccaggctcctcatctatgatgcatcccaccgagggccacgtggccactcccagccaggttcagtggcaggtggtctgggacagactcactctcacatcacgcacgcctagcgcctagaagtntttgcttagtttactactgtctgctaggtcgtagctaacgtcggaccctaacgcccgttcgggaccgaaagggaccacggacgtagggaacgtaacgttaaacgacgttggtagggccttcggacctaaccgtacttcgttacgttacccttactacgttcccttaccccgg

SEQ ID NO: 109287 - DNA, 539 bp, Homo sapiens
  misc_feature: GYAE6OF01EIGPX.33.70.G04.1.454.CMB.1.raw
tcagtacacacactcacgaccggtgctcgatttagtgtagtgtgaagggaaaggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactcccaggctcctcatctatgatgcatccaccagggccactggcatcccagccaggttcagtggcagtggtctgggacagacttcactctcacatcagcagcctagagcctgaagtattttgctagtttatactgtctgcagcgtagcaacgtggacccttaacacccgttcggaccaaagggaccacggaacgtgggaagattaaaaccggaacgtgtaggactggaccaaccgattcctagttacctttcattccttccccg

SEQ ID NO: 109288 - DNA, 530 bp, Homo sapiens
  misc_feature: GYAE6OF01AG21A.33.70.G04.1.454.CMB.1.raw
  modified_base (202)..(202): a, c, t, g, unknown or other
  misc_feature (202)..(202): n is a, c, g, or t
  modified_base (518)..(518): a, c, t, g, unknown or other
  misc_feature (518)..(518): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttgcctggtaccaacaaaacctggccagactcccaggctcctcatctatgatgcatcccaccagggcccactggcactcccagccaggttcagtggcaggtgggtctggggacaggacttcactctcaccatcagcagcctagacgcctgaagtatttgctagtttattactgtctgctagcgtagctaacgttggtcttgggacgtttcgggaccgaaggggaccaagggtcggaaatcgaaacgtactggtggctgcacatctcgtcttacncttcctcccgac

SEQ ID NO: 109289 - DNA, 503 bp, Homo sapiens
  misc_feature: GYAE6OF01BT9YC.33.70.G04.1.454.CMB.1.raw
  modified_base (260)..(260): a, c, t, g, unknown or other
  misc_feature (260)..(260): n is a, c, g, or t
  modified_base (479)..(479): a, c, t, g, unknown or other
  misc_feature (479)..(479): n is a, c, g, or t
  modified_base (494)..(494): a, c, t, g, unknown or other
  misc_feature (494)..(494): n is a, c, g, or t
tcagtacacacactcacgaccggtgctcgatttagtgtagtgtgaagggaaaggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaanaaaaacctggccagactcccaggctcctcatccatggtgcatccaccagggccactggcatcccagccaggttcagtgcagtggtctgggacagacttcactctcaccatcagcagcctagagcctgaagattttgctagtttatactgtctgcagcgtagcaactggacctaacaccttcggaccaagggacacgactggagattaaacgaactgtgntgcacatctgtcttnctctcccgc

SEQ ID NO: 109290 - DNA, 509 bp, Homo sapiens
  misc_feature: GYAE6OF01DZ42J.33.70.G04.1.454.CMB.1.raw
  modified_base (485)..(485): a, c, t, g, unknown or other
  misc_feature (485)..(485): n is a, c, g, or t
  modified_base (506)..(506): a, c, t, g, unknown or other
  misc_feature (506)..(506): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagagccaccctctcctgcagggccaatcagagtgttagcagtaacttagtctggtaccaacatagacctgaccaggctcccaggctcctcatctacgatgcgtccaacagggccactggcatcccagccaggttcagtggcagtggtctgggacagacttcactctcaccatcagcaacctagaacttgaagtattttcattttattactgtcaacatcacgcagctgcctctcacgtttcggcggagggaccaaggtgagctacgaaacgactgtggctgcacntctgtcttcatcttcccgctntcg

SEQ ID NO: 109291 - DNA, 537 bp, Homo sapiens
  misc_feature: GYAE6OF01ET8DI.33.70.G04.1.454.CMB.1.raw
  modified_base (202)..(202): a, c, t, g, unknown or other
  misc_feature (202)..(202): n is a, c, g, or t
  modified_base (510)..(510): a, c, t, g, unknown or other
  misc_feature (510)..(510): n is a, c, g, or t
  modified_base (534)..(534): a, c, t, g, unknown or other
  misc_feature (534)..(534): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaacaaaacctggccagactcccaggctcctcttctatgatgcatccaacagggccactggcatcccagccaggttcagtggcggtgggtctggggacagacttcactctcaccatcagcagcctaggacgcctagaagtattttgctagttttattactgtcagcagcgtagctaacgtggtcttgggaccgttcggaccgtaaaggggaccaaagggtggaaactcgaaaacgactggtaggcgtgacacntctgtcttcacttccttcccgctntcg

SEQ ID NO: 109292 - DNA, 497 bp, Homo sapiens
  misc_feature: GYAE6OF01CWKTC.33.70.G04.1.454.CMB.1.raw
  modified_base (494)..(497): a, c, t, g, unknown or other
  misc_feature (494)..(497): n is a, c, g, or t
tcagtacacacactcacgaccggtgctcgatttagtgtagtgtgaagggaaaggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctggggacagacttcactctcaccatcagcagcctagagcctgaagattttgcagtttatactgtcagcagctagcaactgtctggacgttcgcaagggaccaaggtggaaatcgaaacgaactgtggctgcaccatctgtcttcattccttcccgcccaatcctgaagtgtgtgtactgtagcgggctggcaaggcgcatagnnnn

SEQ ID NO: 109293 - DNA, 818 bp, Homo sapiens
  misc_feature: GYAE6OF01DN5QD.33.70.G04.1.454.CMB.1.raw
  modified_base (201)..(201): a, c, t, g, unknown or other
  misc_feature (201)..(201): n is a, c, g, or t
tcagtacacacactcacgaccggtgctcgatttagtgtagtgtgaagggaaagggggaggaactgctcagttaggacccagagggaaccatggaagccccagcctcagcttcctcttcctcctgctactctggctccagataccaccgggaattgtgttgacacagtctccagccaccctgtctttgctccgaggggaagngccaccctctccgtgcagggccagtcagagtgctggcagcaacttgcctggtaaccaaacaaaaacctggaccagactcccaggcctcctcatccatggtcgcactccacgacgggccacgtggccactcccgaagtaccgtaggtttccaaggtcggacgtagggttcgggtacgtacggggaactacggtacctttccgaacgtttccgtaccgtaacccgtacgttaccgaaacggcctaacgggtaccgttacggggaaccgtacccgttagggtaaacgttacgttttttacggaccgttaagggtttacgtttaaacgtttaacgttacggttaaccgtaacggtaccgttaacggtttaaccgggtttaagttttaccccgtaaggttttccccggtaaccccgggttaaccgggtttacccggggtaaacccggtaaaacggggtaacccgtaaaggggttacggaaaaaccgttaccgaaaaaccgggttaccgtaaggggttaccgggtaccgttacggaacccgtaacccgttaacgttacccgtttacggtttacccgtttaccgtaaccgtttcccccggtttacccccggacctttaaccggg

SEQ ID NO: 109294 - DNA, 544 bp, Homo sapiens
  misc_feature: GYAE6OF01CMYSU.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaacaaaaacctggccagactccaggctcctcatctatgatgcatccaccagggccactggcatcccagccaggtcagtggcagtggtctgggacagacttcactctcacatcagcagcctagagcctgaagtattttgctaagtttattactgtctgcagcgttagctaactcggacctaacgaccgttcggaccaaacgggaccacggactcgggaagtaaagttaaacggaacgtggtggcttgacctaccattcctagttcctttacgacttccgttaccccg

SEQ ID NO: 109295 - DNA, 534 bp, Homo sapiens
  misc_feature: GYAE6OF01EPNHO.33.70.G04.1.454.CMB.1.raw
  modified_base (201)..(201): a, c, t, g, unknown or other
  misc_feature (201)..(201): n is a, c, g, or t
  modified_base (388)..(388): a, c, t, g, unknown or other
  misc_feature (388)..(388): n is a, c, g, or t
  modified_base (408)..(408): a, c, t, g, unknown or other
  misc_feature (408)..(408): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaangccaccctctcctgcagggccagtcagagtgctggcagcaacttagcctggtaaccaaacaaaacctggccagactcccaggctcctcatccatggtgcatccaccgagggccacgtggcactcccagacaggttcagtggcagtggtctggggacagacttcattctcaccatcagcagactggancctgaagtattttgctagtntattactgtacagcagttacggtattcattcgtccggtacgttccggaccgtaacgggaccaagggtaggaaatacgaaacgtacgtaggtggctagccacatctgtccttcatccttcccgctac

SEQ ID NO: 109296 - DNA, 622 bp, Homo sapiens
  misc_feature: GYAE6OF01BRBQA.33.70.G04.1.454.CMB.1.raw
  modified_base (204)..(204): a, c, t, g, unknown or other
  misc_feature (204)..(204): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaagngccaccctctcctgcagggccagtcagagtgctggcagcaacttagcctaggtaaccaaacaaaaacctggaccaagacctcccaggctcctcatctatgatgcactcccaaccgacgggccacgtggccactcccagccaggttcaggtggcaggtgggtctgggacagacttcactctcaccatcagcacgcctagacgtcctaggaagttattttcgacttaagttttaacttacgttgttctgtacaggtcgtagacctaacgtcggacccttaaccgtacccgttcgggaccaaacggggaccacggtaacgtagggaacgtaacgttaaaaccggacgtcggtaggaccttacggaccctaaccgtacgttccttacggttacctttaccgtacgtttccccgttacccccg

SEQ ID NO: 109297 - DNA, 520 bp, Homo sapiens
  misc_feature: GYAE6OF01EKE2N.33.70.G04.1.454.CMB.1.raw
  modified_base (202)..(202): a, c, t, g, unknown or other
  misc_feature (202)..(202): n is a, c, g, or t
  modified_base (398)..(398): a, c, t, g, unknown or other
  misc_feature (398)..(398): n is a, c, g, or t
  modified_base (444)..(444): a, c, t, g, unknown or other
  misc_feature (444)..(444): n is a, c, g, or t
  modified_base (473)..(473): a, c, t, g, unknown or other
  misc_feature (473)..(473): n is a, c, g, or t
  modified_base (511)..(511): a, c, t, g, unknown or other
  misc_feature (511)..(511): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaaacaaaaacctggccagactcccaggctcctcatctatgatgcatccaccagggccactggcatcccagccaggttcagtggcagtgggtctgggacagacttcactctcaccatcagcagcctagacgcctagaagtntttgctagtttattactgtctgcagtcgtagcaactggacctaacnccgttcggaccaagggaccacgactgganacgttaaacgacgtgtggctgaccacattctgtcttcntcctccccg

SEQ ID NO: 109298 - DNA, 614 bp, Homo sapiens
  misc_feature: GYAE6OF01CXG7J.33.70.G04.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (384)..(384): a, c, t, g, unknown or other
  misc_feature (384)..(384): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccaggggaaangccaccctntcctgcagggccagtcagagtgctggcagcaaacttgcctggtaccaaacaaaaacctggaccagactcccaggctcctcatctatgatgcatccacaggccactggcatcccagccaggttcagtgcagtgggtctgggacagacttcactctcacatcagcagcctaggacncctagaacgtattttgactagttttatacttgttctgcagtcgtagctaacgtcggacccttaaccgtacccgtttccgggacccgtaaaggggtacccaacgggtaaccgttacgggaaacggtaaacgtttaaaaaccgggaacttcgggtagggtaccttacgggaccctaaacccgtagtttacccgttaggttacccttttaccacgtttccccgtttacccccg

SEQ ID NO: 109299 - DNA, 509 bp, Homo sapiens
  misc_feature: GYAE6OF01E2XHH.33.70.G04.1.454.CMB.1.raw
  modified_base (502)..(502): a, c, t, g, unknown or other
  misc_feature (502)..(502): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaacctggccagactcccaggctcctcatctatgatgcatccaccagggccactggcatcccagccaggttcagtggcagtgggtctggggacagacttcactctcaccatcagcagcctagagcctgaagtattttgctagtttattactgtctgcagcgtagcaactggacctaacaccttcggaccaagggacacgactggagacttaaacgactgtaggctgcacatctgtcttcntctcccg

SEQ ID NO: 109300 - DNA, 587 bp, Homo sapiens
  misc_feature: GYAE6OF01A2EKB.33.70.G04.1.454.CMB.1.raw
  modified_base (400)..(400): a, c, t, g, unknown or other
  misc_feature (400)..(400): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaacctggaccagactcccaggctcctcatctatgatgcatccacgagggccacgtggacactcccagccaggttcagtggcagtgggtctgggacagacttcactctcacatcagcagcctagacgtcctagaagtntttagactaagtttatactgtactgactagcgtagactaacgtcggacctaacgacccgttacggacctaaagggaccacggacgtagggaagtaaacgttaaaaccggacgttggtacggacttcggaccctaaccgtagttaccgttacggttaccctttacgtaacgtttccccgttaccccgg

SEQ ID NO: 109301 - DNA, 644 bp, Homo sapiens
  misc_feature: GYAE6OF01DNX44.33.70.G04.1.454.CMB.1.raw
  modified_base (204)..(204): a, c, t, g, unknown or other
  misc_feature (204)..(204): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtctttgtctccaggggaaagngccaccctctcctgcagggccagtcagagtgctggcagcaacttagcctggtaccaaacaaaaacctggaccaagacctcccaggcctcctcatctaatgatgacatcccaaccgaggggcccacgtcggcactcccagccaggttccaggtggcgaggtgggtctgggacagtacttcactctcaccatcagcagcctaagcgcctagaagttattttgacttaagttttattactgttcgtgactaggtacgtagaccgtaacgtcggtaacccttaaccgtacccggtttaccggaaccgtaaacggggaccctacggtaaccggttacgggtaaagtaaaccgtttaaaacggtaacgttcggtacgggtacgttacggaccctaaccgtacgttccgttacgttaccttttaccgccgtttccccgttacccccg

SEQ ID NO: 109302 - DNA, 522 bp, Homo sapiens
  misc_feature: GYAE6OF01A1PPN.33.70.G04.1.454.CMB.1.raw
  modified_base (485)..(485): a, c, t, g, unknown or other
  misc_feature (485)..(485): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccaggcaccctgtctttgtctccaggggaaagagccaccctctcctgcagggccaatcagagtgttagcagtaacttagtctggtaccaacatagacctgaccaggctcccaggctcctcatctacgatgcgtccaacagggccactggcatcccagccaggttcagtggcagtgggtctgggacagacttcactctcaccatcagcaacctagaacttgaagtattttcattttatactgtacaactatcacggcagtctggcccttctctacgtttcggacggtagggaccaagggtgacgctacaacgatgngctgccacatctgtcttcattcctaccgntntcgtag

SEQ ID NO: 109303 - DNA, 561 bp, Homo sapiens
  misc_feature: GYAE6OF01EOGOX.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaagagccaccctctcctgcagggccagtcagagtgctggcagcaacttagcctggtaaccaaacaaaaacctggaccagacctcccaggcctcctcatctatgatgcatccaacgacgggccacgtggccactccccagccaggttcaggtggcggtgggtctggggacagacttcactctacaccatcagcagcctagacgtcctagaagttattttgacttaagtttattactgtactagcagcgtagctaactggttcgttgggacgttcgggaccgaagggaccaagggtacgaaacttacgaaacgtacgtgtggctaggacctcatcgttgtcttacgtacttccttcccgctag

SEQ ID NO: 109304 - DNA, 577 bp, Homo sapiens
  misc_feature: GYAE6OF01BQ9V8.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaaacaaaaacctggaccagactcccaggctcctcatctatgatgcactcccaccgacgggcccacgtggccactccccagcccaggttcaggtggcaggtgggtctgggacagacttcactctcaccatcagcagcctagacgcctagaagtattttgacttagttttacttacttgttctgcagtcgtagcctaagtcgacctaaccgacccgttacggaccgaaacgggacacgacgtagggaacgtaacgttaaaccggagtggtacggtctcggacctaccgtattcgtgttaccttctacttcccgttaccccg

SEQ ID NO: 109305 - DNA, 661 bp, Homo sapiens
  misc_feature: GYAE6OF01AS8IA.33.70.G04.1.454.CMB.1.raw
tcagtacacacactcacgaccggtgctcgatttagtgtagtgtgaagggaaagggggaggaactgctcagttaggacccaggagggaaccatggaacgccccagctcagcttctcttcctcctgctactctggcctcccagataccgaccggggaaattgtgttgacacagtctccagcccaccctgttctttgtctccgaaggggaaagacgcccaccctctcctgcgagggccagtcagagtgctggcagcaacttagcctaggtaaccaaacaaaaacctggaccagacctcccaggcctcctcatctatgatgcactcccaccgacgggcccacgtcggccactccccgacgcccgtaggttccaggtcggcgtaggtcgggtcgtaggggactagtaccttcacttcctacacctatccgagcacgtcctaaggacgtccgtaggtaagttagttttacgactttaagttttaactacgttgtacgacgcgacgtccgtctacgtaacgtcggacccttccggtcgtaccctacccgttcgggaaccgtaacggggacctacggtagttacgggaagtaacgttaacggaaccgttaacgttcgggtacggtccgttcggtaccctacccgttcgttcgttcccgtttactacccg

SEQ ID NO: 109306 - DNA, 613 bp, Homo sapiens
  misc_feature: GYAE6OF01BFHHT.33.70.G04.1.454.CMB.1.raw
  modified_base (409)..(409): a, c, t, g, unknown or other
  misc_feature (409)..(409): n is a, c, g, or t
tcagtacacacactcacgaccggtgctcgatttagtgtagtgtgaagggaaagggggaggaactgctcagttaggacccagagggaaccatggaacgccccagactcagcttctcttcctcctgctactctggctcccagactaccaccgggaattgtgttgacgcagtctccaggcacctgtctttgctccaggggacagacgccaccctctcctgcagggccagtcagactgttagcagcgcttctagcctggtaccagcagaacctggccaggctccaggctcctcctctatggttagcatccaccgaggccactggcatcccagacaggttcagtggctaggtcgggtctgggacaggactttcgatttcacacctatccaagccagactggagcctagaacgtnttttgcagtgttattacgtgtacagctagtacggtacgttcgacttccgtaccggtacgtttccggaccgtaacggggtaacccgtaagggttacggtaaaacgttaccgaaaacggtaacgttcgggttaggaccgtttcggacccgtaaccctaacgtttccgttacggttacctttaccgtaaccgttccctttaaccccg

SEQ ID NO: 109307 - DNA, 522 bp, Homo sapiens
  misc_feature: GYAE6OF01CFXE8.33.70.G04.1.454.CMB.1.raw
  modified_base (202)..(202): a, c, t, g, unknown or other
  misc_feature (202)..(202): n is a, c, g, or t
  modified_base (483)..(483): a, c, t, g, unknown or other
  misc_feature (483)..(483): n is a, c, g, or t
  modified_base (506)..(506): a, c, t, g, unknown or other
  misc_feature (506)..(506): n is a, c, g, or t
  modified_base (515)..(515): a, c, t, g, unknown or other
  misc_feature (515)..(515): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaaacaaaaacctggaccagactcccaggctcctcatctatgatgcatccaccaggccactggcatcccagccaggttcagtgcagtgggtctgggacagacttcactctcaccatccagcagcctagacgcctagaagtatttttcgactaagttttattacgttgttctgcagtcgtagcaacgtggacctaacgaccttcggacctaagggacagactggaanacttaaagactggtgactgcacntctgtctcntctcccg

SEQ ID NO: 109308 - DNA, 538 bp, Homo sapiens
  misc_feature: GYAE6OF01A9J8Y.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaacctggccagactcccaggctcctcatctatgatgcatccaccaggccactggcatcccagccaggttcagtggcagtggtctgggacagacttcactctcaccatcagcagcctagacgcctgaagtattttgctagtttatactgtctgcagcgtagcaactggacctaacaccgttcggacctaagggaccacggactgggaacgtaatttaaaaccggacttcggtggccttggaccaaccattcctgttccttcattcccgttaccccg

SEQ ID NO: 109309 - DNA, 569 bp, Homo sapiens
  misc_feature: GYAE6OF01ALU6O.33.70.G04.1.454.CMB.1.raw
tcagtacacacactcacgaccggtgctcgatttagtgtagtgtgaagggaaagggggaggaactgctcagttaggacccagagggaaccatggaagccccggctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactcccaggctcctcatctatgatgcatccaccagggccactggcatcccagccaggttcagtggcagtggtctgggacagacttcactctcaccatcagcagcctagagcctgaagtattttgacttagtttacttactgttctgctagcgtagacacgtcgtacctaacctaccgttccggaccgaacgggacacgtacgtaggaagtaacgttaaaaccgaacgttggtcggtacgttcggccctaaccgtattccgttcgttccttactactttcccgttccccgtaccc

SEQ ID NO: 109310 - DNA, 558 bp, Homo sapiens
  misc_feature: GYAE6OF01BQNTW.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaaccaaacaaaaacctggaccagactcccaggctcctcatctatgatgcatccaccgacgggcccactggcactcccagccaggttcaggtggcaggtgggtctgggacagacttcactctcaccatcagcagcctagacgcctagaagtatttgactagtttattactgtctgcagtcgtacactacgtccgtacctaaccgtaccgttacgaccgaacggacacgacgtaggaacgtaacgtaaacggagtggtacgctcgacctacgtacttcgtcgttaccttactcttcccgtacccg

SEQ ID NO: 109311 - DNA, 547 bp, Homo sapiens
  misc_feature: GYAE6OF01DWV25.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttagcctggtaccaacaaaaacctggccagactcccaggctcctcatctatgatgcatccaccagggccactggcatcccagccaggttcagtgcagtggtctgggacagacttcactctcacatcagcagcctagacgcctgaagtattttgactaagttttattacgtgttctgcagtcgtagcaacgtggacccttaacgaccgttcggaccaaagggaccacgacgtaggaagtaacttaaacggaacgtggtaggctgacctaccattccgttagttccttctattcccgttaccccg

SEQ ID NO: 109312 - DNA, 613 bp, Homo sapiens
  misc_feature: GYAE6OF01CPTPB.33.70.G04.1.454.CMB.1.raw
  modified_base (199)..(199): a, c, t, g, unknown or other
  misc_feature (199)..(199): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccgggaaattgtgttgacgcagtctccaggcaccctgtcttgtctcaggggaaanagccacctctcctgcagggccaatcagagtgttagcagtaacttagtctggtaccaacatagacctgaccaggctccaggctcctcatctacgatgcgtccaacagggccactggcatcccagccaggttcagtgcaggtggctgggacagacttcaactctacacctatcaagcaaacctagaacttgaagttattttctattttattactgtacaactatacgacgcagtctaggcccttctacctacgttttccgggacgggtacgggaacccgtaagggttcggaacgtacgtaccgaaaaaccggtaacgttcggtacgggtccttacggacccgtaacctaattcccgtacgtttaccctttactaaccgtttccccttaccccggtaccctagttcccgttaacggg

SEQ ID NO: 109313 - DNA, 571 bp, Homo sapiens
  misc_feature: GYAE6OF01C6YFD.33.70.G04.1.454.CMB.1.raw
  modified_base (201)..(201): a, c, t, g, unknown or other
  misc_feature (201)..(201): n is a, c, g, or t
  modified_base (354)..(354): a, c, t, g, unknown or other
  misc_feature (354)..(354): n is a, c, g, or t
  modified_base (398)..(398): a, c, t, g, unknown or other
  misc_feature (398)..(398): n is a, c, g, or t
  modified_base (433)..(433): a, c, t, g, unknown or other
  misc_feature (433)..(433): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccaggggaaangcccacctctcctgcagggccagtcagagtgctggcagcaacttgcctggtaaccaaacaaaaactggccagactccaggctcctcactctatgatgcatccaccgaggccactggcatcccagccaggttcagtggcaggtggtctgggacngacttcactctcacatcagcagcctagacgaccgtagaaacgtntttttgacttaagtttattactgtctgcagcgtanaccaacgtcgacctaaccaccgttccggacctaagggtaccacggtacgtacggaagtaaagttaaaaccgacgttaggtacggtacgtcgaccaaccgtacttccgttacgtcctttacaccgttccgttacccccg

SEQ ID NO: 109314 - DNA, 553 bp, Homo sapiens
  misc_feature: GYAE6OF01CN02G.33.70.G04.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (403)..(403): a, c, t, g, unknown or other
  misc_feature (403)..(403): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggagaaagngccaccctctcatgcagggccagtcagagtattagcatcttcttggcctggtaccaanagaaacctggccaggctcccaggctcctcatccagaatgcattcaacagggccacgtggcactcccagccaggttcagtggcaggtgggtctgggacagacttcactctcaccatcagcagcctagacgcctggagtattcngctagtttattactgtcagcagtctctcaacgtcggccctcgtcgcctaccgttcggacccgaagggacaccggtagttcgggaagtagtttaaggaccggtaaacgttggtacgggtccttacggacccaccccgtttgttcggttccc

SEQ ID NO: 109315 - DNA, 577 bp, Homo sapiens
  misc_feature: GYAE6OF01BNRR6.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttgcctggtaccaacaaaaacctggccagactcccaggctcctcatctatgatgcatcccaccacgggccactggcactcccagccaggttcagtggcagtgggtctgggacagacttcactctcacatcagcagcctagacgctgaagtatttgctagtttattactgtctgcagcgtagctaacgtcggacccttaacgcccgttcgggacctaaacggggaccaccggtacgtagggaacgtaacgttaaaaccggacgttcggtagggactcggaccctaaccgtacgttccttacggttacctttcgtacgttccccgttacccccg

SEQ ID NO: 109316 - DNA, 596 bp, Homo sapiens
  misc_feature: GYAE6OF01BN3DO.33.70.G04.1.454.CMB.1.raw
  modified_base (202)..(202): a, c, t, g, unknown or other
  misc_feature (202)..(202): n is a, c, g, or t
  modified_base (384)..(384): a, c, t, g, unknown or other
  misc_feature (384)..(384): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagactgttagcagcggcttctagcctggtaccagcagaacctggccaggctcccaggctcctcttctatgatgcatccaacaggccactggcatcccagccaggttcagtggcggtggtctggggacagtacttcactctcacatcagcagctagancctagaagtatttgactagtttacttactgtcgagcagtcgtagctaacgtcggttacttcgggtaccgttccgggtaccggtaacgggtaaccgtaaaggggtaacggaaaacgtaccgaaaaaccggtaacgtacggtacgggtactacggtaccctaaccgtacttacgtacgtttacccttacgtacctttcccgttcccccgtaccg

SEQ ID NO: 109317 - DNA, 559 bp, Homo sapiens
  misc_feature: GYAE6OF01E0S5H.33.70.G04.1.454.CMB.1.raw
  modified_base (202)..(202): a, c, t, g, unknown or other
  misc_feature (202)..(202): n is a, c, g, or t
  modified_base (439)..(439): a, c, t, g, unknown or other
  misc_feature (439)..(439): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttgcctggtaccaaacaaaaacctggaccagactcccaggcctcctcatctatgatgcactccaccgacgggcccactggccactcccagccaggttcagtggcaggtgggtctgggacagacttcactctcaccatcagcacgcctagacgcctagaagtattttgcttagttttactactgtctgcagcgtancaacgtcggacctaacgaccgttcggaccgaaggaccacggactggaagtaaacgttaaacgaacgtggtaggacgtcgacctacctagtcttacgttaccttctacgttcccttccccg

SEQ ID NO: 109318 - DNA, 556 bp, Homo sapiens
  misc_feature: GYAE6OF01EGDB8.33.70.G04.1.454.CMB.1.raw
  modified_base (202)..(202): a, c, t, g, unknown or other
  misc_feature (202)..(202): n is a, c, g, or t
  modified_base (407)..(407): a, c, t, g, unknown or other
  misc_feature (407)..(407): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaaccaaacaaaacctggaccagactcccaggctcctcatctatgatgcatccaccgacgggccacgtggccactcccagccaggttcaggtggcaggtgggtctgggacagacttcactctcaccatcagcacgcctagacgcctagaagtnttttgcttagtttattacttgtctgcaggtcgtagcaacgtcggaccctaacgaccgttaccggaccgaaacgggaccacggacgtaggaagaaacgttaaaccggagtggtggctgaccactagttctcgttcttcacttccgtcccg

SEQ ID NO: 109319 - DNA, 563 bp, Homo sapiens
  misc_feature: GYAE6OF01EEXLB.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagngccaccctctcctgcagggccagtcagagtgctggcagcaacttagcctggtaaccaaacaaaaacctggaccagacctcccaggcctcctcatctatgatgcactccaccgacgggccacgtggcactcccagcctaggttcaggtcggcgaggtcgggtcgtgggacagtacttcactctacaccatcagcagcctagacgcctagaagttatttgacttagtttattactgtcagctaggcgtagctaacgttggtacgttggacgttcggaccgtaagggaccgtaagggtagaaactacgaaaacgtacgtggtacggctagccacctattcgtgtcttacacttccgtcccgac

SEQ ID NO: 109320 - DNA, 541 bp, Homo sapiens
  misc_feature: GYAE6OF01B3EMC.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaacaaaaacctggccagactcccaggctcctcatctatgatgcatcccaccagggccactggcatcccagccaggttcagtggcagtgggtctgggacagacttcactctcaccatcagcagcctagagcctgaagtattttgctagtttatactgtctgcagcgtagcaacgtcggacccaacaccgttcggaccaagggaccacgacgtggaagtacttaaaacggactggtaggcctgacctaaccgtattcctagttaccttctattcccgttaccccg

SEQ ID NO: 109321 - DNA, 606 bp, Homo sapiens
  misc_feature: GYAE6OF01CJR9Z.33.70.G04.1.454.CMB.1.raw
  modified_base (204)..(204): a, c, t, g, unknown or other
  misc_feature (204)..(204): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtctttgtctccgaggggaaangccaccctctcctgcagggccagtcagagtgctggcagcaacttgcctaggtaaccaaacaaaaacctggaccagacctccaggctcctcatctatgatgcactccacgacgggccacgtggaactcccgagccctaggttcaggtcggctaggtggtctgggacagtaccttcactctacacctatcagcacgccctagacgctagaagtatttgacttagtttatcttgtctgcagtcgtagactaacgtcggtaaccctaaccgtacccgttacgggaacccgaagggaccacggtaccgtagggaaactaacgttaaaaccggtcgttacggtacggtactacggacctacccgtattccgttacgttacctttacacgtttccccttcccggtaacc

SEQ ID NO: 109322 - DNA, 637 bp, Homo sapiens
  misc_feature: GYAE6OF01DQ16Y.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaagagccaccctctcctgcagggccagtcagagtgctggcagcaacttgcctggtaccaaacaaaacctggaccagactcccaggcctcctcatctatgatcgcactccaccgacgggccacgtggccactcccagccctaggttcaggtggctaggtgggtctggggactaggtacttcgactctccaccatcagcagcctagagtcctagtaagttattttgacgttagttttacttacgtgttacgtgtacgtagtacgtagacctaacggttcggaacccttaaccgtacccgtttccgggaacccgtaaacggggacctaacggtaaccgtacgggaacgtaaacgtttaaaacgaaccgttcgggtacgtacggtcgacctaaccgtacttaccgtttcgttacccgtttactaccgttcccgttacccccg

SEQ ID NO: 109323 - DNA, 592 bp, Homo sapiens
  misc_feature: GYAE6OF01CYKQ5.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaagagccaccctctcctgcagggccagtcagagtgctggcagcaacttagcctaggtaccaaacaaaaacctggaccaagacctcccaggcctcctcatctaatgatgcactccaccagggccacgtggcactcccagccaggttcagtggcaggtgggtcgtgggacagtacttcacttctcacatcagcagcctagacgtcctagaagtatttttcgacttaagttttattacgtgtctgctaggtcgtaagcaacgtcgacctaacgtacccgttacggaccgaaagggacacggacgtagggaagtaaacgttaaacgaacgttcggtaggaccttaggaccctaaccgtattacgttcgttacctttacacgtttccccgtaccccg

SEQ ID NO: 109324 - DNA, 526 bp, Homo sapiens
  misc_feature: GYAE6OF01AUM5Q.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaagagccaccctctcctgcagggccagtcagagtgctggcagcaacttagcctggtaccaacaaaaacctggccagactcccaggctcctcatctatgatgcatccaccaggccactggcatcccagccaggttcagtcggcagtgggtctgggacagacttcactctcaccatcagcagcctagacgcctgaagtattttgctagtttatactgtctgcagcgtagcaacgtcggacctaacgacccgttcggacccaagggaccacggactggagtaacttaaacgactggtggactgacaccatcctgtccttcattccgtcccg

SEQ ID NO: 109325 - DNA, 537 bp, Homo sapiens
  misc_feature: GYAE6OF01ANMF6.33.70.G04.1.454.CMB.1.raw
  modified_base (383)..(383): a, c, t, g, unknown or other
  misc_feature (383)..(383): n is a, c, g, or t
  modified_base (503)..(503): a, c, t, g, unknown or other
  misc_feature (503)..(503): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaagagccaccctttcctgcagggccagtcagagtgctggcagcaacttagcctggtaccaacaaaaacctggccagactccaggctcctcatctatgatgcatccaacagggccactggccatcccagccaggttcaggtggcggtggtctgggacagacttcactctcacatcagcagcctagngcctgaagtatttgactagtttatactgtcagcagcgtagcacgtggtcttggacggttcggaccgaagggaccaagggtaggaataccgaaacggtactaggtggcgtcggacaccgtntcctgtcttacacttccgttcccgctaagttcgg

SEQ ID NO: 109326 - DNA, 744 bp, Homo sapiens
  misc_feature: GYAE6OF01CKPJS.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccagggggaaangccaccctctcctgcgagggccagtcagagtgcgtggcagcaacttcgcctacggtaaccaaaacaaaaccgtcggaccaggcctacccgaggtcctcctacactccagtcggtcgactactcccgaaccgacgggcccacgtcggacacgtcccgagaccgtaggttcaggtcggacgtagggtcggtcgtagggacacgtacgttcacgttctacactatcgagcaggtacgtcggacgtccgtaggtaagttagttttacgacgttaaggttacgttaacgtttacgtaggttaccgaacggtaccgtaacgggtttaaccgggtttacgttaccgtaacgtttccccgtaacccgggttaccgggtttacccggggaacccggtaaaacgggggtaacccgtaaaggggttaacggtaaaactacccggtaaaaaccggtacgttagggtacgggtacctacggaaccctaccgttacgtttaccgttacggtttaccctttaccgtaccgtttccccgttccccgtaccgttaacg

SEQ ID NO: 109327 - DNA, 628 bp, Homo sapiens
  misc_feature: GYAE6OF01DG879.33.70.G04.1.454.CMB.1.raw
  modified_base (204)..(204): a, c, t, g, unknown or other
  misc_feature (204)..(204): n is a, c, g, or t
  modified_base (459)..(459): a, c, t, g, unknown or other
  misc_feature (459)..(459): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaagngccaccctctcctgcagggccagtcagagtgctggcagcaacttagcctaggtaccaacaaaaacctggaccagacctccaggctcctcatctatgatgcatccaccagggccacgtggcactcccagccaggttcaggtggctaggttgggtcgtaggggacctaggtacctttcaacttcctacaccactcagcacgcctagacgccttagaagttattttgacttagttttatacgtgtactgcagtcgtanactaactcggtaccctaacgtaccgttacgggaccgtaaacggggacacggaacgttacggaaacgtaaacgtttaaaaccggaacgtttgggtacggacttaccggacccttaaccgtaacgtttccgttacggtttacctttaccctacgtttcccgtttacccccg

SEQ ID NO: 109328 - DNA, 507 bp, Homo sapiens
  misc_feature: GYAE6OF01BE25B.33.70.G04.1.454.CMB.1.raw
  modified_base (367)..(367): a, c, t, g, unknown or other
  misc_feature (367)..(367): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
  modified_base (496)..(496): a, c, t, g, unknown or other
  misc_feature (496)..(496): n is a, c, g, or t
tcagtacacacactcacgaccggtgctcgatttagtgtagtgtgaagggaaagggggaggaactgctcagttaggacccagagggaaccatggaagccccggctcagcttctcttcctcctgctactctggctcccagataccaccgggggaaattgtgttgacacagtctccagccaccctgtctttgtctccaggggaaagagccaccctctcctgcagggccagtcagagtgctggcagcaacttagcctggtaccaacaaaaacctggccagactcccaggctcctcatctatgatgcatccaccagggccactggcatcccagccaggttcagtggcagtggtctgggacagacttcactcncaccatcagcagcctagagcctgaagtatttgctagtttattactgtctgcagcgtagcaacgtggcctaacaccttcggaccaagggacacgactggagattaaacgatgtgntgcacntctgtcttnactctcccgtc

SEQ ID NO: 109329 - DNA, 614 bp, Homo sapiens
  misc_feature: GYAE6OF01EN59Q.33.70.G04.1.454.CMB.1.raw
  modified_base (203)..(203): a, c, t, g, unknown or other
  misc_feature (203)..(203): n is a, c, g, or t
  modified_base (411)..(411): a, c, t, g, unknown or other
  misc_feature (411)..(411): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaangccaccctctcctgcagggccagtcagagtgctggcagcaacttagcctaggtaaccaaacaaaaacctggaccagacctcccaggctcctcatctatgatgcatcccaccgacgggccacgtggccactccccagcctaggttcagtggcaggtgggtctgggacagtacttcactctcacatcagcagcctagacgcctagaagtntttgacttagttttacttacgtgtctgtcagtcgtacgcctaacgtcggtacctaaccgtacccgtttaccgggacctaaacggggaccaacggtacgtagggaacgtaaacgttaaaaccggaacgttgggtacggacttacggaccctaaccgtacgttccgttacgttacctttaccgtaccgttccccgttacccccgg

SEQ ID NO: 109330 - DNA, 522 bp, Homo sapiens
  misc_feature: GYAE6OF01AG7DP.33.70.G04.1.454.CMB.1.raw
  modified_base (202)..(202): a, c, t, g, unknown or other
  misc_feature (202)..(202): n is a, c, g, or t
  modified_base (365)..(365): a, c, t, g, unknown or other
  misc_feature (365)..(365): n is a, c, g, or t
  modified_base (403)..(403): a, c, t, g, unknown or other
  misc_feature (403)..(403): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccacctctcctgcagggccagtcagagtgctggcagcaacttagcctggtaccaacaaaaacctggaccagactcccaggctcctcatctatgatgcatccaccaggccactggcatcccagacaggttcagtggcaggtggtctgggacagacttcattcncacctatcagcagactggagcctgagtatttgctagtntattactgtcagcagtacggtattcatcctcgacgttcggaccaagggaccaaggtgaaatcgaaaacgtacgtggtacgactgccaccattctacgttcttacacttcccttcccgac

SEQ ID NO: 109331 - DNA, 723 bp, Homo sapiens
  misc_feature: GYAE6OF01BM3X9.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccggccaccctgtctttgtctccgaggggaaanagccaccctctcctgcagggccagtcagagtgttagcagcaactacttagcctggtaccagcagacactgccaggctcccaggctcctcactccagtggtgccatcccacgaggcccacgtggcactcccgagacctaggttcaggtcggactaggtcggggtctaggggacacggtaacctttcaaccgttcgtaccaacctacgttccgaacggtcctaacggtacccgttaaggaacccggtccccgttaaagggtaaaacggtttaacgttttttacggaaccgttttaaacggttttttaacgttttaccgttacggttacctaacggaccgtaacgggtaccgtaaccggtacgtaaaccgtttcgggtttaccgtttacggggtacccggtttaccgggaccggtaaacgggaccgtaagggtacggtaaagtaccgaaaacgtaacggtacgtacggtcgtacggtaccgtaacctagtccgttacgttccttactcgttcccgttaccccg

SEQ ID NO: 109332 - DNA, 508 bp, Homo sapiens
  misc_feature: GYAE6OF01DJABO.33.70.G04.1.454.CMB.1.raw
  modified_base (302)..(302): a, c, t, g, unknown or other
  misc_feature (302)..(302): n is a, c, g, or t
  modified_base (370)..(370): a, c, t, g, unknown or other
  misc_feature (370)..(370): n is a, c, g, or t
  modified_base (446)..(446): a, c, t, g, unknown or other
  misc_feature (446)..(446): n is a, c, g, or t
  modified_base (492)..(492): a, c, t, g, unknown or other
  misc_feature (492)..(492): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaattgtgttgacacagtctccagccaccctgtctttgtctccaggggaaagagccaccctctcctgcagggccagtcagagtgttagcagcaactacttagcctggtaccagcagacacctggccaggctcccaggctcctcatccatggtncatccaccagggccactggcatcccagacaggttcagtggcaggtgggtctgggacagcttcatttcncacatcagcagactggagcctgaagtatttgctagtgttattactgttctgcagcgtagcaacgtggtacctaacnccgttacggccgaaggacacgacgtggagtagtaaacgactggtgntcgcacatctgtctac

SEQ ID NO: 109333 - DNA, 793 bp, Homo sapiens
  misc_feature: GYAE6OF01C46PW.33.70.G04.1.454.CMB.1.raw
  modified_base (210)..(210): a, c, t, g, unknown or other
  misc_feature (210)..(210): n is a, c, g, or t
tcagtacacacactcacgaccggtgctcgatttagtgtagtgtgaaggggaaagggggaggaactgctcagttaggacccaggagggaaccatggaacgccccagctcagcttcctcttcctcctgctactctggcctcccagataccgaccggggaaattgtgttgactactagtctccagtccaccctgtcttgtctccgaggggaanacgccacctctcctgcgaggggccagtcagagtcgcgtgcagcaacttagcctggtaaccaaacaaaacctcggaccaagacctaccgtaggcctcctcaatcctagtgactcgcactacccgaacggacgggccctacgtcgggcctaacgtccccaaggacccgtaaggttaccgaagggtggaccgtaaggtcgggtacgtaggggaactacggtacttcgacttccgacgtacccgtaagtccgaacgtcccgaagtccctaggaccgtaccgtaaggtaaacgtttacgttttacgaacgtttaaacggtttacttaaccgttgttaccgtagtaccgtaacgttaccggtaacgtaaccgtaaccggttccgggtaaacccctaaaccggttaacccccggtttaccgggaaaccccgggaaacgggtaacccgaaccgggtaacgttagggaaaccgttaaacggttaaaaccggaacggttacgggttacggggacttccgggaacccgttaaacctaacggttaccggttacggttacccgtttacccgttaaccgtttcccgttaacccccgg

SEQ ID NO: 109334 - DNA, 587 bp, Homo sapiens
  misc_feature: GYAE6OF01BE89V.33.70.G04.1.454.CMB.1.raw
  modified_base (403)..(403): a, c, t, g, unknown or other
  misc_feature (403)..(403): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaagagccaccctctcctgcagggccagtcagagtgctggcagcaacttagcctaggtaccaaacaaaaacctggccagactcccaggctcctcatctatgatgcactccacgacgggccacgtggcactcccagccaggttcagtggcaggtgggtctgggacagacttcactctcacatcagcagcctagacgctagaagtnttttgacttagtttattactgtctgcaggtcgtacgacaacgtcggtaccctaacgtccgttacggaccgaaagggaccaacggtacgtaggaacgtaacttaaaaccggacgttgggtaggacccgtcgaccctaacccgtagttccgttacgtttacccttccgtacttccccgttaccccg

SEQ ID NO: 109335 - DNA, 648 bp, Homo sapiens
  misc_feature: GYAE6OF01ECSWD.33.70.G04.1.454.CMB.1.raw
tcagtacacacactcacgaccggtgctcgatttagtgtagtgtgaagggaaagggggaggaactgctcagttaggacccagagggaaccatggaagccccggctcagcttctcttcctcctgctactctggctcccagataccaccgggggaaattgtgttgacacagtctccagccaccctgtctttgtctccaggggaaagagccaccctctcctgcagggccagtcagagtgctggcagcaacttagcctggtaccaaacaaaaacctggccagactcccaggctcctcatctatgatgcatccaccagggcccacgtcggcactcccagccctaggttccagtcgggcaggtagggtcgtaggggacaggtacttcacctctacaccatcagcacgcctagacgcctaggaacgttattttcgacttaagttttacttaacgttacgtcttggccgtaggtccgttaggacctaaccgtacggtaccctaaaccgtacccgttaccggggaaccgtaaacggggaccaaccggacggtaagggtaaagtaaacgtttaaaaaccggaacttacgggtacggtcgttacggaccgtaacctacttccgtcggttaccttaccttacgttcccgttcccgtaaccc

SEQ ID NO: 109336 - DNA, 595 bp, Homo sapiens
  misc_feature: GYAE6OF01BAYDT.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacgcagtctccaggcaccctgtctttgtctccaggggaaagagccaccctctcctgcagggccaatcagagtgttagcagtaacttagtctggtaccaacatagacctgaccaggctcccaggctcctcatctacgatcgcgtccaacgacgggccactcggcactcccagcctaggttcagtcggcaggtggggtctgggacagacttcactctcaccatcagaccaacctaagaacttgaaagttacttttttactaatttttacttactgttacaactatcgacgcagtctggccttctctacgttcggacgggtacggaccgtaagggtcggacacgtacgaaacggtactggtacggtctacggcctaacctacgttccgttacgtcctttacgtacctttacccgttaccccgcttagttccgtaagg

SEQ ID NO: 109337 - DNA, 642 bp, Homo sapiens
  misc_feature: GYAE6OF01DOSPR.33.70.G04.1.454.CMB.1.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggaaanagccaccctctcctgcagggccagtcagagtgttagcgggtacctagcctggtaccaanagagacctggccaggcctcccgaggtcctccttcttctatgatcgcatacccaacgacggggcccaacgtcggacacgtccccgagcccgaaggttcaggtcgggcgggtggtcgtgggacagtacttcactctcaccatcagcacgcctagacgcctagagtattttgacttagtttatactgtcagcagtcgtagtactaacgtggttcgttacggtacggttacggacccgtaaaggggaccgtaaagggttaggaaacttacgaaaacgtaacgttcggtacggactacggtacctaacccgtagttacccgttcggtttacccttaccgttacgtttacccgttaccccccgtactaacgtttcccggttaaaggg

SEQ ID NO: 109338 - DNA, 547 bp, Homo sapiens
  misc_feature: GYAE6OF01CPJMZ.33.70.G04.1.454.CMB.1.raw
  modified_base (203)..(203): a, c, t, g, unknown or other
  misc_feature (203)..(203): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (404)..(404): a, c, t, g, unknown or other
  misc_feature (404)..(404): n is a, c, g, or t
  modified_base (416)..(416): a, c, t, g, unknown or other
  misc_feature (416)..(416): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtctttgtctccaggggaaanagcccaccctctcctgcagggccagtcagagtgctggcagcaacttagcctggtaccaaacaaaaacctggaccagactcccaggctcctcatctatgatgcactccacacgggccactggcatcccagccaggttcagtggcaggtgggtctgggacngacttcactcncaccntcagcagactggacgccgtagaagtnttttgactagtnttattacgtgtcagcagcgtagactacgtggtcgttgggtaccgttcggaccgtaagggaccgaaggtcggaaataccgaaagacgtgtggactgaccctactagtctgttaccttcacgttcccgtcccg

SEQ ID NO: 109339 - DNA, 560 bp, Homo sapiens
  misc_feature: GYAE6OF01AGET8.33.70.G04.1.454.CMB.1.raw
  modified_base (414)..(414): a, c, t, g, unknown or other
  misc_feature (414)..(414): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagcccaccctctcctgcagggccagtcagagtgctggcagcaacttagcctggtaccaacaaaacctggccagactcccaggctcctcatctatgatgcactcccaccgacgggccacgtggcactccccagccgtaggttcaggtcggcaggtgggtctggggacaggtacttcactctacaccatcagcacgcctagacgcctagaagtntttgcttagtttatactgtcagcagtcgtagctacgtggtcttggaccgttcggaccgaacgggtaccaagggtacggaaactcgaaaacgtacgtggtcggactgcccactagttcgtcgttcttacgacttcccgttcccgacc

SEQ ID NO: 109340 - DNA, 788 bp, Homo sapiens
  misc_feature: GYAE6OF01D254A.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaangcccaccctctcctgcgagggccagtcagagtgctggcagcaacttgcctaggtaaccaaacaaaaccgtggaccaagacctcccgaggcctcctcatctatgatgcactccacgacggccacgtcggaccacgtcccagccgtaggttcaggtcggacgtaggtcgggtcgtagggactacggtacttcctacgtctaccgaacctatacgacgtcacggtaccctaagggaccgtccgttaggtaaacgtttgttttacgaaccgttttaagttttaaccttacgttcggttaccgtacggtaccgtaacggttacgttaacgaacccgttaaaccggttacccgggttaaacccctttaaaccccggttaccccgggttttaaccccggggaaaccccggtaaaacgggggtaaccccgtaaacccggggtaacgttaacggggtaaaaccgttaaaaccgtttaaaaacccgggtacggtttacggggtacggtacccttaaccggaacccgtaaaccgttacgtttcccgttaacggtttaccctttacccgttaacccgtttcccccgttaacccccgg

SEQ ID NO: 109341 - DNA, 681 bp, Homo sapiens
  misc_feature: GYAE6OF01DVSZ5.33.70.G04.1.454.CMB.1.raw
  modified_base (200)..(200): a, c, t, g, unknown or other
  misc_feature (200)..(200): n is a, c, g, or t
  modified_base (312)..(312): a, c, t, g, unknown or other
  misc_feature (312)..(312): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggagaaattgtgttgacacagtctccggccaccctgtctttgctccgagggaangccaccctctcctgcagggccagtcagagtgttagcggtacctagcctggtaccaagagagacctggccaggcctcccgaggcctcctcatctacgatcgccgtccaaacgngggcccacgtggcactccccgagcccgtaggttcaggtcggcgagggttcgggtcgtgggacaggtaccttcgactcctacacctatccacgacctaaaccgtaagtaactttagtaaacgtttactttttacttaattttttaactttacttagttaaccaaactattaccgaacggtctaacgtccttacgggtccccttcttccttaccggttttcgggaccgggtaacggggaaccgtaaaggggtcgggtaacgtaccgttaacgtaaacggtaacgttcggtcggtaccgtacgacctacccgtattccgtttcgttacctttactaccttcccgtttaccccgacttacttcgtggtaacgg

SEQ ID NO: 109342 - DNA, 611 bp, Homo sapiens
  misc_feature: GYAE6OF01CPT4X.33.70.G04.1.454.CMB.1.raw
  modified_base (203)..(203): a, c, t, g, unknown or other
  misc_feature (203)..(203): n is a, c, g, or t
  modified_base (430)..(430): a, c, t, g, unknown or other
  misc_feature (430)..(430): n is a, c, g, or t
  modified_base (445)..(445): a, c, t, g, unknown or other
  misc_feature (445)..(445): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaancgccaccctctcctgcagggccagtcagagtgctggcagcaacttgcctggtaaccaaacaaaactggaccagactccaggctcctcatctatgatgcactccaccgacgggcccaacgtcggcactcccagccaggttcagtggcaggtgggtactgggacagtacttcactctaccacatcagctagcctagacgtcctagaactatttgacttagtttatcgtntctagctagcgtaancctaacgttcgacccttaacgtacccgttcggaaccgaacgggtaccaccggacgttaaggaacgttaaacttaaaaccgggacgttggtaccgggtacttacggacctaaaccctacgtttaccctacgggtttacccttaccgtaagttccccgtttaccccgg

SEQ ID NO: 109343 - DNA, 578 bp, Homo sapiens
  misc_feature: GYAE6OF01A45C4.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaagagccaccctctcctgcagggccagtcagagtgctggcagcaacttagcctggtaaccaaacaaaaacctggccagactcccaggctcctcatctatgatgcatccaccagggcccactggcactcccagccaggttcagtggcagtgggtctgggacagacttcactctcacatcagcagcctagacgcctagaagtatttgctagtttatactgtctcgcagcgtagctaacgtcggaccctaacgcccttacgggaccaaacgggaccacgacgtgggaaacgtaaacgttaaacggaacgttcgggtacggtaccttacggacccaacccgtaagttccgtgtttaccttcctaacgtttcccgttacccccgg

SEQ ID NO: 109344 - DNA, 875 bp, Homo sapiens
  misc_feature: GYAE6OF01DMG59.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccacctgtctttgtctccgaaggggaagagccaccctctcctgcagggccagtcagagtgctggcagctaaacgttcgccgtacggtaaccaaaacgtaaaaaaccgtcgggacccaacggaacctaccccgaagggtcccttaccctactaacttaccgttaattaggaaacgttcggaccgtaaccttaacccccgaaacccggtaacgggggtaccccaaaccggttcggggaacccctaaaccttcccccgaaacggtccccggttaaggggtttaccgaacgggttcgggaccgtaaggggttcgggggttaccggttaggggaacctaaggtaccctttaccgaccttaccgttactaactttaacgtccgtaacgaccgaacgtcccgttaaaggacggtacccgttaaggtaaacgtttaacgttttttcggaaccgttttaagttttttaaaccgtttaaccgtttcggttaccgtttaacggaccgttaacgggtaccggtttaacgtacccgttaaacgttccgggtaacccctttaaaccggtaccccggtttaaccgggaacccgtaaacggggacctaaccggtaaccgtaggtaaacgttaaaccgttaaacgaacggttcggtaggacctacggacctaacccgttagttccgttacgttaccttactcccgtttccgtaccccg

SEQ ID NO: 109345 - DNA, 600 bp, Homo sapiens
  misc_feature: GYAE6OF01A12SC.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaagagccaccctctcctgcagggccagtcagagtgctggcagcaacttagcctggtaaccaaacaaaaacctggaccagacctcccaggctcctcatctatgatgcactccaccgacggccacgtggcactccccagcctaggttcaggtcggcaggtggtcgtgggacagtactcactctcacatcagcacgcctagacgcctagtaagtagtttgacttagttttactacgttgtctgacagtcgtagactaacgtcggtaacctaaccgtaccgtaccggaccgaacgggaccaacggtacgtaggaacgtaaacgttaaaaccgacggttcggtacggtacctcgacctaacctacgttccgttacgttacctttcgtacctttcccgttaccccg

SEQ ID NO: 109346 - DNA, 967 bp, Homo sapiens
  misc_feature: GYAE6OF01DRROG.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaattgtgttgacacagtctccagccacctgttctttgtctccgaaggggaaagcgcccaccctctcctgcgacgggccagtcagagtgcgtggcagctaacttcgcctacggtaaccaaaaccaaaaaccgtcggacccaacgtaccctaccccgacggtcccttaccctactaacttctaacgttggaacttcgacctaaccgttaccccgaacccggtaaccggggacccctacggttaccgggaccctaaccgttacccccgaacggtaccccgttaacggggtttaccgaacgggttacgggtaccggttaacgggtttcgggggttaccggttacgggggaaaccttaacgggtttaccctttaccgtaacccgtttccctaaccctaacccgtaacgttacccgaacgggtacccgtaaccggtacccgttaacgggaaccgtacccgtttaagggttaaacgttttacgttttttaccggtaacgttttaaacgttttttaacgtttaccgtttacggtttaccgttacggtacccggttaacggttacccggttaacgtacccgttaaacccgggttcccgggttaaacccccttaaacccgttaaccccgggtttaaccgggaaacccggtaaacgggggtaaccctaaccggggtaaaccggttaacggggtaaaaccgttaaaacggtttaaaaacccggtacggtttaccgggttacggtaccgttacggaacccctaaccgtttaaccgttcccgtttaccgtttacccgttttaccgtacccgtttccccggttaacccccg

SEQ ID NO: 109347 - DNA, 565 bp, Homo sapiens
  misc_feature: GYAE6OF01AZQIS.33.70.G04.1.454.CMB.1.raw
  modified_base (200)..(200): a, c, t, g, unknown or other
  misc_feature (200)..(200): n is a, c, g, or t
  modified_base (528)..(528): a, c, t, g, unknown or other
  misc_feature (528)..(528): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccaggggaangccaccctctcctgcagggccagtcagagtgctggcagcaacttagcctggtaccaacaaaaacctggccagactcccaggctcctcatctatgatgcatccacaggccactggcactcccagccaggttcagtggcagtggtctgggacagacttcactctcaccatcagcagccctaggacgcctggaacgtattttcgctaggtgttatttactgtacagcctaggtacggttattcattcctccggaacggtttccggaccgtaaagggaccctaagggtacggaaaatcgaaaacgtacgtggtggtacctggcccaaccgtnttcttcggttaccttacgacttcccgttccccgaccg

SEQ ID NO: 109348 - DNA, 569 bp, Homo sapiens
  misc_feature: GYAE6OF01AFX3J.33.70.G04.1.454.CMB.1.raw
  modified_base (202)..(202): a, c, t, g, unknown or other
  misc_feature (202)..(202): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
  modified_base (460)..(460): a, c, t, g, unknown or other
  misc_feature (460)..(460): n is a, c, g, or t
tcagtacacacactcacgaccggtgctcgatttagtgtagtgtgaagggaaagggggaggaactgctcagttaggacccagagggaaccatggaagcccccagctcagcttctcttcctcctgctactctggctcccagataccaccggggaaattgtgttgacacagtctccagccaccctgtctttgtctccaggggaangccaccctctcctgcagggccagtcagagtgctggcagcaacttgcctggtaccaaacaaaacctggaccagacctcccaggcctcctcatctatgatgcactccaccgagggcccactcggccactccccgagcccagggttcaggtcggcaggtcgggtctgggacagtacttcactctacacctatcacgctaacctagaacttgaagttacttttctaattttatactgtacactntacacgnagctgtccctntctacgtttcggacggtacggaccgaagggtcgacgtctaacgaaacgtacgtggtcggcctaggcctacctagttcttacgttcttactacttcccgttcccgctacg

SEQ ID NO: 109349 - DNA, 659 bp, Homo sapiens
  misc_feature: GYAE6OF01A9U8I.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaangccaccctctcctgcagggccagtcagagtgctggcagccaacttgcctggtaaccaaacaaaacctggaccagacctcccaggcctcctcatctatgatgcatcccaccgacgggccacgtggcactcccagccgaggttccagtcggcgaggtgggtcgtggggacagtacttcactcctcaccgtatccagcacgacctagacgtcctaaggaagttactttacgactttaagttttaacgttaccttggttcgtcgtacgtaggtccgttaagaccctaacggtccggtaaccctaaccgtaccccgttacgggaacccgtaaaggggtaccctaaccggtacgttacgggtaaacttaaccggtttaaaaacggaccggttaggtaccgggacttaccgggaccctacgtacttaccgttcgttacttccttaacgttccccgttaccccg

SEQ ID NO: 109350 - DNA, 749 bp, Homo sapiens
  misc_feature: GYAE6OF01BKTKP.33.70.G04.1.454.CMB.1.raw
  modified_base (201)..(201): a, c, t, g, unknown or other
  misc_feature (201)..(201): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccgggaaattgtgttgacacagtctccagccacctgtctttgtctccgaggggaanacgccaccctctcctgcaggccagtcagagtgctggcagctaacgttagcctacggtaaccaaaacgaaaaaaccgttcggacccaacggaacctcccgaagggtccttccctacaacttcctaattgaacttgcctaactcccgaaccgacgggcccaacgtcggaccaactccccaaggtcccctaagggtttccgaaggttcgggaccgaagggttcggggtaccgtggggaaccagggtacccttcgaaccgtccctacaaccctagtccaacgtccacgtccgtaaggacgtccctaaggtaagttatttttcggacgtttaagtttttaactttaccttcggtacttcggtacaagggtccgttaacgtaccgtaacccgttcggtaaccccttaacgaccccgggtttaccggaacccgtaaagggaacccctacggaaccgttagggaaacttaccggtaaaacgtaaccggtggttaggccttacggaacctaccgtaagtttccctacgtttaccttacgtccttcccgttaaccccg

SEQ ID NO: 109351 - DNA, 759 bp, Homo sapiens
  misc_feature: GYAE6OF01D1HWO.33.70.G04.1.454.CMB.1.raw
  modified_base (196)..(196): a, c, t, g, unknown or other
  misc_feature (196)..(196): n is a, c, g, or t
  modified_base (708)..(708): a, c, t, g, unknown or other
  misc_feature (708)..(708): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccacctgtcttgctcagggaangccacctctcctgcagggccagtcagagtgctggcagacaattagccttaggaaccaaaacaaaaccgtggaccaagtaccgtcccaaggcctcctacgacttccagtcggtcgactacgtaccgaccgacgggtccaacgtcggacctactaccccgaagaccgtaggttaccaggtcggccgtaagggttcggtacgtaggggacctaggttaccttactacgtttccgtaccgaacctagttaccgaacgggaccctaacgggttacgttacggggaacttacccggttaagggttaaacggtttaacgttttttcggaccgttaaggtttacgtttaaacgtttacgtacggttaccaacgggtacttaccgggtttaacggtttacgttcgtaacgttcccgttacgggtaccggttaccggtaaaccggaaacgggtaccgtaaagggttacgaaaacctacggaaaaaccgtcggtacggttacggacctaggaccttaaccgtnttacccggttacgttccttaccgttagttccccgttacccgctttaaacgg

SEQ ID NO: 109352 - DNA, 653 bp, Homo sapiens
  misc_feature: GYAE6OF01CS71S.33.70.G04.1.454.CMB.1.raw
  modified_base (202)..(202): a, c, t, g, unknown or other
  misc_feature (202)..(202): n is a, c, g, or t
  modified_base (473)..(473): a, c, t, g, unknown or other
  misc_feature (473)..(473): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttagcctggtaccaacaaaaacctggaccagacctcccaggctcctcatctatgatgcactccaccagggccacgtcggacactcccagcctaggttccagtcggacaggtcgggtacgtaggggactacggtacttcaacttcctacgacctatcaagccagacccgtagacgcctaggaacgtagttttgacttaagtttacttacgtgttctcgtcagtcggttanaccgtaacttccggacctaacgtacccgttcggacctaaacgggaccacggtaacgtacgggaacgtaaacgtttaaaccggtaacgttacggtacggtaccgtacggtacccgtaaacccgttacgttaccccgtttagtttaccccgtttaccttaccgtttcccccgtttacccccg

SEQ ID NO: 109353 - DNA, 710 bp, Homo sapiens
  misc_feature: GYAE6OF01AZVTZ.33.70.G04.1.454.CMB.1.raw
  modified_base (199)..(199): a, c, t, g, unknown or other
  misc_feature (199)..(199): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccacctgtctttgtctcaggggaangccacctctcctgcagggccagtcagagtgttagcagcaactacttagcctggtaccagcagacacctggccaggcctcccaggcctcctcatccagtggtcgcactccaccgagggccacgtcggcactcccagacctaggttccaggtcggacgaggttggggtctaggggaacaggtaccttcgattcctaccacctatcacgtcacgtacgtacgggacgtaccgttagtaaacgttacgttttgaccgttaagttaggtttaactttacggttcgtacgtacggtaccgtaacgggtttacggttaacgtttaccgtaaccgtttccgtaaccccggggtttaaccgggtttacccggggtaacccgggaaacggggttaacccgtaaaacggggttacgggtaaaaaccttaaccggtaaaaaccgggtaaaccgttgggtacgggtacccgtaggtaacccacccgttattaccgtttagttccttacgttcccgtttaccccg

SEQ ID NO: 109354 - DNA, 551 bp, Homo sapiens
  misc_feature: GYAE6OF01D9JI2.33.70.G04.1.454.CMB.1.raw
  modified_base (399)..(399): a, c, t, g, unknown or other
  misc_feature (399)..(399): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggagaagagccaccctctcatgcagggccagtcagagtattagcatcttcttggcctggtaccaacagaacctggccaggctcccagcctcctcatccagaatgcattcaacagggccacgtggcactcccagccaggttcagtggcaggtgggtctgggacagtacttcactctcaccatcagcagcctagacgcctgacggtnttctgctagttttacttactgtcagctagcgttctactaaccgtcggtcccttccggtgccctaccgtccgggaccaaaggggaccacggtagttggaagtattacggacgtaacgtggtacgtcgtacggaccctacccgttgtcgttccc

SEQ ID NO: 109355 - DNA, 577 bp, Homo sapiens
  misc_feature: GYAE6OF01CZ1J6.33.70.G04.1.454.CMB.1.raw
  modified_base (204)..(204): a, c, t, g, unknown or other
  misc_feature (204)..(204): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtctttgtctccgaggggaaangcccaccctctcctgcagggccagtcagagtgctggcagcaacttagcctaggtaccaaacaaaaactggccaagacctcccaggctcctacatctatgatgcactccaccgagggccactggcactcccagccaggtcagtggcaggtgggtctgggacagtacttcactctcaccatcagcagcctagcgcctagaatattttgacttagtttatactgtctgcagtcgagcaacgtcgaccttaactccgttccggacgtaagggacctacgacgttagggaaacgtaacgtttaaacggacgttggtacgggtccttacgaccctaaccgtacttccgttacgttccttactacgttcccgttaccccg

SEQ ID NO: 109356 - DNA, 582 bp, Homo sapiens
  misc_feature: GYAE6OF01C07CO.33.70.G04.1.454.CMB.1.raw
  modified_base (201)..(201): a, c, t, g, unknown or other
  misc_feature (201)..(201): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaattgtgttgacacagtctccagccaccctgtctttgtctccaggggaaangccaccctctctgcgagggccagtcagagtgctggcagcaacttagcctaggtaccaacaaaaacctggaccaagacctccaggcctcctacatctatgatgcactccaccaggccacgtgcactccagctggtcagtcggcaggtgggtcgtaggggacacgtacttacacttcctacaccgatcgacgcagtaccgtagacgtaccgtagtaaagttattttcggacttaagttttattactgttactgatacgcgttacgactaacgtcgaccctaacgtacccgttaggacccgtaaggaccacgtagtacggaataacgtaacgagtgtaggcctaggacctacattccgtacgttactcgtacctccgtaccccg

SEQ ID NO: 109357 - DNA, 760 bp, Homo sapiens
  misc_feature: GYAE6OF01DNG7T.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaattgtgttgacacagtctccagccacctgtctttgtctccgaggggaaancgccaccctctcctgcgagggccagtcagagtgctggcagcaacttagcctaggtaaccaaacaaaaacctggaccaagacctccgaggcctcctctatctatgatcgcactccgaccgagggcccacgtcggacactccccagcctaggttcaggtcggacgtaggtcgggtacgtaggggactagtacctttcaccgttcctacaccagttacacgacgtaacgtacccgttaaggaacgtaccgtaaggtaaaggttactttttacggaactttaaggtttttaactttacgttggtttaccctacggtaccgtaacgggttaccggttaacgtaacccgttaacggttacccggtaacccgtttaaacccggtacccggtttaacccgggaacccggtaaaacggggtaaccctaaccgggttaacggtaacgggtaaacgttaaaacgttaaaacccggtaacggttcgggtaacggtaccgttacggaacccttaacccgtaacgtttccgttacgtttacctttacccgtaaccgtttccccgttaccccg

SEQ ID NO: 109358 - DNA, 508 bp, Homo sapiens
  misc_feature: GYAE6OF01CKZ99.33.70.G04.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
  modified_base (487)..(487): a, c, t, g, unknown or other
  misc_feature (487)..(487): n is a, c, g, or t
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctntcctgcagggccagtcagagtgctggcagcaacttagcctggtaaccaacaaaaacctggaccagactccaaggctcctcatctatgatgcatccaccaggccactggcatccagccagtcagtggcaggtggtctgggacagacttcactctcaccatcagcagcctagacgcctagaacgtattttgactagttctattactgtcagtcagtatacgngggaacncgttcggacgaagggaccaaggtagaatanaaacgatgngctgacacntctgtctnactctccncntcg

SEQ ID NO: 109359 - DNA, 636 bp, Homo sapiens
  misc_feature: GYAE6OF01CKAWM.33.70.G04.1.454.CMB.1.raw
  modified_base (632)..(632): a, c, t, g, unknown or other
  misc_feature (632)..(632): n is a, c, g, or t
tcagtacacacactcacgaccggtgctcgatttagtgtagtgtgaagggaaagggggaggaactgctcagttaggacccagagggaaccgtggaagccccagctcagcttctcttcctcctgctactctggctcccagataccaccggggaaattgtgttgacacagtctccagccaccctgtctttgtctccgaggggaaagacgcccaccctctcctgcgacgggccagtcagagtgctggcagccaacttacgcctaggtaacccaaactaaaaaccgtggaccagacctcccgaggtcctcctcatctatgatgacacgtccaacgcgggaccacgtggccactcccagcccgaaggttcaggttcgcgtggtcggtcgtgggacagtaccttcgactctaccgaccagtccagtacgacgtactcgggacgccgttaagacgtttactttgacgtagtaccgtttatacgtgtacgagtccgtaaggttacgttattcctacgttcccgtaccggaggtttaccgggaccgtaaacgggtacgtaacgggtacgaaaacctcgaaaccgtaacgtggtacgacttggacccacgtattcggtcttacctactacgttccctcccgtntacg

SEQ ID NO: 109360 - DNA, 551 bp, Homo sapiens
  misc_feature: GYAE6OF01CMCN7.33.70.G04.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (398)..(398): a, c, t, g, unknown or other
  misc_feature (398)..(398): n is a, c, g, or t
  modified_base (444)..(444): a, c, t, g, unknown or other
  misc_feature (444)..(444): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagngccatcctctcctgcagggccagtcagagtgctggcagcaacttagcctggtaccaaanaaaacctggaccagactccagctcctnatctatgatgcatccaccaggcccacgtggcatcccagccaggttcagtggcagtgggtctgggacagacttcactctacacctatcagcagcctagagcctagaagtntttgactagtttatacttgtctgcagcgtagcaacgtgacctaacncgttcggaccaaagggcaacgacgtggaaacgtaacgttaaacgaacgttaggtacggtacgttacgaccgtaacctacgttacttgttacctttcgtacttccccg

SEQ ID NO: 109361 - DNA, 582 bp, Homo sapiens
  misc_feature: GYAE6OF01A30WF.33.70.G04.1.454.CMB.1.raw
  modified_base (203)..(203): a, c, t, g, unknown or other
  misc_feature (203)..(203): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaangccaccctctcctgcagggccagtcagagtgctggcagcaacttagcctggtaccaaacaaaacctggccagactcccaggctcctcatctatgatgcactcccaccgagggcccacgtggccactcccagccaggttcaggtggcaggtgggtctgggacagacttcactctcaccatcagcagctagngcctagaagtntttgacttagtttatacgtgttactgcgagtcgtagcctaacgtcggaaccctaaccgtaccgttccgggaccgaacgggaccacggacgtacgggtaataaacgttaaaccgaacgttggtagggccttgacccaaccgtattccgttacgttcctttccacgttcccgttaccccg

SEQ ID NO: 109362 - DNA, 610 bp, Homo sapiens
  misc_feature: GYAE6OF01AOJ0H.33.70.G04.1.454.CMB.1.raw
  modified_base (200)..(200): a, c, t, g, unknown or other
  misc_feature (200)..(200): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccacctgtctttgctccgaggggaancgccaccctctcctgcagggccagtcagagtgctggcagcaacttagcctggtaccaacaaaacctggccagactcccaggctcctcactctatgatcgcactccaccgacgggccacgtggcactcccagccaggttcagtggctaggtgggtctgggacagtacttcgactcctaccacctactcacgccacgcctaagacgtccgtagtaacgttattttacgactttaagttttacttacgttgttactgcgacgtacgtacgacctaacgtcggtaaccctaaccgtacccgttaccggaccgaagggaccacggacgtaggaacgtaaacgttaaaccggacgttggtacggtctacggacctaccgtacttcgttacgttacctctccgttcccgttaccccg

SEQ ID NO: 109363 - DNA, 574 bp, Homo sapiens
  misc_feature: GYAE6OF01C2V9V.33.70.G04.1.454.CMB.1.raw
  modified_base (398)..(398): a, c, t, g, unknown or other
  misc_feature (398)..(398): n is a, c, g, or t
tcagtacacacactcacgaccggtgctcgatttagtgtagtgtgaagggaaagggggaggaactgctcagttaggacccagagggaaccatggaagccccggctcagcttctcttcctcctgctactctggctcccagataccaccggggaaattgtgttgacacagtctccagccacctgtctttgtctccgaggggaaagagccaccctctcctgcagggccagtcagagtgctggcagcaacttagcctaggtaaccaaacaaaaacctggaccaagacctcccaggcctcctcatctatgatgcatccaaccgagggccactggcactcccagccaggttcaggtgcgaggtggtctgggacagtacttcactctcacatcagcagcctagacncctagaagtatttgactaagttttatacgtgtctgacaggcgtagactaacgtcggaaccctaacgtacccgttacggaccgaaagggaccaacggtacgtaggaagtaattaaaaccggacgttggtaggctagacccacctaattcgtcgttacttacacgttcccttcccgac

SEQ ID NO: 109364 - DNA, 754 bp, Homo sapiens
  misc_feature: GYAE6OF01BMFC1.33.70.G04.1.454.CMB.1.raw
  modified_base (201)..(201): a, c, t, g, unknown or other
  misc_feature (201)..(201): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccacctgtctttgtctccgaggggaanagccaccctctcctgcagggccagtcagagtgctggcagcaacttagcctaggtaaccaaacaaaacctggaccagacctcccaggcctcctcatctatgatcgactactcccaaccgacgggcccacgtcggacactcccagcccaggttccaggtcggacgtaggtcgggtacgtaggggaccacggtactttccgtacctcctaccaacctagtccaacgcgacgtccgtaaggaccgtcctaaggtaaacgttagttttcgacctttaagttttaactttacgttacgtacgacgacgtacggtcgttaacgtacgtaaccggttgggtttaccgtttacggggtaaccggtttacccggggaacccggttaaaacgggggtaacccgtaaaggggttaacggaaaaaccgttaacccggaaaaaaccgggttaacggttcgggtaacgggttaccgtacccggtaacccgtaaccccgttaggtttaccccgtttaccggttacccttttaaacccgtcccgttttcccccgttacccccggtaaccc

SEQ ID NO: 109365 - DNA, 580 bp, Homo sapiens
  misc_feature: GYAE6OF01D1S0G.33.70.G04.1.454.CMB.1.raw
  modified_base (389)..(389): a, c, t, g, unknown or other
  misc_feature (389)..(389): n is a, c, g, or t
  modified_base (399)..(399): a, c, t, g, unknown or other
  misc_feature (399)..(399): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaaccaaacaaaaacctggaccagacctcccaggctcctcatctatgatgcatccaccagggccactgcatcccagccaggttcagtggcagtgggtctgggacagacttcactctcaccatcagcagcctagancctagaagtntttgactagtttattactgtctgcagcgtagctaacgtcggtaccctaacgacccgttcggacccgaaacgggacacggtacgtacgggtaaagtaaacgttaaaaccggaacgttggtaggtacgtcgacctacccgtaacgttccgttacgttacctttaccagtttcccctaccccgg

SEQ ID NO: 109366 - DNA, 733 bp, Homo sapiens
  misc_feature: GYAE6OF01DRVXC.33.70.G04.1.454.CMB.1.raw
  modified_base (199)..(199): a, c, t, g, unknown or other
  misc_feature (199)..(199): n is a, c, g, or t
tcagtacacacactcacgaccggtgctcgatttagtgtagtgtgaagggaaagggggaggaactgctcagttaggacccagagggaaccatggaagcccagctcagcttctcttcctcctgctactctggctccagataccaccggggaaattgtgttgacacagtctccagccacctgtctttgtctccaggggaaangccaccctctcctgcgagggccagtcagagtgctggcagcaacttagcctaggtaaccaaaacgaaaaacctcggaccaagacctcccgaacggtccttcctactatactatagatgcactacccacgacgggccaactcggacactcccgagaccgtagttcgaggtcggacgtacggttcggggtcgtacggggactacggtacctttacgaacttcctacaaccctataccacggactacgaccgtaagacgtaccgttagaaacgttatttttacggactttaagttttactttacgtgttccgttacgtctaacgggtcggttaacaccgttaacggttaccggaacccttaaacgtaccccggtttacgggaaacccggtaaagggaacccgtacgggtaaccgtaacgggtaacgttaaaacgtttaaaacccggaacggttacgggttaggtaccgttcgaacccgtaccgttaacgtttccgttacggtttacccttttaccgaacgttttccccgttaaccccg

SEQ ID NO: 109367 - DNA, 701 bp, Homo sapiens
  misc_feature: GYAE6OF01B3X8T.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaaccaaacaaaaacctgaccagacctcccaggctcctcatctatgatgcactcccaccgacgggcccacgtcggaccactccccagccctaggttccaggtcggccgaggtcgggtcgtacggggactacggtacctttcacttctaccaaccatcaacgtcaacggtccctaaggacgtacccgttaggtaaaacgttattttttacggactttaacggtttttaactttacgttggttaccttggaccgtacggtcggttaacgacctaaccggtcggtaccccttaaaccgtacccgttaccgggaccgtaaacggggacccaaccggtacgtaacgggtaacgttaaacgttaaaacccggtaacgtggttaacgggcgttacggaccctaacccgtagttccctttacgttaccctttccctaccgtttccccttcccccg

SEQ ID NO: 109368 - DNA, 726 bp, Homo sapiens
  misc_feature: GYAE6OF01C1FBJ.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagcccagctcagcttctcttcctcctgctactctggctccagataccgaccggggaaattgtgttgacacagtctccagccaccctgtctttgtctccgaggggaaancgccacctctcctgcaggccagtcagagtgctggcagcaacgttacgcctaggtaaccaaaacgaaaaaccgtggacccacgacctccgaggcctcctcatctatgatcgctactacccgaccgacgggcccacgtcggacctactcccgaacgccgtacggttacgacggtggcgtaggttcgggtacgtaggggaactaacgtaccgttcgacctctaccaacctataccgacgaccgacggtaccctaggaaccgtccgtaaggttaaagtttacgtttttacggaactttaagtttttaacgtaccgtttaggttcctaggtacctaggttaaccgtaacgtaccgtaacggttccgttaacccgtaaacccgttcccggttaaccgggaacccgtaacggggtacctaaccggaacggttaggaaacgtaaacgttaaaccggtacgtcgggtacggtactacggtaaccctacgttacttaccgttacgttcccttacgttccttcccggttaccccg

SEQ ID NO: 109369 - DNA, 565 bp, Homo sapiens
  misc_feature: GYAE6OF01BXWHN.33.70.G04.1.454.CMB.1.raw
  modified_base (200)..(200): a, c, t, g, unknown or other
  misc_feature (200)..(200): n is a, c, g, or t
  modified_base (553)..(553): a, c, t, g, unknown or other
  misc_feature (553)..(553): n is a, c, g, or t
tcagtacacacactcacgaccggtgctcgatttagtgtagtgtgaagggaaagggggaggaactgctcagttaggacccagagggaaccatggaagccccagctcagcttctcttcctctgctactctggctcccagataccgaccggggaaattgtgttgacacagtctccagccacctgtctttgctccgaggggaangccacctctcctgcagggccagtcagagtgctggcagcaattagcctaggtaaccaaacaaaaaccgtggaccagactcccaggctcctcatctatgatgcatccacgacggccacgtggccactcccgagccgtaggttcaggtggctaggtgggtcgtagggactagacttcactctcacatcgagcacgctagacgtctagagttagtttcgacttaagttttatacgtcgtactgacaggtctagacctaacgtcgacctaaccgtcgttccggaccgaaggaccaggacgtaggacgtaaattaaaccggacgtggtagctacgacctactacttcgttcgtacttcncttccgtacccg

SEQ ID NO: 109370 - DNA, 694 bp, Homo sapiens
  misc_feature: GYAE6OF01BT8BH.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccacctgtctttgtctccaggggaaagagccaccctctcctgcagggccagtcagagtgctggcagcaacttagcctggtaccaaacaaaaacctggaccagacctcccaggcctcctacactctatgatgcactacccaaccgacgggcccacgtcggccactcccacgccgtaggttccaggtcggacgtacggttgggtccgtaggggacacgtacttccgactccgtaccaccatacgagaccacgacctagacgaccgtaggtaagttattttgacttaagttttacttacgtcgtacacgtacacggtacgtaacggaccgttaacgttcgggtacctttacggggaccgggtttacccggaccgggtaaaggggtaacccgtaaagggttacggaaaacgttaaccggaaaaaccgggttaacgttacgggtacgggtacttacggtaccctaacccgtagttccgttcgtttacccgtttaaccttacgttccccggttttacccccgaccg

SEQ ID NO: 109371 - DNA, 596 bp, Homo sapiens
  misc_feature: GYAE6OF01C5RA1.33.70.G04.1.454.CMB.1.raw
  modified_base (204)..(204): a, c, t, g, unknown or other
  misc_feature (204)..(204): n is a, c, g, or t
  modified_base (437)..(437): a, c, t, g, unknown or other
  misc_feature (437)..(437): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaaccgggggaaattgtgttgacacagtctccagccaccctgtctttgtctccaggggaaanagcccaccctctcctgcagggccagtcagagtgctggcagcaacttagcctaggtaccaaacaaaaacctggaccaagacctcccaggcctcctacatctatgatgacactccaccgagggccacgtcggcactccccagcccgtaggttcaggtcggactaggtgggtcgtaggggactagtactttcacttcctacaccatcacgcacgacctagacgtccgtagtaagtnttttgacttaagttttacttacgttgtctgctagtcgtaagcctaacgtccggtaacccttaacgtaccgttacggaccgtaacgggactacggacgtaggaagtaactaacgacgtggtagcctgacccactgtctagttacctctcttcccgtcccg

SEQ ID NO: 109372 - DNA, 606 bp, Homo sapiens
  misc_feature: GYAE6OF01DCU39.33.70.G04.1.454.CMB.1.raw
  modified_base (202)..(202): a, c, t, g, unknown or other
  misc_feature (202)..(202): n is a, c, g, or t
  modified_base (417)..(417): a, c, t, g, unknown or other
  misc_feature (417)..(417): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagataccaccggggaaattgtgttgacacagtctccagccaccctgtctttgctccgaggggaaagngccaccctctcctgcagggccagtcagagtgctggcagcaacttagcctaggtaaccaaacaaaaacctggaccagacctcccaggcctcctcatctatgatgcactccaccgacggccacgtggcactcccagccaggttcaggtcggcgaggtcggggtctaggggacaggtacttcactctacaccatcagcagcctagacgcctagaagtnttttgacttagtttacttactgttcgtgacgtagtcgtagctaacgtcggaccttaaccgtccgttaccgggaaccgtaagggaccacggtacgtagggtaacgtaaacgttaaaccgacgttagggtacggtcttacggacccgtacctagttccgttacgttctttacctacgttcccgttaccccg

SEQ ID NO: 109373 - DNA, 649 bp, Homo sapiens
  misc_feature: GYAE6OF01BDWI2.33.70.G04.1.454.CMB.1.raw
  modified_base (200)..(200): a, c, t, g, unknown or other
  misc_feature (200)..(200): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagataccaccggggaaattgtgttgacacagtctccagccaccctgtctttgtctccaggggaanagccaccctctcctgcagggccagtcagagtgctggcagcaacttagcctggtaaccaaacaaaacctggaccagactcccaggctcctcatctatgatgcactccaccacgggccacgtcggcactcccaagccctagggttcaggtcggactaggtcgggtcgtagggacaggtacttacaaccttcaccacctatcaagcaacgtcctaaggacctccttaggtaaacgttcttttacgacgttaagttttaacttacgttcgttcgttgacgtacggtcgttagacctaacgttcggtaaccctaaaccgtccgttacccgggaaccgtaaacgggacctaaccggtacgttacgggaaacgttaacgttaaaaccggtacgtgggtacgacgttacgaccgtaactacttcggttcgttaacctcgtacttccccgttaccccg

SEQ ID NO: 109374 - DNA, 655 bp, Homo sapiens
  misc_feature: GYAE6OF01BRARA.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtctttgtctccgaggggaaagagcccaccctctcctgcagggccagtcagagtgctggcagcaacttgcctggtaccaaacaaaacctggaccagacctcccaggcctcctcatctatgatcgcactccaccgacgggcccacgtggccactccccgagccgtaggttcaggtcggcaggtgggtcgtggggactagtaccttcactctaccacctatccacgtacctaaccgtaagtaacttaggtaaagtttactttttactaactttttaacttacgttagtaacctaactacgttaccgtacggtactaacgtccgtccggtacccttcgttaccgttaccggttttccgggaccggggtaacggtaaccggtaagggttcggacgtaccgtaccgaaacgtaccgttgggtacggtctagaccctactgttccgttagttccttacgtaccttccgtcccgtctacg

SEQ ID NO: 109375 - DNA, 744 bp, Homo sapiens
  misc_feature: GYAE6OF01CVI2X.33.70.G04.1.454.CMB.1.raw
  modified_base (202)..(202): a, c, t, g, unknown or other
  misc_feature (202)..(202): n is a, c, g, or t
  modified_base (361)..(361): a, c, t, g, unknown or other
  misc_feature (361)..(361): n is a, c, g, or t
tcagtacacacactcacgaccggtgctcgatttagtgtagtgtgaagggaaagggggaggaactgctcagttaggacccagagggaaccatggaagcccagctcagcttctcttcctctgctactctggctccagataccgaccgggaaattgtgttgacacagtctccagccaccctgttctttgtctccgaaggggaaancgccacctctctgcgagggccagtcagagtgcgtggcagctaacgttcgccgttacggaaccaaaacgaaaaaccgtcggaccaacgacctacccgaaggtcctacctactactactagtgactcgacactacccgacgacggccacgtcggacctacncccgacgccgtaggttcgaggtcggacgtaggttcgggtacgtacggggaactaacggtaccttacacgttcctaccaacctatccgaacgtaccgacgtaccgtaagtacgtaccgtaaggttaaagttacgtttttacgaacgtttaaggttttaactttacgtcgtttacgtacgtacgtaacgggtacgttaaggaacccgttaacggttcccgggtaacccttaaccggtaacccgttaccgggaaaccgtaaacgggtacccgaaccggtaacggtaacgggtaactaaaacggttaaaccgacggttcggtacggtctacggaccctaactacgtttccgtacgtttacccttcttaaccgttccccgttaacccg

SEQ ID NO: 109376 - DNA, 700 bp, Homo sapiens
  misc_feature: GYAE6OF01DE1JJ.33.70.G04.1.454.CMB.1.raw
  modified_base (213)..(213): a, c, t, g, unknown or other
  misc_feature (213)..(213): n is a, c, g, or t
tcagtacacacactcacgaccggtgctcgatttagtgtagtgtgaagggaaagggggaggaactgctcagttaggacccagaggaaccatggaagccccagctcagcttctcttcctctgctactctggctccagactaccgaccgggaattgtgttgacgcagtcctccaggccacctgtctttgctccgagggacagacgcccacccttcncctgccgacgggccagtcagtactgtagcagcgtacttcgttagcccgttggtaccagtacgaacgtaaacctggaccgacggccctacccgaggtcctaccctccgtacgtagtcggtcgacactacccgaccgacggccacgtcgacctactaccccgagacctaggttaccgaggtcggacctaggtcgggtcgtacggactaacgtactactacgttcctacacgtatccgaacgcctaagtacgtggaaccgtcctaaggtaacgttctttacgacgttagttacttaagtttaccgtagtacgaagtcggtaaggtttaacgttcgttacacgttcccgtaccggttacggttaccggaccgtaaacgggaccgttaaagggtacgtaaacgtaaccgtaaaacgtaccgttagggtaccgtcgtacgacctaacgtaacgttccttaacgttctttaccgtcccttccggttaacccccg

SEQ ID NO: 109377 - DNA, 663 bp, Homo sapiens
  misc_feature: GYAE6OF01CCG7C.33.70.G04.1.454.CMB.1.raw
  modified_base (278)..(278): a, c, t, g, unknown or other
  misc_feature (278)..(278): n is a, c, g, or t
  modified_base (300)..(300): a, c, t, g, unknown or other
  misc_feature (300)..(300): n is a, c, g, or t
  modified_base (435)..(435): a, c, t, g, unknown or other
  misc_feature (435)..(435): n is a, c, g, or t
tcagtacacacactcacgaccggtgctcgatttagtgtagtgtgaagggaaagggggagggaactgctcagttaggacccagagggaaccatggaacgccccggctcacgcttctcttcctcctgctactctggctccagataccgacggggaattgtgttgacacagtctccagccaccctgttctttgtctccgaaggggaaagagcccacctctcctgcagggccagtcagagtgctggcagcaacttagcctaggtaaccaaaacaaaaaccgnggaccagacctccaggctcctnaatctaagtgatgacatccaaccgaggccacgtggacactccccagccgaggttcaggtggctaggtggttacgaggggactagtacctttcaaccttctacaccatcaacgcacgcctagacgcctagaagttntttagcttaaggtttattacgtcgttctggcctaggtcgtagactaaacgtcggtaacccttaaccgaccgtttaccgggaaccgtaagggaacctaaccgggtacgtacggggaaaattaacggttaaaaaccggtaacggttacggtacggtcgtaacccggtacctaacccgtaactttccgttacggttaccctttagtaacccttcccgtttaccccgtaacg

SEQ ID NO: 109378 - DNA, 603 bp, Homo sapiens
  misc_feature: GYAE6OF01DUO5I.33.70.G04.1.454.CMB.1.raw
  modified_base (204)..(204): a, c, t, g, unknown or other
  misc_feature (204)..(204): n is a, c, g, or t
  modified_base (439)..(439): a, c, t, g, unknown or other
  misc_feature (439)..(439): n is a, c, g, or t
  modified_base (587)..(587): a, c, t, g, unknown or other
  misc_feature (587)..(587): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaattgtgttgacacagtctccagcccacctgtctttgtctccgaggggaaagngccaccctctcctgcagggccagtcagagtgctggcagcaacttagcctaggtaaccaaacaaaaacctggaccaagacctcccaggcctcctcatctatgatgcactccaccgacgggccacgtcggcactccccgagccgtaggttcaggtggactaggtgggtcgtaggggactacgtactttcaccttcctaccaccatcagacacgacctaagcgtccgtagtaaagttnttttcgactttaagtttacttacgtgttctgcagtcgtacgctaacgtcgacctaacgtccgttcggaccgaaggaccacgtacgtaggaacgtaaacgttaaacgacgttggtagactcgacctactacgttcttacgttccttacncgttcccgttaccccg

SEQ ID NO: 109379 - DNA, 794 bp, Homo sapiens
  misc_feature: GYAE6OF01C0SKX.33.70.G04.1.454.CMB.1.raw
  modified_base (201)..(201): a, c, t, g, unknown or other
  misc_feature (201)..(201): n is a, c, g, or t
tcagtacacacactcacgaccggtgctcgatttagtgtagtgtgaagggaaagggggaggaactgctcagttaggacccagagggaaccatggaagcccagctcagcttctcttcctcctgctactctggctcccagataccaccggggaaattgtgttgacacagtctccagccaccctgtctttgctccgaaggggaangccacctctcctgcagggccagtcagagtgctggcagcaaacttgccttaggtaaccaaaacaaaaaccgtcggaccaagacctacccgaggctcctcatctatgatgcactcccaccgacggccacgtcggacctactacccgagccgtacggttcaaggttcggcgtaggtcgggttcgaggggtaccaggtaccttcgaacttcctacaacccgtatccgaacgtccgaacgtccctaaggacgtacccgttaggtaaacggtttcgtttttaacggaccgtttaacggtttttaacgttacgttacggtttccgttacggtaccgtaacgttaccgggttaagtaacccgtaaaccggtttaccgggtaacccctttaaacccggtaccccggtttaacccggggaaacccggtaaacgggtaacccgaaacccgggtaacggttacgggtaaacggttaaaaaccgtttaaaaaccgggtaaccggttcgggttaacgggacctttaccggggaacccctaaactttaaccggttccgtttacggtttaccctttaacccggtaccgtttcccccgtttaccccccgg

SEQ ID NO: 109380 - DNA, 542 bp, Homo sapiens
  misc_feature: GYAE6OF01BOJRX.33.70.G04.1.454.CMB.1.raw
  modified_base (202)..(202): a, c, t, g, unknown or other
  misc_feature (202)..(202): n is a, c, g, or t
  modified_base (398)..(398): a, c, t, g, unknown or other
  misc_feature (398)..(398): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttagcctggtaccaacaaaaacctgccagactcccaggcctcctcatctatgatgcatccaccagggccactggcactcccagccaggttcagtggcaggtggtctgggacagacttcactcctcaccatcagcacgcctagcgcctagaagtntttgctagtttattactgttctgcagtcgtagccaacgtcggaccctaacgtcccttcgggaccaagggaccacgacgtggactaagttaaaacgacgtggtcggactcgaccaaccattctagttccttcagttccctacccg

SEQ ID NO: 109381 - DNA, 525 bp, Homo sapiens
  misc_feature: GYAE6OF01EVHND.33.70.G04.1.454.CMB.1.raw
  modified_base (202)..(202): a, c, t, g, unknown or other
  misc_feature (202)..(202): n is a, c, g, or t
  modified_base (382)..(382): a, c, t, g, unknown or other
  misc_feature (382)..(382): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaacaaaacctggccagactccagctcctcatctatgatgcatccaccgagggccactggcatcccagccaggttcagtcgcagtggtctgggacagacttcactctcacatcagcagctagacncctagaagtattttgactagtttattactgtctgcagcgtagcaactcggacctaacaccgttacggccaaggacacgacgtggaataagttaaacgacgtggtaggctgacacatcgtagttaccttctacttccgttcccg

SEQ ID NO: 109382 - DNA, 705 bp, Homo sapiens
  misc_feature: GYAE6OF01DBZ3S.33.70.G04.1.454.CMB.1.raw
  modified_base (315)..(315): a, c, t, g, unknown or other
  misc_feature (315)..(315): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagactaccgaccggggaaattgtgttgacacagtctccagccaccctgtctttgtctccgagggggaaagacgcccaccctctcctgccgagggccagtcagagtgcgtggcagctaacttcgcctaggtaaccaaacaaaaacgtcggaccacgacctccacggccttcctcactctangatgcactccaccgacgggcccacgtcggccactccgacgcctaggtcaggtcggctaggtcgggtcgtaggggaactacggtactttaccgaccttccgtacctaccgaactacgtacgaccgtacggtaccgtaacgacggtaccgttaaggtaaacgttagtttttacggaacttttaaggttttactttacgttacgttacgtacgtacgtacggttacgtacggtaaccgtaacgttccggtaacccgttaaccgtacccgggtttaccggaaccgtaaacggggaacctaccggaacggttaggtaaacgtaaacgttaaccgtaacgttcgggacggtctcgaacctaccgacttcgtacgttcttactccttcccgtacccg

SEQ ID NO: 109383 - DNA, 653 bp, Homo sapiens
  misc_feature: GYAE6OF01ANU65.33.70.G04.1.454.CMB.1.raw
tcagtacacacactcacgaccggtgctcgatttagtgtagtgtgaagggaaagggggaggaactgctcagttaggacccagagggaaccatggaagccccggctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaaacaaaaacctggaccagacctcccgaggctcctcatctatgatgcactccaccgacgggccacgtggaccactccccgagccctaggtttcaggtggcgtaggttcgggtcgtaggggacaggtacctttacaaccttctaccaacctatccgacgcacgcccgtaaggacgtaccttaggaagttattttgacttaagttttattacgtgttctgactaggtcgtagaccgtaacgtcggtaaccctaaccgtacccgttaccgggaccgaaacgggtaccaaccggtacgtagggaactaaacgttaaaccggaacgttacggcggtacctacggtcctaacccgtagttaccgttcgttaccctttacgactttcccgttccccgtaccg

SEQ ID NO: 109384 - DNA, 563 bp, Homo sapiens
  misc_feature: GYAE6OF01AW6AI.33.70.G04.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
  modified_base (401)..(401): a, c, t, g, unknown or other
  misc_feature (401)..(401): n is a, c, g, or t
  modified_base (549)..(549): a, c, t, g, unknown or other
  misc_feature (549)..(549): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaancgccaccctctcctgcagggccagtcagagtgctggcagcaacttgcctggtaccaanaaaacctggaccagactcccaggctcctcatctatgatgcatccaccagggcccactggcactcccagccaggttccagtcggacgagtgggtctgggacaggacttcgactctcacatcagcagcctagacgcctgaatntttgcttagtttatactgtctgcagtcgtagcacgtcgaccctaaccgtacccgttcggacccgtaagggaccacggacgtagggaagtaacttaaacggaacgttggtagacctggtacccaccgttatccgttacttcttaccgtnttcccgttaccccg

SEQ ID NO: 109385 - DNA, 803 bp, Homo sapiens
  misc_feature: GYAE6OF01A1DEC.33.70.G04.1.454.CMB.1.raw
tcagtacacacactcacgaccggtgctcgatttagtgtagtgtgaagggaaagggggaggaactgctcagttaggacccagagggaaccatggaagccccggctcagcttctcttcctcctgctactctggctccagataccaccggggaattgtgttgacacagtctcagccacctgtcttgtctcgagggaagacgcctacctctcctgcacgggccagtcagagtcgctggcagccaacgttacgcctacggtaacccaactaaaaaccgtcggaccaacgacctacccgacggcctcctactactctatcgactcacgtactaccaccgtacggtccaacgtcggacctactaccgacgtaccgtacggttacgacggtcgtacgtacggtcgggtacgtacggggactacggtaccttcgtaaccttcgtaccctaacctacgtaccacgtacgtacggtacccgttaggacgtcccgttaggaaacgtttcgttttaagaccgtttaacggttttaactaccgtttacggtacccgtaggtacccgtagggttaccggtaacgtaccgtaacccggtttacggaccccgttaaaaccgtcccggtttacggggaacccgttaacggggtaaccctacgggggttaaacctagggggtaaacccgttaaacgtttaaaacccggggacctttacggggtaacccgttacggtaacccggtaccgttaaacccggtcggttttacccgttacgggttacccttaaccggttaccctttcccccggttacccgtaacccg

SEQ ID NO: 109386 - DNA, 836 bp, Homo sapiens
  misc_feature: GYAE6OF01DPD2L.33.70.G04.1.454.CMB.1.raw
  modified_base (207)..(207): a, c, t, g, unknown or other
  misc_feature (207)..(207): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagactaccgaccgggaattgtgttgacacagtctccagccacccttgttctttgtcctccgaaggggaaanacgccacccttctcctgcgacgggccagtcagagtgctggcagctaacgttgcctaggtaaccaaacaaaacgtggaccagactccgaggcctcctctatctatgatcgactactacccgaccgacgggaccacgtcggaccaacctaccccgacggacccgtaacggttccgaaggttcggaccgtaggttcgggtacggtacgggacctacggtaccttccgtaaccgtcctaccgaacctagtaccgaacgtccgtaacggacccgttaaggacgtacccgttaagggtaaacgttttacgtttttaccggactttaaacggttttttaactttaccggttagtttaccgttacgtaccggtaacggttacccgttaacggaacccttaaaccgggttccgggtaaacccctttaacccggttaacccccgggtttaacccggggaacccgggtaaaacggggttaaccctaaccgggttaaccggttaaacggggtaaccgttaaaaaccgggtttaaaaacccgtaccgggtttacgggtacgggttacctaccgggtaacctaaacccgttcgtttcgttaaccggtttcccttaaccgttcccgtttccccgttaaaccccg

SEQ ID NO: 109387 - DNA, 825 bp, Homo sapiens
  misc_feature: GYAE6OF01BHEIZ.33.70.G04.1.454.CMB.1.raw
tcagtacacacactcacgaccggtgctcgatttagtgtagtgtgaagggaaagggggaggaactgctcagttaggacccagagggaaccatggaagccccggctcagcttctcttcctcctgctactctggctcccagataccaccggggaattgtgttgacacagtccctcgacgccctacttcttcttcgtcctacggaagggaacgccgaccctacctcctcgtcgacggacgacgtacgtacgaggtgtcgtcggtcgacgacgacttaacgtaccgtaccgtaaccgtaaaccaaaaccgtaaaccggccgaaccgaaccgtacccgtaccggaccgtcccttacctactacttacgtagtacgtacgtcgaccgtaccgtaaccgaccggaccggacctacggtaccgtacctaccgtacccgacgtaccggttacgtacggtacggtacggacggttacggggttcggttacgggaaccgggtaacgtacggttacctacccgtaccttaccgaaccctacgtaccgtacgacgtacgaccgttaacgacggccgtttaacgtaaggttacttttcggttactaacgttttaactttacgtcgttcgtacggtcgacggtacgttacgtaccgtaccgtaaccgggttacctaaacccgtacccgttcccgggaacgggaaccgtaaacgggccgtaacggtaggtaacggtaaacgttaaaccggtaacgtcgggttacggccgttaccaacccggtacctaccgttagttccggtttaccttacccgtaactttccccgtaccccgtccgggttaa

SEQ ID NO: 109388 - DNA, 642 bp, Homo sapiens
  misc_feature: GYAE6OF01C0NB2.33.70.G04.1.454.CMB.1.raw
  modified_base (199)..(199): a, c, t, g, unknown or other
  misc_feature (199)..(199): n is a, c, g, or t
  modified_base (445)..(445): a, c, t, g, unknown or other
  misc_feature (445)..(445): n is a, c, g, or t
  modified_base (594)..(594): a, c, t, g, unknown or other
  misc_feature (594)..(594): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagataccgaccggggaattgtgttgacacagtctccagccacctgtctttgtctcgagggaaancgccaccctctcctgcgagggccagtcagagtgctggcagctaacttgcctaggaaccaaacaaaactggaccagacctccgagcctcctcatctatgatcgaccactaccgaccgacggtcccaacgtcggctacctcccgacgccgtaggttccgaggtcggacgtaggtcgggtacgtaggggactagtaccttcactcctaccactacgtacgacgagtacgtaggactcgtaggtaacttntttacgcttaagtctttagtacgtgtacgagtacgtagttacgtacgggtaggggtacgttacggtacggaaccggtaagggtaccgaaagggttacgaaacgtaccgtaaaagtaccggttgggacggtacgttacgaacctacgttnttacgttcgttacttactaccgttacccttcccgactggttacgtagg

SEQ ID NO: 109389 - DNA, 728 bp, Homo sapiens
  misc_feature: GYAE6OF01CEZ2X.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaanagccaccctctcctgcagggccagtcagagtgctggcagcaacttagcctggtaccagcagacacctggccaggcctcccaggcctcctcttctatgatgcactaccaacgacgggcccacgtcggccacgtccccgagcccgtaagggttccaagggttgggccggggttggggtcctacggggactaggtacctttcgacttcctccgaacctacgttaccgacggtaccgacgtacccgtaacggtacgtacccgttaggtaaacggttaagtttttcggtaacctttaaggtttttactttaacgtttacgttaccgtacggtaccgtaacggtacggttaacgtaccgttaacgttcgggttacgtttcggggtaccggtttaccgggaaccggtaacgggtaccgtaaagggtaacggtaaacgtaaccgtaaaacggtaacggttcggttacggtacgttacggaccctaaccgttacgttaccgttcgttacctttccgttaccttcccgttaccccg

SEQ ID NO: 109390 - DNA, 754 bp, Homo sapiens
  misc_feature: GYAE6OF01DBCF2.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggcctcccagataccgaccggggaattgtgttgacacagtctccagccacctgtctttgctccgaggggaaancgccaccctctcctgcagggccagtcagagtgctggcagctaacgttgccgtacggtaaccaaaccgaaaaacctcggacccaagtaccctacccgaggcccttacctcaacttaccgttattaggaacttcggacctaactacccgacccgacgggcccctaacgttcgggacctacgtcccccgaagtcccgtaacggttttaccgagggttacggcgtaaagggtttcggtaccggtagggggaacctacggttaccctttaccgaaccttcccgtaccaacccgttaacgtaccgaacggaccgtacgtacccgtaacggtacgtacccgttaaggtaaaccgttagttttacggaactttaacggttttaattaccgttggttaccttcggactacggtacgtacgtaccgtaacgtccgaaccgttaacctacccggttaccggaacgtaacgggaccctaggtaaccgtaggaacgtaaacgttaaacgacgttacgagacgtacgactacctcgttacgtcttaccttactctcccgttacccg

SEQ ID NO: 109391 - DNA, 866 bp, Homo sapiens
  misc_feature: GYAE6OF01B6EO0.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaaattgtgttgacacagtctccagccaccctgtctttgtctccgaggggaangccaccctctcctgcagggccagtcagagtgctggcagcaacttagcctaggtaaccaaacaaaaccgtggaccacgacctcccgacggcctcctcatctatgatgacactacccaccgacgggcccacgtcggaccactaccccgagcccgtaggttccaagggttcggaccgtagggttcggggttaccgtacgggggaacctacggtaacccgtttaccgaacccgttacccttacccaaacccgtaacgttacccgaaacggtacccgtaacgggtaaccccgttaagggtaacccgggttacccgttaacgggttaaaacggtttaccgttttttacggaaccgtttttaaacggttttttaaccgttttaacccgtttcggtttacccggttacgggtaccgtttaacgggtaccggttaacggaccggttaaaccgtttccggggtaacccctttaaacccggtaccccgggtttaccggggaacccgtaaaacggggggtaccctaacgggtaaccggtaaggggtaaaccgttaaacggtttaaaaaccggtaaccggttcggggttaccggtacccggttacggaacccctaacccgtaacgttttccgttacggtttaccctttaccgtaccgtttccccggttaccccccg

SEQ ID NO: 109392 - DNA, 755 bp, Homo sapiens
  misc_feature: GYAE6OF01AOXSC.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaagngccaccctctcctgcagggccagtcagagtgctggcagcaacttgcctaggtaaccaaacaaaaccgtggaccacgacctcccgaggtcctccctacatctatgatcgctactcccaaccgacgggcccacgtcggacctactccccgagtacccgtacggttccgaaggtcggacgtaggttcggggtcgtaggggacctacggtaccttcacctcctaccacctatcgacgtcgacgtcctaaggacgtccgtaaggtaactttacgtttttacggacttttaaggtttttaacttaccgttcggttaccgttacggtaccgtaacggtccggttaacgacccgtaaacggttccggtaaccccttaaacccgtacccggtttaccgggaacccggtaaacggggtaccctacggtaacgttacgggaaacttaaaaccggttaaaaccgaacggtttcgggtaccggtacttaccgggaacccctaacccgttacgttaccggtttacctttaaccgtttccctaacccgttttccccggtaccccccg

SEQ ID NO: 109393 - DNA, 599 bp, Homo sapiens
  misc_feature: GYAE6OF01D8GVK.33.70.G04.1.454.CMB.1.raw
  modified_base (201)..(201): a, c, t, g, unknown or other
  misc_feature (201)..(201): n is a, c, g, or t
  modified_base (357)..(357): a, c, t, g, unknown or other
  misc_feature (357)..(357): n is a, c, g, or t
  modified_base (438)..(438): a, c, t, g, unknown or other
  misc_feature (438)..(438): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaattgtgttgacacagtctccagccacctgtctttgctccgaggggaaangccaccctctcctgcgagggccagtcagagtgctggcagcaacttagcctaggtaaccaaacaaaacctggccagactcccaggcctcctcatctatgatgcactcccaccgagggccacgtgccactcccagccaggttcaggtgcagtgggtcngggacagtactttcgacctctacacctataccagcagcctagacgctagaagttatttgacttagtttacttacgtgttcngtcagtcgtacgactaacgtcggtacctaaccgtaccgttacggaccgtaacgggaccacggtacgtacgggtaaactaaacgttaaaaccgacgttcggtaggtaccgtggacctaccgtacgttccgtacgttaccctttacacgttcccgttaccccg

SEQ ID NO: 109394 - DNA, 649 bp, Homo sapiens
  misc_feature: GYAE6OF01DB328.33.70.G04.1.454.CMB.1.raw
  modified_base (197)..(197): a, c, t, g, unknown or other
  misc_feature (197)..(197): n is a, c, g, or t
  modified_base (620)..(620): a, c, t, g, unknown or other
  misc_feature (620)..(620): n is a, c, g, or t
tcagtacacacactcacgaccggtgctcgatttagtgtagtgtgaagggaaagggggaggaactgctcagttaggaccagagggaaccatggaagccccagctcagcttctcttcctcctgctactctgctccagataccgacgggaaattgtgttgacacagtctccagcccacctgtctttgctccgaggggaanagccacctctcctgcgagggccagtcagagtgcgtggcagcaaacttgcctaggtaaaccaaaacgaaaaacgtcggaccaagacctacccaggcctacctcatctatgatcgacactcccgaacgacggacccacgtacggcaacctccccgacgcccgtaaggttccgaaggtcggaccgtaggtcggggtaccgtagggggaacctacggtaacctttccaaccttcctaccgaacctacttacacgaccgacgtacccgtaagacgcctaaggtaagttattttcgacttaagttttatacgtgtctagcgtagcgttacgactaacgtggaacccttaaacgcccgttacgggaaccgtaacgggacaaccgacgtaggaactaaacgtaaaacgacgtgacggctacgaccaccttntacgtcttacttctacgtcccgttacccg

SEQ ID NO: 109395 - DNA, 584 bp, Homo sapiens
  misc_feature: GYAE6OF01D4CEP.33.70.G04.1.454.CMB.1.raw
  modified_base (202)..(202): a, c, t, g, unknown or other
  misc_feature (202)..(202): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccaggggaaagngccaccctctcctgcagtgccagtcagagtgctggcagcaacttgcctaggtaaccaaacaaaaacctggaccagacctcccaggcctcctcatctatgatgcatccaccgagggccacgtggcactcccagcctaggttcaggtcggcaggttgggtctgggacagtaccttcactctacaccatcagcacgcctagacnccgtagaagttntttgcttagtttattacttgtctgcaggtcgtacgctaacgtcggtacctaaccgtacccgttcggacccgaagggacacggtactagggaacgtaacgttaaaacggacgttaggtacggtcctacgacctaaccgtacgttccgttagttaccttctacgttccccg

SEQ ID NO: 109396 - DNA, 836 bp, Homo sapiens
  misc_feature: GYAE6OF01DNPR1.33.70.G04.1.454.CMB.1.raw
tcagtacacacactcacgaccggtgctcgatttagtgtagtgtgaaggggaaagggggaggaactgctcagttaggacccagagggaaccatggaagccccagctcagcttctcttcctcctgctactctggctccagataccgaccggggaattgtgttgacacagtctccagccacccttgttcttttgtcctccgaagggggaaacacgcccacccttctcctgcgacgggccagtcagagtgctggcagctaacttagcctacggtaaccaaaacgaaaaaccgtcggaccaacggacctacccgaaggcctcctacattcctatcgtatcgactactacccaccgacgggccacgtcggaccactcccgacgccgtaggttcgaggtggacgtaggtcggggtacgtaggggactacggtaccttcgtaaccttcctaccaacccgtacgtaccacgacccgtaacggtacccgtaaggaaccggtccttaagggtaacgttttacgttttacggaactttaaggttttttaacgttacgttacgttacgtacgtacgtaacgggttaccggttaagacccgttaaacgttccgggtaaccctttaaacccgtaccccggtttacccggggaaacccgtaaacggggacccgtaaacccggtaacggttaaacgggtaaaccggttaaaaaccggttaaaaccggtaacggtttaccgggtaacggggtaaccctttccggggaaacccttaaaccccgttacgttttaccccgtttacggtttaaaccccgttttaccggttaacccgttttcccccggttaacccccgg

SEQ ID NO: 109397 - DNA, 653 bp, Homo sapiens
  misc_feature: GYAE6OF01ECOHS.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggagaaattgtgttgacgcagtctccaggcaccctgtctttgtctccgaggggacagagccaccctctcctgcagggccagtcagactgttagcagcggtcttcttagcctggtaccagcagaaacctggccaggcctccaggctcctcctctagtggtcgctactcccacgacgggccacgtggccactcccagacctaggttcagtggctaggtgggtctgggacagtactcactctcacctatcgacagacgtggacgtaccgtagtaacgtattttcggactacgttacttaacgtttacgttacgtactaggtacgtaaggttaacgtacgggtaggggtaacgtaccgggttaccgggaccggtaaacggggaaccgtaagggtaacggtaaaacgtaaccgaaacggtaacgtacgggtacgggtccgtacggaccgtaacccgtacgttaccgttacgttcctttacctaacgtttccccgttccccgtaccgttaacg

SEQ ID NO: 109398 - DNA, 684 bp, Homo sapiens
  misc_feature: GYAE6OF01AB9T3.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaagngccaccctctcctgcagggccagtcagagtgctggcagcaacttgcctaggtaaccaaacaaaaccgtggaccacgacctcccaggcctcctcatctatgatgcactcccaccgacgggccacgtggccacgtccccgagcccgtaggttccgaggtcggcgtaggtgggtcgtaggggactacggtacttcactctaccacctatccagccacgacctagacgtaccgtaggtaacgttattttacgactttaacgttttattaccgtttgttccgtggactaggtcggttaacgaccgtaacgttcggtaaccccttaaaccgtacccgggtttaccgggaccgtaaacggggacccaaccggtaacgtagggtaaacgtaaacgtttaaaaccggacgttacgggtacgggtacctacggaccctaacccgtacgttcccttggttacccctttactaccgtttccccttacccccgg

SEQ ID NO: 109399 - DNA, 816 bp, Homo sapiens
  misc_feature: GYAE6OF01CJEUN.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaaattgtgttgacacagtctccagccaccctgtctttgctccgaggggaaanacgcccacctctcctgcgacgggccaggtcagagtgctggcagcaacttagcctaggtaaccaaaacaaaaccgtggaccagacctccgaggcctcctacatactagtgaatcgaccactcccgaacccgacgggacccacgtacggacctaactccccgaagcccgtagggtttaccgaagggtcggaccggtacgggttcggggtacggtacggggaaactacggttaaccctttccgaccgttacctaaccctaacccgtacgtacccgaaacggacccgtaacgtaccccgttaaggaaccggtaccctaagggttaaacttcgtttttaacgaacgtttaaaggtttttaccttacgttacgttacgtacggtacgacggttacgttaagaacccgttaaccgtaccgggtaaaccccttaacccggttaaccccgggttaccgggaaacccgggtaaacgggaaccccgtaaaccggtaacgggtaaacggtaaacggtaaaaccgtttaaaaccggtaccgggtttaggaccggtaccgttaccgaacccgtacgttacgttacccgtttagtaccctttacctaaccggtttcccctaaccccgg

SEQ ID NO: 109400 - DNA, 724 bp, Homo sapiens
  misc_feature: GYAE6OF01DXJAC.33.70.G04.1.454.CMB.1.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaaattgtgttgacacagtctccagccacctgttctttgtctccgaaggggaaanagcccacctctcctgcagggccagtcagngtgctggcagctaacttagcctaggtaaaccaaaactaaaaacctcggaccacgaccnccgaggcctccncatctatgatcgacatccaccgaggccacgtgcactcccagccaggttccaggtggacgtaggtcgggttacgtacggggaacaggtacccttacacgttcctaacccacctaagtccaacgccacgtaccgtaggaccgtaccgtaaggtaacgttactttttacgggaactttaacggttttttaacttacgttcgggtttaccttacgacgttaacgggtacgttaaccgacgttaaaccgtcccgggtaacccaaaccggttcccgttaaccgggaaccgaacgggacccacggtaaccgttagggaaacgttaaacgttaaaaccggaacgtttcgggaacgccttaacggtaccccaacgtttaaccttccggtttacgttacccctttaccgtccgtttccccgtaacccccg

SEQ ID NO: 109401 - DNA, 594 bp, Homo sapiens
  misc_feature: GYAE6OF01EA6XU.33.70.G04.1.454.CMB.1.raw
  modified_base (203)..(203): a, c, t, g, unknown or other
  misc_feature (203)..(203): n is a, c, g, or t
  modified_base (420)..(420): a, c, t, g, unknown or other
  misc_feature (420)..(420): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaangccaccctctcctgcagggccagtcagagtgctggcagcaacttagcctaggtaaccaaacaaaaacctggaccagacctcccaggcctcctcatctatgatgcactccaccgagggccacgtggcactcccagccaggttcaggtcggcgtaggtgggtcgtgggacaggacttcgactctacacctatcagcacgtcctagacgcctagaagttntttgacttagttttacttacttgtctcgctacggtcgtacgacctaacgtcggtaccctaacgtccgttacggaccgaacgggacaccgtacgtaggaacgtaaacgtaaacgacgttggtgtacgtcgacctacctacgttcttacgttaccttactccgttccgttaccccg

SEQ ID NO: 109402 - DNA, 781 bp, Homo sapiens
  misc_feature: GYAE6OF01A4S5X.33.70.G04.1.454.CMB.1.raw
  modified_base (199)..(199): a, c, t, g, unknown or other
  misc_feature (199)..(199): n is a, c, g, or t
tcagtacacacactcacgaccggtgctcgatttagtgtagtgtgaagggaaagggggaggaacgtggctacagttaggacccagagggaaccatggaagcccagctcagcttctcttcctcctgctactctgctcccagataccacggagaacttgtgttgacacagtctcggccacctgtctttgtctccgagggaancgccacctctcctgacaggtccagtcagacgtgttagcggtactgcctggtaccacagagacctggccaggcctcccgaggcctccgtacttcgactgactcgactacttacccgaacgacgggtcccaacgtcgggacctacgttccccgacgaccgtaagggtttccacggttcgggtacggtcgggttcctacgggaccttacggtacctttccgaccttccgtcccgtaacctagtacccgaagtcccgtaaggtaccccgttaaggaccgtacccgttaagtaacggttacgttttacgacgtttaagttttaacgttacgttacgttacgtaacgtacgttacggtaccgttaacgaccgtttaacgttcggttaccgtttacgggtaaccggtttaccggacccggtaaacggggtaaccgttaaacgggttaacggtaaaccgttaccggaaaaccggttacggttacggtacgggtaccgtacggtacccgtaaccgttacgttaccgttccggttaacccttacggtaacctttaccccggttaccccgtaccgttaccgttccgttaacgg

SEQ ID NO: 109403 - DNA, 876 bp, Homo sapiens
  misc_feature: GYAE6OF01D5ACD.33.70.G04.1.454.CMB.1.raw
  modified_base (204)..(204): a, c, t, g, unknown or other
  misc_feature (204)..(204): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaattgtgttgacacagtctccagccaccctgtctttgtctaccgaggggaaanacgccaccctctcctgcagggccagtcaggagtgctggcagacaacgttacgccgttaggtaacccaaactaaaaaccgtcggaccaacggtacctcccgaggtcccttccgtactaacttactacgtacggattacgcctaactaccccgaacccggacggggaccctaccggttcgggaccaaaccgttcccccgaacggtaccccgtaacgggtttaccgaacgggttcgggaccgtaacgggttcgggggtaccgttaggggaacccgtaggtacccgtttaccgtaccgttacccttacccgaaacccgtactaccaacggacccgaacgtaccccgttaaggacccggtacccgttaaggtaaacggtttacgtttttacggtaaccgtttaagtttttaacgttaccgttcggttttaccgtcggtaccgttaagggtaccgtttaagtaacccgtaaccggtacgggtaaccccctttaaccggtacccggtttaccgggaaccgaaccgggtaacgaccgggttaaacgtagggttaaacctaaacggttaaaaccggtaacgttcggggttaaccgtaccggttaacgaacccgttaacccgtacgtttccggtttaccggtttacccttttaaccccgttcgttcccccgggtttaacccc

SEQ ID NO: 109404 - DNA, 563 bp, Homo sapiens
  misc_feature: GYAE6OF01CQRC4.33.70.G04.1.454.CMB.1.raw
tcagtacacacactcacgaccggtgctcgatttagtgtagtgtgaagggaaagggggaggaactgctcagttaggacccagagggaaccatggaagccccagcgcagcttctcttcctcctgcttctctggctcccagataccaccggagaaattgtgttgacgcagtctccaggcaccctgtctttgtctccaggggacagagcccaccctctcctgcagggccagtcagactgttagcagcggtcttctagccttggtaccaacagagacctggccaggcctcccgaggctcctcttctatgatgcataccaacgagggccacgtcggcactcccagccgtaggttcaggtggcggtgggtctgggacagacttcactctcacatcagcagcctagacgcctagaagttatttacgacttagtttatacgtgtcagtcgagcgtagcgtaagttcggttacgttggtacgttcggaccgtagggaacgtaaggtaacgaaactacgaaacgtacgtggtacggctacgacctacgtacttcgtacgttcttcgtcttcccg

SEQ ID NO: 109405 - DNA, 754 bp, Homo sapiens
  misc_feature: GYAE6OF01B5JUP.33.70.G04.1.454.CMB.1.raw
  modified_base (204)..(204): a, c, t, g, unknown or other
  misc_feature (204)..(204): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggtaaattgtgttgacacgagtctccagccacctgtctttgctccgaggggaaancgccaccctctcctcgcagggccagtcagagtgctggccagacaacttacgcctaggtaaccaaaccgaaaaaccgtggacccaagacctacccgaaggtcctcctacctatcctatcgtatgcctacgtacccaccggacgggacccacgttacggaccacgtaccccgacggtcccgtaaggttccaagggttcggaccgtaagggttcggggtccgttagggggaacctacggtaccttaccgaaccttctacccaactactcgaacgccaggtcctaaggcgtaccgttaggaattttacgtttcgtaccgtttaagtttttattaccgttacggttcgtacgacgttaacgtacgggtaactaccgtaaaccggttcggtaacccctttaaaccgtacccgggtttacccggaaccggtaaacggggtacccaacgggtacgtaagggaaacgttaaagttaaacccggaaggttcgggtaggcccttacggacctacgttaacttccgtttagttaccttacccgtcgttccccttacccccgg

SEQ ID NO: 109406 - DNA, 651 bp, Homo sapiens
  misc_feature: GYAE6OF01B8Q1K.33.70.G04.1.454.CMB.1.raw
  modified_base (202)..(202): a, c, t, g, unknown or other
  misc_feature (202)..(202): n is a, c, g, or t
  modified_base (407)..(407): a, c, t, g, unknown or other
  misc_feature (407)..(407): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangcccaccctctcctgcagggccagtcagagtgctggcagcaacttagcctaggtaaccaaacaaaacctggaccagactcccaggcctcctcatctatgatgacatcccaccgacgggcccacgtcggccactccccagcccgtaggttcaggtggcgaggtgggtctgggactagacttcactctcacatcagcagcctagacncgtagaagttattttgacttagttttactacgttcgttctgactagggtaccgtagtaccgtaacgtccggtaacccttaacctaccccggttaccgggaacccggaaacgggtaccctaaccgggtaccgtagggaaacgttaaacgttaaaacccggtacgttcgggtacgggccttacggaccctaaaccttacgttaccttggttaccctttaccctaacgtttccccgttaacccccgg

SEQ ID NO: 109407 - DNA, 604 bp, Homo sapiens
  misc_feature: GYAE6OF01DMOOU.33.70.G04.1.454.CMB.1.raw
  modified_base (447)..(447): a, c, t, g, unknown or other
  misc_feature (447)..(447): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagataccgaccggggaattgtgttgacacagtctccagccacctgtctttgtctccgaggggaaagcgcccaccctctcctgcgacgggccagtcagagtgctggcacgctaacgttgcctaggtaaccaaacgaaaaaccgtcggaccaacgacctcccgaacggtccttcctactatactatgactcgacactccaccgacggcccacgtcgaccactccgacgccgtaggtcaggtggcgtaggtcgggtcgtagggacacgtacttcgacctcaccactatcagcacgctagctacgtagtaacgttntttagactttagtttactctgtcncgacngtactacgactacgtcgacctaacgtccggtcgaaccgaagggaccacggtacgtaggaacgtaacgttaaacggacgtggtacgctcgacctagtacttccgttacttacctctacgtcccgtaccg

SEQ ID NO: 109408 - DNA, 728 bp, Homo sapiens
  misc_feature: GYAE6OF01ADHU2.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaaattgtgttgacacagtctccagccaccctgtctttgctccgaggggaagcgcccaccctctcctgcacgggccagtcagagtgcgtggcagctaacgttcgcctacggtaaccaaaacctaaaaccgtcggaccacgacctcccgaggtcctccctcacttctagtagatcgacctactcccgaccgacgggtacctacgtacggccaccgtacccgacgccgtaggttcgaggtcggacgtaggtcggggtacgtacgggactacgtaccttccgaccttccgtacctaccgtactaccgacgaccgtaacggtcctaacggaccgtaccgtaggttaaacgtttacgttttacggacgtttaagttttaacgttacgtttcggttaccgtaggtaccgtacggtacgtaacgtaaccgtaccggttacgtacccttaaacccggtcccggttaaccgggaaccggaacggtaccgaacggtacggttaaggaacgttaaacgtaacggtacgttcggtagtaccgtcgacctaacgtcgttacgttcgttacttcccgttcttcccgtacccg

SEQ ID NO: 109409 - DNA, 624 bp, Homo sapiens
  misc_feature: GYAE6OF01AZLYJ.33.70.G04.1.454.CMB.1.raw
  modified_base (202)..(202): a, c, t, g, unknown or other
  misc_feature (202)..(202): n is a, c, g, or t
  modified_base (424)..(424): a, c, t, g, unknown or other
  misc_feature (424)..(424): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaangcccaccctctcctgcagggccagtcagagtgctggcagcaacttagcctggtaaccaaacaaaaacctggaccagacctcccgaggcctcctcatctatgatgcactccaccgagggcccacgtggccacgtcccagcctaggttcaggtggctaggtgggtcgtaggggaccagtaccttcactcctccacatccagcacgcctagcgtctagaacgttntttcgcttaagttttattacgttgtctcgacacggtacgtaacgcctaacgtcgtaaccctaaccgtacccgttccgggaacctaacgggactaaccggacgttagggaaacgtaacttaaaaccggacgttggtacggacgttcggacctaacccgtatttcccgttacgttaccctttccagtttcccccgttacccg

SEQ ID NO: 109410 - DNA, 743 bp, Homo sapiens
  misc_feature: GYAE6OF01CJAVW.33.70.G04.1.454.CMB.1.raw
  modified_base (203)..(203): a, c, t, g, unknown or other
  misc_feature (203)..(203): n is a, c, g, or t
  modified_base (324)..(324): a, c, t, g, unknown or other
  misc_feature (324)..(324): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaattgtgttgacacagtctccagcccaccttgtctttgtctccgaaggggaancgccacctctctgcagggccagtcaggagtgcgtggcagctaacgttgccgtacggtaccaaaaccgtaaaaaccgtggaccacgaccgtcccgagcctcctcactactatgatcgctacnccaccgagggtcccacgtcggcctactacccgagtaccgtaggttcaggtcgacgtaggtcggggtcggtagggaaccgtagtacctttacaccttccttaccaaccctataccgagtaccgaccgtacccgtagggaaccgtaccgtttaaggaacgttttaagttttacggtaccttttaaaggttttactttaccggttcgttaccgtacgacgttaacgggtccctaggaaccccttaacggtccggtaaaccccgttaacccgacccggtttccgggaaccggaaacgggtaaccgacgtaaacggtacggtaaagtaaaccgtttaaaacgggcggtagggtaccggtcttaacccgacgaaccttcggtttaccgtccgtttaattccccgttaaccgttcccgttaccccg

SEQ ID NO: 109411 - DNA, 808 bp, Homo sapiens
  misc_feature: GYAE6OF01C6GF1.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgcgtcagttaggacccagagggaaccatggaacgcccagctcagcttctcttcctcctgctactctggctccagactaccgaccggggaattgtgttcgacacagtctccacgccacctgtctttcgctcgaggggaangcccacctctcctgcacgggccagtcagagtgcgtggcagacaacgttcgcctacggtaaccaaaccgtaaaacgtcggaccaacgtacctcccgacggccttacctacacttacctagtacgtaactcgacctaccttaccgaaccggtacgggaccctaacggtcggacctaccgtaccccgacgtacccgtacggttaccgtacggtcgggacgttacgggttccggggtcgtacgggggaacctaacggttaccttacctaccgtacctaccgaacctaacgtccgaacggacctacgtaaccgtagaccgtaccgtagtaaacgttatttttacggactttaaagtttactttaccgtgttacgtacggtactaacggtttacgtaacttaccggaaacggtttacccgtaaccttaaacccggttaccgttacggggacccgtaaacggggaccctaccggtaacgggttaacggtaaacggtaaaccggttttaaaccgaacgggtttcgggtaaccgtaccgttaacgaccccggttaaactccggttttaccgttaacgttccctttaacccgttcccgtttcccggttaccccgg

SEQ ID NO: 109412 - DNA, 795 bp, Homo sapiens
  misc_feature: GYAE6OF01EOXVA.33.70.G04.1.454.CMB.1.raw
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
  modified_base (338)..(338): a, c, t, g, unknown or other
  misc_feature (338)..(338): n is a, c, g, or t
  modified_base (737)..(737): a, c, t, g, unknown or other
  misc_feature (737)..(737): n is a, c, g, or t
  modified_base (772)..(772): a, c, t, g, unknown or other
  misc_feature (772)..(772): n is a, c, g, or t
tcagtacacacactcacgaccggtgctcgatttagtgtagtgtgaagggaaagggggaggaactgctcagttaggacccagaggaaccatggaacgccccagctcagcttctcttcctctgctactctggctccagactaccgaacggggtaattgtgttgacacagttctccacgcccaccctgttctttgcctcgaaggggaaancncccaccctctccgtgcgacgggccagtcgaggagtcgcgtggacacgactaactttacgcccgtaaggtaaacccaaaaccgtaaaaccgtcgacccaaacggtaccctacccgaacggtcctaccctntaattacctaacgtgaacgtctacgtaccgtacccgaaccggaccggtacctaaccggtggaccctaaccgtacccgacggttccctaaacggtcgtaacgggtccgtagtacgggtcgggttaccgaggggttaactacgtaccgtttaccgacttccgtaccacgtaagtacgactcggacccgttgtaaccggtaccgtacgtaaggtaacgtttttatttcgaaccggttttagttttaacctacgggtttgtcccgtaactacggtacggttaacccgtacggtaacaacccgtttaagggaaccccctttaaagttcccccgggtaacggaacccggaaacgtccgtaagtccgggtaaataaaccggtaaattaacggggacgttcgttacncgttacgaacccgttatacggttccctagttaccncccggttaaccgttcccgtacgg

SEQ ID NO: 109413 - DNA, 735 bp, Homo sapiens
  misc_feature: GYAE6OF01E02T9.33.70.G04.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccacctgtctttgtctccgaggggaangccaccctctcctgcagggccagtcagngtgctggcagctaacttgcctaggtaacccaaacaaaaccgtggaccacgacctcccgaggcctcctacattctatgatgactactcccaccgacggccacgtcggacactcccagccaggttcaggtgacgtaggtggtctaggggactaggtaccttaccacgtcctaccaacctataccgaggaccacggtacccgtaaggtaccgtacctaagggtaaacgtttagtttttacggaaccttttaaggtttttaaccttaccggtttgttaccgttacggaccttaacgggtccggttaacgacccgtaacggtttcccggtaacccttaaacccggtaccccggtttaaccggggaacccgtaaaggggtacccctaacggggtaacgtaagggtaaacggttaaaaccgttaaaaccgggtacgttgggtaacggtccttacggaccctaaacgttcgttacccgttacgtttaccttacgttcccgttccccgttacccg

SEQ ID NO: 109414 - DNA, 793 bp, Homo sapiens
  misc_feature: GYAE6OF01BF9BU.33.70.G04.1.454.CMB.1.raw
  modified_base (216)..(216): a, c, t, g, unknown or other
  misc_feature (216)..(216): n is a, c, g, or t
  modified_base (233)..(233): a, c, t, g, unknown or other
  misc_feature (233)..(233): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagataccgaccggggaattgtgttgacacagtctccagccacctgttctttgctccgaaggggaacgacgccacctctccngcgacgggccagtcagngtcgctggcacgctaacgttcgccgttaggtaaccaaaacgtaaaaccgtcggaccaacgtacctacccgaggtccttacctactacttctagtgactcgactactcccgaaccggacggacccacgtacggaccactcccgacgtccgtagggttaccaggtcggacgtaggttcgggtacgtacgggactacgaccttcgtacctccgtacaccgtacgtacgtacgtccgacgtaccgtagtacgtaccgttaagtaacgtttacgtttacggtacgtttaacgttttaacgttacgttcggttaacgtttacgacgtacggtaccggtaacgtaaccgtaaccggtaccggttaaccccttaaaccgggttacccccgggtttaacgggaaacccgggtaaacgggtaacccgtacggttaacgggttaaacgggaaacgttaaacccgtttaaaacgggaccggtttacgggtacccggtacgtaacccggtaacctaccgggttactttaccgggttaccttttaacctcgttaaacccgttcccgttaccccg

SEQ ID NO: 109415 - DNA, 556 bp, Homo sapiens
  misc_feature: GYAE6OF01CCE46.33.70.G04.1.454.CMB.1.raw
  modified_base (412)..(412): a, c, t, g, unknown or other
  misc_feature (412)..(412): n is a, c, g, or t
  modified_base (446)..(446): a, c, t, g, unknown or other
  misc_feature (446)..(446): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtctttgtctccaggggaaagagccaccctctcctgcagggccagtcagagtgctggcagcaacttagcctaggtaccaaacaaaactcggccagactcccaggcctcctcatctatgatgcactcccacccgagggcccacgtcggcactcccacgcctaggttcagtggctaggtgggtctgggacagacttcacgtctcaccatcagcagcctagacgctagaagtntttgactagtttattactgttcagcaagtcgtanctaacgttcgtacgttggtacgttcggacgaacgggacgtaggtaagaactacgaaaagtactggtcggatcgcacctagtccgttagtccttgctttccgtccccgtac

SEQ ID NO: 109416 - DNA, 569 bp, Homo sapiens
  misc_feature: GYAE6OF01EKB1J.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaanagccaccctctcctgcagggccagtcagagtgctggcagcaacttgcctggtaaccaacaaaaacctggaccagactcccaggcctcctcatctatgatgcactccaccgacgggcccacgtcggccactcccagccgtaggttcaggtcggcaggtgggtcgtgggacaggtacttccactctacaccatcacgcacgcctagacgcctagaacgttattttcgacttagtttattacgttgtctgctagcgtagcacgtcgacctacaccgttcgaccgtaagggaccacggactagggataaacgttaaacggacgtcggtaggctcgacctacctagtccttgttactctgtcccttacccg

SEQ ID NO: 109417 - DNA, 360 bp, Homo sapiens
  misc_feature: GYAE6OF01DG2E3.33.70.G04.1.454.CMB.1.raw
  modified_base (204)..(204): a, c, t, g, unknown or other
  misc_feature (204)..(204): n is a, c, g, or t
  modified_base (289)..(289): a, c, t, g, unknown or other
  misc_feature (289)..(289): n is a, c, g, or t
  modified_base (319)..(360): a, c, t, g, unknown or other
  misc_feature (319)..(360): n is a, c, g, or t
tcagtacacacactcacgaccggtgctcgatttagtgtagtgtgaagggaaaagggggaggaactgctcagttaggacccagagggaaccatggaagccccagctcagcttctcttcctcctgctactctggctcccagataccaccggggaaattgtgttgacacagtctccagccaccctgtctttgctccgaggggaaaangcccaccctctcctgcaggccaagcagagtgctggcagcaacttagcctaggtaaccaaacaaaaactggcaagctccagctctnatctatgatgctactccaccgagggacccnnnnnnnnnnnnnnnnnnnnnnnnnnnnnnnnnnnnnnnnnn

SEQ ID NO: 109418 - DNA, 689 bp, Homo sapiens
  misc_feature: GYAE6OF01DXEDR.33.70.G04.1.454.CMB.1.raw
  modified_base (199)..(199): a, c, t, g, unknown or other
  misc_feature (199)..(199): n is a, c, g, or t
  modified_base (502)..(502): a, c, t, g, unknown or other
  misc_feature (502)..(502): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaattgtgttgacgcagtctccaggcaccctgtctttgctcgagggaagngccaccctctcctgcgaggccaatcagagtgttagctaagttaacttagtcctaggtaaccaacatacgacctgaaccaggcctacccgaggtcctcctcatcctacgatcgccgtaccaacgcgggccctacgtcggaccacgtcccgacggtccgtaaggttcaggtcggacgtagggttcggggtctagggaacctagtccttacgacttccaccaccatccaaggtaccctaaacgttagtaactttggtaaacttttattttttacctaattttttacttacgtagtaacctaaactntaccgacggtctacggtccttaccggtcccttcgttacccgttacggtttccggggaacgggtacgggaaccgtaagggtcggtaaccgtactaacgaaacggtgtcgggtcgtctaccggcctaaccgtcttcgttacgttcccttaccttacgtttccccccgttacccacgttgtcgtaacggg

SEQ ID NO: 109419 - DNA, 647 bp, Homo sapiens
  misc_feature: GYAE6OF01BCHOU.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaanacgccaccctctcctgcagggccaatcagagtgttagcagtaacttagtctggtaccaacatagacctgaccaggcctcccaggcctcctcatctacgatcgccgtaccaacgacgggcccacgtggcactcccgagccgtaggttccagtcggcgtaggtgggtcgtgggaacaggtacttcactctccactatcaacgtaccaaaccgtagtaacctttaggaactttactttttacgtaactttttacttacttacgtacctaaactagttaccgaacgggtcagtcctacggcccttctaccttacggttccgggaccgggtaagggaccctaagggtcgacgtacctacgaaaacgtacgtcggtaggacctcggacctacgtattccgttacgttcctaccgttaccttaccccgttacccgtacttagtccgttaagg

SEQ ID NO: 109420 - DNA, 684 bp, Homo sapiens
  misc_feature: GYAE6OF01EI6IF.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccacctgtctttgtctccgaggggaaagngccaccctctcctgcagggccagtcagagtgctggcagcaacttgcctggtaaccaaacaaaacctggaccagacctcccaggcctcctcatctatgactgcatcccaccgacgggccacgtcgcactcccgagccgaggttcaggtcggacgtaggtcggtcgtgggactacgtaccttcgactcgtacacctataccgagtcaacgtccgtaagacgtcgtaggtaagttagttttcggactttaagttttacttacgttcgttcgtacgtacgtacggtcgttaacgaccgtaacgttccggaacccttaaccgtcccggtttacccggaaccggtaacgggacccgtaacgggtacgttacgggaaacgttaacggttaaaaaccgtacggttcgggttacgggaccttaccggacccgttaacgttacgtttcgttaccggtttacctttaccgtaccgtttccccgttaccccgg

SEQ ID NO: 109421 - DNA, 664 bp, Homo sapiens
  misc_feature: GYAE6OF01DA1TO.33.70.G04.1.454.CMB.1.raw
  modified_base (200)..(200): a, c, t, g, unknown or other
  misc_feature (200)..(200): n is a, c, g, or t
  modified_base (438)..(438): a, c, t, g, unknown or other
  misc_feature (438)..(438): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagataccaccggggaaattgtgttgacacagtctccagccacctgtctttgtctcaggggaaagngccaccctctctgcagggccagtcagagtgctggcagcaacttagcctggtaaccaacaaaaacctggaccagacctcccaggcctcctcatctatgactgcactccaaccgaggggcccacgtcggacctactaccccagcccgtaggttccaggtcggactaggtcgggtcgtggggaacacggtactttcaccttcaccaccatcacgcacgccctagacgtcctaggaaacgtnttttacgacttaagtttacttacgttgttactcggacgtaggtcgtaacgacctaacgtcggtaaccccttaaaccgtacccggttaccgggacccgtaaacggggaccctaacggtaacgtacgggtaaacgtaaaccgttaaaccggtaacgtcgggttaggacctcggaaccctaccgtaacgttcgttacggttcctttacccgaccgtttcccgtaccccg

SEQ ID NO: 109422 - DNA, 756 bp, Homo sapiens
  misc_feature: GYAE6OF01CAYIV.33.70.G04.1.454.CMB.1.raw
  modified_base (204)..(204): a, c, t, g, unknown or other
  misc_feature (204)..(204): n is a, c, g, or t
tcagtacacacactcacgaccggtgctcgatttagtgtagtgtgaagggaaagggggaggaactgctcagttaggaaccagagggaaccatggaagccccagctcagcttctcttcctcctgctactctggctcccagactaccgaccggggaattgtgttgacacagtctccagccaccctgtctttgtctccgaggggaaancgccaccctctcctgcgagggccagtcagagtgctggcagctaacttagcctacggtaaccaaacaaaacctggaccacgacctcccgacggcctcctcactctatgtatgcactcccgaccgacgggacccacgtcggactactcccacgtccgtacggttcgacggtcggacgtacggttcggggtcgtacggggactacggtaccttcgaccgtcctaccaacctactacacgcacggtaccgtagtaccgtaccgtagtaaacgttagttttacgacgtttaagttttaacgttacgttcggttacgttacggtaccgtaacggttccgtaacggtaccctaacggttaccggtaaccccttaaacccggtaccccggtttaaccgggaacccgtaaaccggggtacctaaacccgggtacgttaacgggtaaacgttaaaccggtttaaaaccggtacgtacgggtttacgggaccgttaaccgaccctaaaccgttacctttacgtacgtttacccttacgttaccgtttaccccggttacccccg

SEQ ID NO: 109423 - DNA, 743 bp, Homo sapiens
  misc_feature: GYAE6OF01D9195.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaangccaccctctcctgcagggccagtcagagtgctggcagcaacttgcctaggtaaccaaacaaaacctggaccagacctccaggcctcctcatctatgatgcactccaccgacgggccacgtggaccactcccgaagcccgtaggttcgaaggtcgggactagggttcggggtcggtaggggacctaacggtaacctttccgaaccttccgtacccaaccgtaataccgacgacaacgtacccgttaaggaccgtaccgttaggtaaacgtttatttttacggaacctttaaggtttttaactttaacgttcggtttaccgttacggtacgtaacgggttccgttaacggtacctaaaccgggttccggtaaaccccgttaaaccgttcccggtttaaccgggaacccgtaaaacgggggtacccaaccggggtaacgtaaggggaaaccttaaacggttaaaaccgtacggttacggttacggaccttcggaaccctaccgtattccggttattccgtttactacgtttcccgtaccccg

SEQ ID NO: 109424 - DNA, 913 bp, Homo sapiens
  misc_feature: GYAE6OF01DL1PT.33.70.G04.1.454.CMB.1.raw
  modified_base (903)..(903): a, c, t, g, unknown or other
  misc_feature (903)..(903): n is a, c, g, or t
  modified_base (910)..(910): a, c, t, g, unknown or other
  misc_feature (910)..(910): n is a, c, g, or t
  modified_base (912)..(912): a, c, t, g, unknown or other
  misc_feature (912)..(912): n is a, c, g, or t
tcagtacacacactcacgaccggtgctcgatttagtgtagtgtgaaggggaaagggggaggaactgctcagttaggacccagagggaaccatggaagcccagctcagcttctcttcctcctgctactctggctcccgaggggaaagagcccaccctctcctgcgacgggccagtcagagtgttagcggtacctacgccgtaggtaccaacgagacgacctggccacggcctacccgacggtcctcctcttctatgatgcactaccaacgacggccacgtcggctactcccgagccgtaggttcgaggttcgggcggttgggtcgtaggggactaacggtaccttacctaccgttcaccgtaaccacttacgactaccgaacgtacccgttaacgggacgtccgttaaggtaaacgtttaacgtttttacggtaacctttaaggttttttaaacgttacctttacggtaaccgtaacggtaccgtaacggggttaaccgttacgggtaacttaaaccggtttcggggtttacccgtttaacgggggtaccccgggttttacccggggaaacccgggtaaaaaccggggggtaaaccggttaaaccgggggttaaacggttaaaaaacccgtaaaccggtaaaaacccggggttaaaacgttcggggttaacccgggtaaccgtaacccggtaacccgttaaacccggtttacttaaccgggttccgttttaaccctttacccgtttaacccggtttcccccgtttacccccgtacgttaaccgttaccggttaacggttaacgggttccgggtttagttacggttaaccggtacggggtaccgggttaaccgggcgggtttaacccgggaccggtaaaccggggctaacgggttaaacgtacgntagacgngng

SEQ ID NO: 109425 - DNA, 720 bp, Homo sapiens
  misc_feature: GYAE6OF01B1JEF.33.70.G04.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (452)..(452): a, c, t, g, unknown or other
  misc_feature (452)..(452): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtctttgctccgaggggaaangccaccctctcctgcagggccagtcagngtgctggcagctaacttgcctaggtaaccaaacaaaaccgtggaccagacctcccaggcctcctcatctatgatcgcactcccacgacgggccacgtggcactcccgagccgtaggttcaggtcggcgtaggtcgggtcgtggggaacaggtaccttcgaccttcctaccgaacctagtaccgagtccacgtacctaagacgtccgtaaggtaaacgtttnttttacggactttaaaggtttttacttaaccgtttcggttacgtacggtaccgtaacggttaccgttaacggtaccctaaaccggttccggtaaacccccgttaaaccgtacccggtttcccgggaaacccgtaaacggggtaccctaaccggtacgtaagggtaaacgttaaaccgttaaaaccggtaacgttgggtaccgtaccgtaccggacctaacccgtacgttccgttacgttacctttaccttacgttccccgttaccccg

SEQ ID NO: 109426 - DNA, 606 bp, Homo sapiens
  misc_feature: GYAE6OF01EOAMS.33.70.G04.1.454.CMB.1.raw
  modified_base (353)..(353): a, c, t, g, unknown or other
  misc_feature (353)..(353): n is a, c, g, or t
  modified_base (447)..(447): a, c, t, g, unknown or other
  misc_feature (447)..(447): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgagggaagagccaccctctcctgcagggccagtcagagtgctggcagcaacttagcctaggtaaccaaacaaaacctggaccagacctccaggctcctcatctatgatgcatccacgtacggccacgcgcactccagccgagttcagtcgcaggtggtcnggacagtacttcactcgtaccaccgatcgagcacgacctagaccgcgtagtaagttatttcgacttaagttttactactgtctgcgagtcgtanacgtaacgtcgtaacctaacgtaccgtacggaccgaacggacaacgtacgtagggaactaaaccgttaaaaccggtacgttacggtacgggtacctcggtacccgtaaacccgtagtttccgtaactttacccgtttcaccccgtttacgtacccccgg

SEQ ID NO: 109427 - DNA, 721 bp, Homo sapiens
  misc_feature: GYAE6OF01B3S6K.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaanacgcccaccctctcctgcgagggccagtcagagtgctggcagcaacttagcctaggtaccaaacaaaacctgtacacgacctcccaggcctcctacatactatgatcgacactcccgaaccgacgggccctacgtcggaccacctacccgacgcccgtaaggttccgaggtggaccgtagggtcgggtacgtacgggacgtacggtaccttacgacctccgtaccactactcgacgtcacgtacccgtagtaccgtacgtaagtaagttagttttacggactttaaaggttttttactaccgtttacgttccttacggtaccgtaacggttacgaacgtaccttaacgttacggtacccctaaacgtccccggttaacgggaacccgtaaacggggaccgtaacggtaacggtacgggtaaagttaaccgtaaaacggtaacgttgggttaccgaccgttacgacctaacccgttagttccgtttacttacctttaccgacctttcccgttaaccccg

SEQ ID NO: 109428 - DNA, 634 bp, Homo sapiens
  misc_feature: GYAE6OF01E18EL.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaangccaccctctcctgcagggccagtcagagtgctggcagcaacttgcctggtaaccaaacaaaacctgccagactcccaggcctcctcatctatcgatgcactccaccgacgggcccacgtggccagtcccacgtcccgaggtttccgaggtcggcgtacggtgggtcgtgggactagacttcactctaccacctacgtcagacctagtacctaagacgtccgtagtaaagttactttttcggacttaagttttacttacgttgttcgtacgtcgtacgtcgtagcgtaacgtcggtaccctaacgtacccgttacggaccgaaacgggtacaccggtaacgtaggaacggtaaacgttaaacgaacgttggtacggtactacggacctaaccgtacgttcctggttacccttctaccgttcccgtaccccg

SEQ ID NO: 109429 - DNA, 816 bp, Homo sapiens
  misc_feature: GYAE6OF01D8192.33.70.G04.1.454.CMB.1.raw
  modified_base (128)..(128): a, c, t, g, unknown or other
  misc_feature (128)..(128): n is a, c, g, or t
  modified_base (215)..(215): a, c, t, g, unknown or other
  misc_feature (215)..(215): n is a, c, g, or t
  modified_base (621)..(621): a, c, t, g, unknown or other
  misc_feature (621)..(621): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactntggctcccagactaccgaaccggggtaaattgtgttgacactagtctccagccctacctgttctttgccgtaccggaaggggaaacncgtcccctaccctcgtccctggaccacggggtccctaaggtcaaggtacgtcggtccgtgggacctaggaccctaaacggttccgacccggttaacggtaaacccaaaaaacctaaaaccggtcggaacccgaacgtacccgtacccgtagggtacccttacccgtataaccttacctaagtcggaattccggaacctaccggtacccgaaccggaccggtaccacggtcggacctaccgtcccgagtaccgtacgttacgaggtcggtacggtacgggtcggtacggtaacggaccgtacgttaccgttacccgaactttcccgaacctacccgtagtaccacggtacgaacgttacgtacgaccgtacgtaggtacttgttacgatttattacgtcttggtccngtacgtaacgcgttacctaaccgtacgtaccggtaacctaccgttcccgtaacgggtacctaaggggcctaaccgtaagttaacggaaacgtttaaccggaaacgttccggaggttacggtcctaacccggaaccgttaaccgttcgtttccgtaacgttaccccctttacgttacccgtccccgtttaaacccg

SEQ ID NO: 109430 - DNA, 693 bp, Homo sapiens
  misc_feature: GYAE6OF01AU716.33.70.G04.1.454.CMB.1.raw
  modified_base (198)..(198): a, c, t, g, unknown or other
  misc_feature (198)..(198): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccacggggaattgtgttgacacagtctccagccacctgtctttgctacgaggggaanagccacctctcctgcagggccagtcaggagtgctggcagctaacttgcctaggaaccaaacaaaacctggaccagacctcccaggcctcctacatctatgtatgacactccaccgacggcccacgtcggccactccgacgcctaggttcgaggtcggacgtaggttcgggtactaggggaactacggtaccttcgacttaccgtaccaacccgtagttaccgacgaccgtaacgtccgttaaggccgtaccgtaaggttaaacgttatttttaccggactttaaacgtttttacttaccgttaggttcttacgacgtacggtacggttacgacctaagttccgaaccttaacccgtccgttaccggaaccgtaagggaacccacggtacgtacgggtaaagtaacgttaaaccgagttacggtaccgtacgttaccggaccttaccgtaacgttaccgttacggtaccctttacgtaccgtttcccgtacccccg

SEQ ID NO: 109431 - DNA, 591 bp, Homo sapiens
  misc_feature: GYAE6OF01C4W0G.33.70.G04.1.454.CMB.1.raw
  modified_base (259)..(259): a, c, t, g, unknown or other
  misc_feature (259)..(259): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
tcagtacacacactcacgaccggtgctcgatttagtgtagtgtgaagggaaagggggaggaactgctcagttaggacccagaggaaccatggaagcccagctcagcttcctcttcctcctgctactctggctcccagataccaccggagaaattgtgttgacgcagtctccaggcaccctgtctttgtctccgaggggacagagccaccctctcctgcagggccagtcagactgtagcagcgcttctagcctggtaccngcagaacctgcaggctccagctctctntatgncntccacnggccactgcatcccagcaggttcagtggcaggtggctgggacagacttcactcgtacaccatcgacagactggacgcctagaagtactttgactagtacttaagttactgtcgaagtactagttaactaacggtaggggaacgtacggtttaccgggaacccgtaaacggggaacccgtaaagggtaggaaaacgtaacgaaaaccggaaaccgttaggtacggtacgttacggacctaaccgaacgttccgttacgttaccgttacaacgttcccttccccgccgttaacg

SEQ ID NO: 109432 - DNA, 748 bp, Homo sapiens
  misc_feature: GYAE6OF01AG7LI.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccgaggggaaangcccacctctcctgcagggccagtcaggagtgctggcagcaacttgcctaggtaaccaaacaaaaacctggaccagacctcccaggtcctcctcatctatgatcgccactccaccgacgggcccacgtcggacacgttccccgacgtcccgtaacgggtttccgaagggttcgggtaccgaggggtttcggggtaccgttacggggggaacctaacggttaacctttacccgactttacccgacctaacccgtactacgacgtcacgggcctaaggacgtccttaaggaacgtttattttggactttaaggttttactacgtttcgttccgtagaccggtagcggttaacaccgtaaacgttccggtaacccttaaacccgtaccgttaccgggaccggtaaacggggaccctaacggtaaccggtagggtaaaaccgttaaacgttaaaacccgggaacgttcgggttaccggtaccggtcgaaccccttaaactcgttttacccggtcgtttaccctttacgaaccgttttccccgtaaccccg

SEQ ID NO: 109433 - DNA, 703 bp, Homo sapiens
  misc_feature: GYAE6OF01D504L.33.70.G04.1.454.CMB.1.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (372)..(372): a, c, t, g, unknown or other
  misc_feature (372)..(372): n is a, c, g, or t
tcagtacacacactcacgaccggtgctcgatttagtgtagtgtgaagggaaagggggaggaactgctcagttaggaccagagggaaccatggaagcccagctcagcttctcttcctctgctactctggctccagactaccgacggggaattgtgttgacacagtctcagccacctgtctttgtctcgaggggaaancgcccacctctctgcgagggccagtcagngtgcgtggcagctaacttgccgtacggtaaccaaacgtaaaaccgtcggaccaacgtacctcccgacgggccttcctcactctatgatcgactactccgaccgtacggcacgtcggcactcccgagtccgtaggttccgaagtcggngtacggtcgggtcgtagggactacgtacttacgaccttccgacctactactcgacgtacacggtaccgtaagaccgtacgtagtaaacggtttcttttagacgtttaacgtttagtttaccgtggttcctacgtcggacgttcggtacgtacgtaacgttcggtaacccttaacgtcccgggtttaccgaacggtaacgggtaccctaacgggtacgttaacggtaacggtaaacgttaaaccgggtacggttacggtacgtccggtaacgtacccgtacgtaacgtttcttaccggttaaccttttacggtcccttacccggttaccccg

SEQ ID NO: 109434 - DNA, 714 bp, Homo sapiens
  misc_feature: GYAE6OF01AVYAD.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaacgtgctcagttaggacccagagggaaccatggaagccccagctcagcttctcttcctcctgctactctggctcccagataccgaccggggaaattggtgttgactacagtctccagccacctgtctttgctcaggggaancgccacctctcctgcgagggccagtcagagtgctggcagcacttagcctaggtaaccaacaaaaccgtggaccacggacctcccgacggtacctccgtcactctagtcgatgcactccaccgacggccacgtcgggactacgtcccgacggccgtaggtttcgaaggttcgggactaggttcgggtcgttacggggaaccacggtaccttcctaccgttacctccaaccgtacgttaccgaggacccgtacggtacccttaaggaccgtaccgtacggtaagttacgttttcggaaccttaaggtttttacgttaccgttacgttcgtcgacgtaacggtacgttacgtaccgtaacgttcggaaccccttaaccgtacccgttaccgggaaccgtaaacgggaccgtaacgtacggtacgggtaacgttaaacgtaaaccggtaacgtgtacgggtctacgacctaaccgtcgttaccttacgttacttaccgtaccgttcccgttccccg

SEQ ID NO: 109435 - DNA, 656 bp, Homo sapiens
  misc_feature: GYAE6OF01CSQMJ.33.70.G04.1.454.CMB.1.raw
tcagtacacacactcacgaccggtgctcgatttagtgtagtgtgaagggaaagggggaggaactgctcagttaggacccagagggaaccatggaagcccagctcagcttctcttcctcctgctactctggctcccagataccgaccggggaaattgtgttgacacagtctccagccctaccctgtctttgtctccgaaggggaaaagcgcccaccctctcctgcacgggccagtcagagtgctggcagcaaacgttagcccgtaggtaaccaaaacaaaaacctcggaccaagacctcccgaacggcctacctacatctatgatcgacactccaccgacggccacgtcggacacgtacccgacgacctaggttactaaggtggacgtaggtgggtcgtagggacaggtacttcactctaccaacactcgagactagacctaaggactaccgttagaacgttatttcgtaacgtaattttactacttcgtctacgctagtcggtaactaccgtaacgttcgaacccgttaacgacccggttcggaacccgtaacgggaccgtaggtacgtaaggaaacgtaacttaaacggaacgtttggtacggtactcggaaccctacgacttctacgttaccttacgttcttcccgtaaccccg

SEQ ID NO: 109436 - DNA, 576 bp, Homo sapiens
  misc_feature: GYAE6OF01A0N8O.33.70.G04.1.454.CMB.1.raw
  modified_base (201)..(201): a, c, t, g, unknown or other
  misc_feature (201)..(201): n is a, c, g, or t
  modified_base (395)..(395): a, c, t, g, unknown or other
  misc_feature (395)..(395): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (529)..(529): a, c, t, g, unknown or other
  misc_feature (529)..(529): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccaggggaaangccaccctctcctgcagggccagtcagagtgctggcagcaacttagcctaggtaccaaacaaaaacctggaccagactcccaggcctcctcatcatgatgcatccaccacgggccagtcggccactcccagcccaaggttcagtgcgagtgggctgggacagcttcactctacaccatcgagtcagcctagacncctagagtatttgcttagtttattacgtgttcngtacngtacggtactacgacgtcgacccttaacgcccgtttacggaccgaagggtaccacggtacgttggaagtaaacgttaaacgacgtggtacggtacncggcctaaccacgttccttacgtacctttcacgtttcccgtaccccg

SEQ ID NO: 109437 - DNA, 705 bp, Homo sapiens
  misc_feature: GYAE6OF01C9PM0.33.70.G04.1.454.CMB.1.raw
  modified_base (266)..(266): a, c, t, g, unknown or other
  misc_feature (266)..(266): n is a, c, g, or t
  modified_base (303)..(303): a, c, t, g, unknown or other
  misc_feature (303)..(303): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtctttgtctccaggagaaagcgcccaccctctcatgcagggccagtcagagtattagcattcttcgttggccttggtaccaanaagaacctggccaggcctcccgaggctcctcatctangatcgacatccacgacgggccacgtcggacctacgtacccgacggtacccgtagggtttcaacgggttcggaccgttaagggttcggggggttaccgttacgggggaaccgtacggtaacccttttccgaacccgtttacctaccctaacccgtaacttaccgaacggtaccgaacccggtacccgtttaacgggaccggtacccgttaaggtaaacggtttacgtttttacggaccttttaagggtttttaaccttacggttacgttctacggtacgtacgtaccggtacgaactacgtacggtacctactaccgttcgaacgtacggacacgtacgagtacgtaacgtaaacgagttcgcggcgtacgcctaacgtcttacctcgttcccttcgtaaccg

SEQ ID NO: 109438 - DNA, 706 bp, Homo sapiens
  misc_feature: GYAE6OF01DGGHQ.33.70.G04.1.454.CMB.1.raw
  modified_base (201)..(201): a, c, t, g, unknown or other
  misc_feature (201)..(201): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaattgtgttgacacagtctccagcccacctgtctttgctccgaggggaaangtcaccctctcctgcagggccagtcagagtgctggcagctaacttagcctgggtaaccagcaagaccaccgtcggacccaggccctcccgaggtcctccctacactccctagttcggtgctactcccgaaccggtacgggaccctacgtcggaccacgtacccgaagaccgtaggttccaggttcggacgtagggttcgggtacgtcggggaactcggtactttacgactttccgacctaaccctagttaccgaacggtaccgtaacggtaccgtaggggtaccgtacccgttagggtaaacgtttacgttttacggaccttacggtttacttaacgtttacgttcgtacgtaacgtacgtaagttaggttaccggtaggggtaacgttaccgggtaccggaccggaacgggtacgtaaggtaacggtaaactacgaaacgtacgtggtacgcgttacggcctacgtattcgttacttccttactccgttcccttaccccggtac

SEQ ID NO: 109439 - DNA, 688 bp, Homo sapiens
  misc_feature: GYAE6OF01AG3T3.33.70.G04.1.454.CMB.1.raw
  modified_base (200)..(200): a, c, t, g, unknown or other
  misc_feature (200)..(200): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccacctgtctttgctccgaggggaanagccaccctctcctgcagggccagtcagagtgctggcagcaacttgcctaggtaaccaaacaaaacctggaccagactcccaggcctcctcatctatgatgcatcccaccgacggccacgtggccactcccagcctaaggttccaggtcggctaggtcggggtcgtggggactacgaacttcgaacttctaccaacctataccagccaacggaccctaggacgtccgtaggtaaacgttacgttttacgtaccgttaagttttttaacttaccgttggtttccttaggtacctaacggtacggttacgacccgtaacgttccggaacccttaacccgtaacccgtttaccgggaacccgtaaacggggtaccctaaccggaacgttaggaacgttaaaacgttaaacggaaccgttgggtacggtacgtacgaccgtaacccgtagttccttacggttaccctttacgtacctttccccgttaccccg

SEQ ID NO: 109440 - DNA, 539 bp, Homo sapiens
  misc_feature: GYAE6OF01BSBZP.33.70.G04.1.454.CMB.1.raw
  modified_base (185)..(185): a, c, t, g, unknown or other
  misc_feature (185)..(185): n is a, c, g, or t
  modified_base (504)..(504): a, c, t, g, unknown or other
  misc_feature (504)..(504): n is a, c, g, or t
  modified_base (507)..(511): a, c, t, g, unknown or other
  misc_feature (507)..(511): n is a, c, g, or t
  modified_base (513)..(539): a, c, t, g, unknown or other
  misc_feature (513)..(539): n is a, c, g, or t
tcagtacacacactcacgaccggtgctcgatttagtgtagtgtgaagggaaagggccaccctctcttgtagggccagtcagagtgttagcagcaactacttagcctggtaccagcagaccacctggccaggctcccaggctcctcatccatggtgcatcccaccagggccatggcatcccagacnggttcagtggcaggtgggtctgggtcagacttcattctcaccatcgagcagcgtggacgcctagaagtattttgctagttgttattacgtgtcagcgtagtacggtagttctatccgtccggtacggttcggaccgaaagggacctaagggtagtaaacgtacgaaaacgtaacgtggaggtcctaggaccctaacgtaacttcgttcgtttaccttactacttaccccgttccccggtacctattaccggtaggtaacggtttcggtggttacgtacgtcgggtagggtcgggtcgtagggacacgggcgtcaatagntgnnnnngnnnnnnnnnnnnnnnnnnnnnnnnnnn

SEQ ID NO: 109441 - DNA, 692 bp, Homo sapiens
  misc_feature: GYAE6OF01D6WVZ.33.70.G04.1.454.CMB.1.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaagngcccaccctctcctgcgagggccagtcagngtgctggcagcaacttgcctaggaaccaaacaaaaacctggaccaagacctcccaggcctcctcatctatgatgcatcccacgacggccactggaccactcccagccgtaggttccaaggttcggcgaggttcgggtcgtaggggacctacggtacctttcgaacctctaccaccgtatcacgtacacgtcctaacggagcccgttaggtaaacgttacgttttgaccgtttaaggttttactttacgttcgttctgacgtacggtacgttaacgacctaacgttccggtaacccttaaaccgtacccgtttaccgggaacccgaaacgggtacctaaccggacgtaacgggaacttaaacgttaaaaccggtaacgttagggtacggtacgttacgaccctaaccgtacgttaccgttacggttaccctttacgtacccgttcccgtttaacccccg

SEQ ID NO: 109442 - DNA, 633 bp, Homo sapiens
  misc_feature: GYAE6OF01BF8OS.33.70.G04.1.454.CMB.1.raw
  modified_base (202)..(202): a, c, t, g, unknown or other
  misc_feature (202)..(202): n is a, c, g, or t
  modified_base (515)..(515): a, c, t, g, unknown or other
  misc_feature (515)..(515): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccgaggggaaangcccaccctctcctgcagggccagtcagagtgctggcagcaacttgcctaggtaaccaaacaaaacctggacccagacctcccaggcctcctcatctatgatcgacactccgaccgacggccacgtcggcactccccgagccgtaggttcgaggtcggctaggtcgggtacgtggggactagtaccttcgaccttcgtaccacgactcgaacggcacgtacctaggacgtccgtaagtaacgttatttacggacttaaggttttacttacgtggttctggacaggtcgtagacctacggttacgtacctaacncccggttaccgggaccgtaagggaccacggtaacgtcgggaactaaacgtaaccgacgtgtacgggcttacgaccgtacctacgttcctacgttaccttaccttgtccccgttacccg

SEQ ID NO: 109443 - DNA, 929 bp, Homo sapiens
  misc_feature: GYAE6OF01B0HR3.33.70.G04.1.454.CMB.1.raw
  modified_base (854)..(854): a, c, t, g, unknown or other
  misc_feature (854)..(854): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaaattgtgttgacacagtctccagccacctgtctttgtctcgaggggaagcgccaccctctcccggcgacggcgacgtcgacgagtggcgtcggtcgacgacgtaacttacgtaccgtcggtaaaccgaaaccaaaaaccgtacggccaacgaccgtacccaccggacctccctctactacttacgtgtaacgttgccgtaactccccgtaccccggaacggggaccccgaacgtcgggacccaccgtaccccgaccgacccggtaacggtttaccggtaacggttacgggtaccgtaacggggttcggggttaccgggtacgggggtaacccgtaacgggttaaccctttaccggtacccttaacctaccccgtaaacccgtacgtacccgtaacggaacccgtacccggttaacccgttaaaggggtaccccgttaacccggtaggggttaaaaaaccggtttttctttttttacgggtaaaccgtttaacgggtttttttaaactaacccggttttcgtttaccgggtaccgtcggtaaacggttacccggttaggtacccctttaaacgggttaccccggaacccgttaaacccccgttacccggtttcccgggaaaacccgggtaaacgggaaccctacggtagggaaccgtttaagggtaaaccttaaaaaccggtcgttggttaacggggtacccncaaacccggttaactacctttacgtttccgggtttaccctttacaccggtttcccccgtttaaccccgtaaccgg

SEQ ID NO: 109444 - DNA, 779 bp, Homo sapiens
  misc_feature: GYAE6OF01DBJMC.33.70.G04.1.454.CMB.1.raw
  modified_base (210)..(210): a, c, t, g, unknown or other
  misc_feature (210)..(210): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagactaccgaccggggaaattgtgttgacacagtcctccagccctaccctgttctttgtctaccgaaggggaaancgccaccctctcctgcgacgggccagtacaggagtgcgtggcaagacctaaacgttacgaccgtacggtaaaccaaaacgaaaaaccgtcggaccaacgacctacccacggtccttcctactaactcttaatacgatcgacaccgtacccgaaccgacgggacccaacgtcggacctacctaccccgacgtaccgtacggttacgacggttggaccgtagggttcggggtacgtacggggaactacggttaaccttcctaaccgttcctaccgtacccaataccgaacgccgtaaccgtaccgtaacggaccgttaccgttaggtaaaagtttcgttttttacgaacgttttaaacgttttacttaacgtcggttactacgacgtacggtacgtaacgtacctaacgtaccgtaaccctaaaccgttaccgtaccggaaccgaaagggtaacctacggtaaccggtaaggtaaacgtaaccgtttaaaaccggacgttgggtaccgtacgtacgaaccttaaccgtacttccgttaacgttacctttaccgacctttcccgtaaccccg

SEQ ID NO: 109445 - DNA, 884 bp, Homo sapiens
  misc_feature: GYAE6OF01B494L.33.70.G04.1.454.CMB.1.raw
  modified_base (201)..(201): a, c, t, g, unknown or other
  misc_feature (201)..(201): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagataccaccggggaaattgtgttgacacagtctccacgccacctgtctttgctacgaggggaaancgccacctctcctgcgagggccaggtcagagtgcgtggcaggctaacgttacgccgtaggtaaccaaaacaaaaccgtcggaccaagaccgtaccaggcctcctacacttcgtatggatcgacctatacccgaacgacggtcccacgtacggaccaacgtacccccgatacccgggggggtaattcgaacgggttcgggaccgttaaggggtttcggggtaccgtacgggggaacctacggtaaccctttacgaccttcctaccgaaccctaagtacccgacgtaccgaacggtacctaaggacgtaccgttaaggtaacgtttacggttttacaaccggtttaaacgttttaactttacccgttaggttaccgttacggtaacggtaccggtacggttaacgaaacccggttacgttaccggggtaaacccccttaaacccggttaaccccgggttaaccgggaaacccggtaaaacgggggttaacccctaaccgggtaaacgggtttaaacgggggaaaaccgtttaaaaaccggtttaaaaaacccggggtacggttaccgggttaaacggggttccccgttacccgggaacccttaaacccggtttactttacccgttaccggtttttaaccgttaaccccgttttaaaccgtttccccccggttttaaacccccggg

SEQ ID NO: 109446 - DNA, 659 bp, Homo sapiens
  misc_feature: GYAE6OF01DRVZ6.33.70.G04.1.454.CMB.1.raw
  modified_base (201)..(201): a, c, t, g, unknown or other
  misc_feature (201)..(201): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagataccaccggggaaattgtgttgacacagtctccagccaccctgtctttgtctccaggggaaangccaccctctcctgcagggccagtcagagtgctggcagctaacttggcctaggtaaccaacaaaaaccgtggccagacctcccaggtcctcctcatctaatgatggacactccaaccgagggcccacgtcggactactccccagccgtacggttcaggtggctaggttcgggtctaggggacagtaacctttcgaccttctacacccataccacgctacgaccctaggacgtaccgtagaaagttctttttggaccttaagttttattacgttcgttcgtagctaaggtcgttaagacccgtaacgttccggtaccccttaaaccgtcccgggtttaccggaacccgggtaaacgggtaccgacggtaccgtagggaacgttaaacgttaaaccgaacgttggtacgggacctgaccctactaagttccgtacttccgttacacgtttccctaccccg

SEQ ID NO: 109447 - DNA, 630 bp, Homo sapiens
  misc_feature: GYAE6OF01BPX1C.33.70.G04.1.454.CMB.1.raw
  modified_base (200)..(200): a, c, t, g, unknown or other
  misc_feature (200)..(200): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (367)..(367): a, c, t, g, unknown or other
  misc_feature (367)..(367): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccgggaattgtgttgacacagtctccggccaccctgtcttgtctcgaggggaaangcccacctctcctgcgaggccagtcagagtgtagcggtactgcctgacacngnacctgccagcctccagctctnttacntnatgctatccaagcggccagtggcactcccagtccgtagtcaggtcggcggtggtctaggacacgtacttcgactcgtacacgtacnctaggcctaggcctaaggactccgtacgtaagttagttttacgacgtttaagtttacttacgttgttaccgtagtacgtagtaccggttacgaccgttaacggttcggttacgtttgggtacccggttcgggaaccgtaacgggtaacgtaacgggttacgaaactaccgtaaacggtaccgttggacgtccgtacgaccgtacgtacgttctccgttaccttcgtaccttcccgttacccgacttactcggttcggtaacgg

SEQ ID NO: 109448 - DNA, 656 bp, Homo sapiens
  misc_feature: GYAE6OF01D6P08.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagngccaccctctcctgcagggccagtcagagtgctggcagcaacttagcctaggtaacccaaacaaaaacctggaccaagacctacccaggcctcctcatctatgatgacactccaccgaggccacgtggcactcccagcctaggtcagtggcgtaggtgggtcgtagggacaggtacttcgactctaccactactcacgccagcctaagacgtccgtagtaacgttattttcgactttaagttttacttacgttgttacgtgactaggtcgtagccgtaacgttcggaacccttaaccgtacccgtttaccgggaacccgtaaacggggacccaaccgggtacgttaacgggaaagttaaacgttaaaaccgggtacgttgggtacggacgtcgacccctaaccgtacgtttccttacggttacctttccgtaaccgttccccgttaacccccg

SEQ ID NO: 109449 - DNA, 806 bp, Homo sapiens
  misc_feature: GYAE6OF01CT5T1.33.70.G04.1.454.CMB.1.raw
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagataccgaccggggaaattgtgttgacacagtctccagccacctgtctttgtctccgaggggaaangcccaccctctccgtgcagggccagtcagngtgctggcagcaacttagcctaggaccaaacaaaactcgaccagactccagctcctcatctatgatgcactccaccacgggccacgtcggacactacccacgccgtacggttacgaggtcggccgtaggttcggggtacgttcggggaacgtacggtaccttacgaccgtttctacctaccgtaacttaccgaacgaccgtacgggtaacccttaacgggaccgttacccggttaaggttaaaacggtttacgttttttacggtaacggttttaaacggttttttaacctttaccgttacgggtttaccttccgggaccgttacggtaccggtaaccggaccgttaaaccggttcccggttaacccgttaaacccgtaaccccggtttacccgggaacccggttaaacgggggaacccctacgggtaaaccgttaaggggtaaaaccttaaaacccggttaaaaccgggtaacgttttcggggacccgttaacggtacccggtaaaccctacccgttaaccgttccgttaccgttttaacccttaccgtacccgttttcccgttaaccccccgg

SEQ ID NO: 109450 - DNA, 770 bp, Homo sapiens
  misc_feature: GYAE6OF01CADZ7.33.70.G04.1.454.CMB.1.raw
  modified_base (210)..(210): a, c, t, g, unknown or other
  misc_feature (210)..(210): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagactaccgaccggggaattgtgttgacacagtcctccagccctaccctgttctttgtcctccgaagggggaaancgccctaccctctcctgcgacgggccagtcagaggtgcgtggacagacctaacttacggcctaacggtaaccaaaaccaaaaccgtcggacccaagacctacccgaggtccctacctacattacctatgatcgactacctcccgaaccgacgggccctacgtcggacctacctcccgacgtccgtaggttaccgaggtcgacggtggtcgggtacgtaggggactacggtaccttccgtaccttcctaccaacctgtaccgacgtccaacggtactaacggacgtaccgttagtaaacgtttgtttacggaacttttaaggttttacttaccgttcggttaccgtacggtactaggttaccgtaacggttaaccctaacggttccgttaaccccgtaaccgttaccccgggttacggaaacccggtaacggtaaccgtaaccggtacggtaaacggtaagtaaaaccggtaaaaccgtacggttcggtaacggtacttaccggacccttaaacgttccgtttcgttaccgttacctttaccgtccgttaccccgttaccc

SEQ ID NO: 109451 - DNA, 626 bp, Homo sapiens
  misc_feature: GYAE6OF01BZ5XE.33.70.G04.1.454.CMB.1.raw
  modified_base (204)..(204): a, c, t, g, unknown or other
  misc_feature (204)..(204): n is a, c, g, or t
  modified_base (420)..(420): a, c, t, g, unknown or other
  misc_feature (420)..(420): n is a, c, g, or t
tcagtacacacactcacgaccggtgctcgatttagtgtagtgtgaagggaaagggggagggaactgctcagttaggacccagagggaaccatggaagccccagctcagcttctcttcctcctgctactctggctcccagataccaccggggaattgtgttgacacagtctccagcccaccctgtctttgtctccagggggaaangcccaccctctcctgcacgggccagtcagagtgctggcagctaacttagcctaggaaccaaacaaaaaccgtggtacacgactcccaggcctcctacatctatgatgcactccaccgaggcccacgtcggcactcccgagccgtaggttcaggtcggcgtaggtcgggtcgtagggactagtaccttcgacctttcaccagtcacgcacgtcacgnaccgtagtaatatttcgacttaagtttatacgttgtacctgcgtagtacgtagtacaaccgttcggacctaaccgtccgttaccgaccggaacggtacaccggtacgtagggtaaacgtaacgttaaaccgaacgttgggtacggttccaaggtcccaaccgtacttcgttcgttacccttactaccgttcccgttcccccgtacg

SEQ ID NO: 109452 - DNA, 927 bp, Homo sapiens
  misc_feature: GYAE6OF01EN8WX.33.70.G04.1.454.CMB.1.raw
  modified_base (206)..(206): a, c, t, g, unknown or other
  misc_feature (206)..(206): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagactaccgaaccggggtaattggtgttgacacagtctccagccacctgttctttgctccgagggaaacngcccacctctccgtgcgaggccagtcgagagtgcgtggacagacctaacgttacgccgtaagtaaacccaaaacaaaaaccgtggacctaacgaccctaccgacggccttcctactaatctaagtagtaactcgactaacgtccgaaccggtacggacccgtacgtacggaccaaccgtaccccgaacgtaccgtaacggttcgacggttacgggacggttaacggttggggtttaccgtaacggggtaactaaccgggttaacctttcgtaacgtttacccgtaccgttaaacccgtaaacgtttaccgaaacggttaacccgtaacgggttaaacccggttcgggtaaacccggttaccggtttaaacgggtaaaacgggtttttcgtttttaacgggaaccgttttaaagggtttaacgtttaaaccggtttacgtttaacgggtaaccggtaaacggtacccgtttaaacggggttttaacggtttaacggtttaaccgttaaccggttaccccgtttaccgggtaaccgggtttacccggggaaacccgggttaaacggggtaaaccgttaaaggggtaaccgttaaaacgtaaacccggtaaaaacgggtacccgtttagggtccgggttaaccgtacgttaacccgtaaaccgtttacgttaaccgttgttaaccccgtttaaccaccgtttaaccccgtccccgttaaaaccg

SEQ ID NO: 109453 - DNA, 881 bp, Homo sapiens
  misc_feature: GYAE6OF01B22GA.33.70.G04.1.454.CMB.1.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
tcagtacacacactcacgaccggtgctcgatttagtgtagtgtgaagggaaagggggaggaactgctcagttaggacccagagggaaccatggaagccccagcgtcagcttctcttcctccgtgctactctggctcccagactaccgaccggggtaattgtagttgacacagtctccagccaccttgtctttcgctccgaggggaangccaccctctccngcaggccagtcagagtgcgtggacagacctaacgttacgccgttacgggtaacccaaaaccgtaaaaacccgttcgggaacccacggaacccgttccccgaacggtacccgttacccgtaccacttaccttaagtcggtaaatcggtacctaaaccgttaccccgaacccggtacgggggtacccctacggttacgggtaccgtacccgttacccccgaacggtaccccggttaacggggtttccgtaacgggttcggtaccggtacgggtttacggggttccgggttacggggaaccgacggttaccgttacctaacccgttcccgtacccacctaactccgacggtaccaccggtaccgtacgacggtaccgttagttaacgtttacgtttttacgacggtttaacgtttttacctttacgtttcgttacgtcgtaacccgtacggtacggttaacgtaccgtaacggttccggttaaacccttacccggtacccggtttaaccgggaaccccggttaaacgggaacccgtacgggtaacgtacgggtaaacggttaaaccgttaaacggttacggtacggttaccggttacgtcgtaaccccgtaccgttagttcccgttaccgtttaaccttcttaccccgttcccgtttacccccg

SEQ ID NO: 109454 - DNA, 867 bp, Homo sapiens
  misc_feature: GYAE6OF01A9VJ8.33.70.G04.1.454.CMB.1.raw
  modified_base (207)..(207): a, c, t, g, unknown or other
  misc_feature (207)..(207): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgacgggaattgtgttgacacagtctccagccctacccttgttctttgtcctaccgaaggggaancgcccaccctctcctgcgacgggccagtcagagtcgcgtgacacgactaacttacgccgtacgtaaaccaaacgtaaaaccgtgacccacgtaccctcccgacggtccttaccacacgttccgtacgacgttccgacccgtaccgaacggccggacctaccggtcggacctaccgtcccggacgtaccgtacggtttcgaggttcggacggtagggttcggggtaccgtacggtacgtacgttacctacgtacccgttcctaaccgaacccttacgtaccggtaacgtaaccccgtaaaccgttaagttaacccgtttaaggttaactttttacttttacgtttaagttttttaaccgttaccttaaccggttaacctaaaccggtaccgttaccggtaaccgttacgtacccgttacgggttccccgttaccctttaaccggttaccggtttaccggggtaacccggggtaccgggtaaacccggggttaacgtaacggggtaccggtaacgttacccgttaaacggtaaaaccggttcggttccggtaaccggtccgtacccggttaaccccagtttccttcccggtttaccgtaccttacccgttttaaccccgtaccgttaacccccggtttataacccggtttttggaaaccggg

SEQ ID NO: 109455 - DNA, 799 bp, Homo sapiens
  misc_feature: GYAE6OF01AWQAP.33.70.G04.1.454.CMB.1.raw
tcagtacacacactcacgaccggtgctcgatttagtgtagtgtgaagggaaagggggagactgcgtcagttaggacccagacgggtaaccgatcggaagccccagtctctagcttctcttcctccgtgctaactctggctcccagactacgacggggaaatttggtgttgacacgtagttctcctagtaccctaccctttaggttctttcgtcctccggaagggggtaacgacgccctacccgtttctcccgtggccggacgggggcctagttcgaaggacgggtcggcgtcgggcctaggacctaaacgttcggtccgttacgggtaaaccaaaaaccgtaaaacccgtggacccgtaacgtaccctacccgaggtacccttaccgtctactttccgtagttacggactacggtaccgtaccgtaccccgaccggaccggggaccctaaccgggtacggggacctaccgtacccggaaggtccgggttaacggtcgaggttacgcgtacggttgggtcggtacgggtacgaaggtaccgttacgaccgttacctaccgtaacgtcgtaccgacgtcgaccgtacgttaacgtccgtacgtttagtaacgtttacgtttagcgtttaagttttacttacgtagtacgtcgaccgtgtacgtaccacgtacgtccgtaaccttaccgacgttaccggacggaacgtcgacggacggtacgttaacgaaagttaaccgtagccggtaggtcctcgaccgtactacgttcgtacgtttaccctcgtaccgttcccgtaaccg

SEQ ID NO: 109456 - DNA, 765 bp, Homo sapiens
  misc_feature: GYAE6OF01DXNMM.33.70.G04.1.454.CMB.1.raw
  modified_base (167)..(167): a, c, t, g, unknown or other
  misc_feature (167)..(167): n is a, c, g, or t
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagactaccgaccggggaattgtgttgacacngtctccagccacctgttctttgctccgaagggaaancgccaccctctcctgcgacggccagtcagtagtcgctggcagctaacttcgcctacggtaaccaaaacaaaaccgtcggaccacgacctacccgaggcctcctacattacctaagtgaacgtcgaccacctacccgaccgtacgggcctacgtcggacctactccccgaagtacccgtaggttaccgtagggtcgacggtaggtcggggttacgtacggggtaacctacgtacccttccaccgttacctacccactacgtccgtaacgcctaaccggtcccgtagacccgttccgtaagttaacggtttattttacgacgtttagttttaaccttgttacgttcctagacgttaacggaccgttacgtacccgaacgttcccggtaaacccttaaccggtacccgttaccgggaaccggaaacggtcctaaccgggacggtaacgtaacgtaaaccgtttaaacgacggttcgggtacgtaccgttaaccgccgttaaaccctacggttttacccgttccgtttacccgtttaccccgttacgttaccccccggtttacccc

SEQ ID NO: 109457 - DNA, 714 bp, Homo sapiens
  misc_feature: GYAE6OF01D83HJ.33.70.G04.1.454.CMB.1.raw
  modified_base (659)..(659): a, c, t, g, unknown or other
  misc_feature (659)..(659): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggagaagttgtgttgacgcagtctccaggcaccctgtctttgtctccagggaagacgccaccctctcctgcacgggccaatcagagtgttagcagtaacttagtctgtaccaacatagacctgaccaggctccagctcctcatctacgatgccgtaccaacgcgggaccacgtggaccacgtcccgagtcctaaggttccgaaggtcggacgtaggttcgggtcgtggggaacacggtaccttcgtaaccttcctaccgacctacttaccgaacgacctaaacccgttaacggtaaaccgtttaggtaaacgttttaattttttaccttaagtttttttaaacttacttacgttaaacgtaacccttactaccggaacgtccgtagttcccgtggtacccttacgttaccgtaaccggttttccgggacgggtaacggggtaaccggtaacgggtcgaacggtacctaaccggaaaacgtaccgtaggtacggtacgtcggaacccaacgttnttaacccgttggtttaccttccgtactttccccggttacccctactgttaaccgg

SEQ ID NO: 109458 - DNA, 700 bp, Homo sapiens
  misc_feature: GYAE6OF01BIC00.33.70.G04.1.454.CMB.1.raw
  modified_base (335)..(335): a, c, t, g, unknown or other
  misc_feature (335)..(335): n is a, c, g, or t
  modified_base (655)..(655): a, c, t, g, unknown or other
  misc_feature (655)..(655): n is a, c, g, or t
  modified_base (695)..(695): a, c, t, g, unknown or other
  misc_feature (695)..(695): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggcctcccagactaccaccggagaaattgtgttgacgcagtctccaggcctaccctgtctttgtctccgaggggacagacgcccacctctcctgcgagggccagtcagcttgtagcgagtcgtcttcgtacgccgtaggtaccagacaacgtaaccgtggaccgaggtccctcccgaggtcccttcccgtcctgttacgtcgggtnaccctacgtacccgaccggacgggtaccctacgtcggaccacgtacccgagtacgtacggttacgaggtcgacgttagggttcgggtacgtacggggaacctaggttaccgttacccgaacttcccgtaaccgtaacccgtacgttacccggaacgtacggtaccgttacgggacgttaccgtaaggttaacgttactttcgggaactttacggttacttacgtttacgtcgtaaccgtagtacgtaagttacgtacgggtgggaccgttacggtacgggaacgtaacggactaagggtacaactacgtaacgtgtacgnggactacacgtactgtctcgttacacctgtttccctccgnttacg

SEQ ID NO: 109459 - DNA, 761 bp, Homo sapiens
  misc_feature: GYAE6OF01B16TJ.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccgaggggaagngccaccctctcctgcagggccagtcagagtgctggcagctaacttgccttaggtaaccaaaccaaaaaccgtggacccaaggaccttacccgaggtcctcctcattctatgatcgcactcccgaccgacgggaccacgtcggccactaccccgacgaccgtacggttaccgaggtaccggcgtaggtcggggtacgtcggggtaaccaaggttaccttaccgtacttcccgtacctaccgtagtaccgaacggacccgtaacggaccgttaacgggaaccgtacccggttaagggaaaacgttttacgtttttacggtacctttaacggtttttaacgtttaccggttagttttccggtagtacccgtagggttacccgtaaccgtaaccgtaaccggttacggtaaccccttaaccgggtaccccgtttacccgggaacccggtaaacgggaccctaacggtaccgtagggaaacgtttaaaccgtaaacggtacgttggtacggcttaccggactaaccgtcttcggtaccttaccgtttcgcctttcccgtacccg

SEQ ID NO: 109460 - DNA, 690 bp, Homo sapiens
  misc_feature: GYAE6OF01DJU37.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaanagccaccctctcctgcagggccagtcagagtgctggcagcaacttgcctaggtaaccaaaacaaaaacctggaccaagacctcccaggcctcctacatctatgatcgaccactcccgaccgacgggccacgtcggcacctccccagccgtaggttcaacggtcgggacgtaggttcggggtctacggggaactacggtaaccttccaacgtcctaccaacccagttaccaacggacctaacgtacccgttaggaccgtacccgttaaggtaaacgtttatttttcggaacgtttaaggttttactttaccgttggttacctcggtacgtaggtacccggtaagcccttaacggtcgtaaccccgttaacttacccggttaccgggaaccaagggacccacggtaacgtaggtaacgtaaacgttaaacggacgttggtagctacggaccctacgtacttctacgtcttaccgtacttcccgtacccg

SEQ ID NO: 109461 - DNA, 763 bp, Homo sapiens
  misc_feature: GYAE6OF01BW5YP.33.70.G04.1.454.CMB.1.raw
  modified_base (295)..(295): a, c, t, g, unknown or other
  misc_feature (295)..(295): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaattgtgttgacacagtctccagcccacctgtctttgtctccgaggggaaagacgccaccctctcctgcagggccagtcagagtgctggcagcaacttagcctaggtaaccaacaaaacctggaccagactcccaggcctcctanatctatgatcgcactccaccgacgggccacgtggcacncccganacgtaggttcaggtggctaggtgggtcgtgggacacggtacttcgtacttcctaccgaacctagtaccaaggtcctaaggaccgttcgggaacggtccgttaaggtaaacggtttactttttacggacgttaagtttaggtttaacgtttaccgttcggtaccgtaggtccttaacggggttaacccggtttaagttttccgtaaccgtttccgtaccccgggttaaccggggttttacccgggaacccgttaaaccgggggtaacccgttaaacgggttaaacggaaaacgttaaacccggtaaaaccggtaaaccgtttacggggtaccgggttaccgtaacgggacccttaaaccccggtattaccgtttacggtttaccccgtttaacctacccttttcccccggttaccccggtaaccc

SEQ ID NO: 109462 - DNA, 786 bp, Homo sapiens
  misc_feature: GYAE6OF01A7OET.33.70.G04.1.454.CMB.1.raw
  modified_base (201)..(201): a, c, t, g, unknown or other
  misc_feature (201)..(201): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaattgtgttgacacagtctccagccaccctgtctttgtctccgaggggaanacgccaccctctcctgcagggccagtcagagtgctggcagcctaacttcgccgtaggtaacccaaaacgaaaaacccgtcggacccaaggtaccctaccccgaaggtccttccctacacttcctagtgactcgacacttacccaaccggacgggtacccacgtcggacctaccgtaccccgacggaccccgttagggttacacggttcggcgtaacgggttcggggtaccgttaggggaaccgtacgtaccgttttaccgaccctttaccctacccgtaaaccccgttagttaacccgacgtacccgtaaccggtacccgtaaggtacccgtaccggtaagttaaagtttacgttttacgacgtttaagtttttaacgttacgttcggttctacggtcgtaaggtccggttaactacccgtaacgttaccggtaacccttaaccggtccccgttacgggaacccgaacggtaccgtaccggtaacgttacgggaaattaaaccgtaaaccggtagtcggtaggacctacggacctaaccgtactttctacgtttacttacccgtaacgttccccggttaaccccg

SEQ ID NO: 109463 - DNA, 688 bp, Homo sapiens
  misc_feature: GYAE6OF01D3K0C.33.70.G04.1.454.CMB.1.raw
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
  modified_base (290)..(290): a, c, t, g, unknown or other
  misc_feature (290)..(290): n is a, c, g, or t
  modified_base (634)..(634): a, c, t, g, unknown or other
  misc_feature (634)..(634): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccacctgtcttgctcaggggaaangcccaccctctccgtgcagggccagtcagngtgctaggcagctaacttgcctaggaaccaacaaaacctggaccagacctccgaggctcctnatctatgatcgctactccaccgacgggaccacgtcggactacgtcccgacgcctaaggttcgaaggtcggaccgtaggtcgggtacgtacggggaacgtacgtaccgttacactaccgtccaacgttacacgacgtaccaggtacccgttaaggaccgtaaccgtggtaaacgttagttttcgacgtttaacgtttaacttcgttcggttacctggtacgtacggtaccggtaacgtccgtaaaccgtggtaacccctaaccgtcccggttaaccggccggtaaacgggtcctaacgggaacttcggaaacgttaaccgttaaaaggtacgtggttacgtaccnggtacccctagtacggttaccttcggttaactcctaagttcccccgttacccgg

SEQ ID NO: 109464 - DNA, 603 bp, Homo sapiens
  misc_feature: GYAE6OF01AFSQX.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggagaagttgtgttgacgcagtctccaggcaccctgtctttgtctccaggggaaanagccaccctctcctgcagggccaatcagagtgttagcagtaacttagtctggtaccaacatagacctgaccaggcctcccaggcctcctcatctacgatcgccgtccaacgcgggccactggccactccccagcccaaggttcaggtcggctaggtgggtctgggacagtctttcactctcaccatccagccaacctagaacttagaagttattttactattttattacttgtactaactactcacggtcagtctaggccttctactaccgtttcgggacgggtaacgggaccgaagggttcggacgtaccgtaacgaaaaccgtacgttggtacggccgtggacccaacctacttccgttgttacctttcctacttcccgtttccccgactacgttaccg

SEQ ID NO: 109465 - DNA, 700 bp, Homo sapiens
  misc_feature: GYAE6OF01B65H2.33.70.G04.1.454.CMB.1.raw
  modified_base (200)..(200): a, c, t, g, unknown or other
  misc_feature (200)..(200): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagataccgaccggggaattgtgttgacacagtctccagccaccctgtctttgctccgaggggaangccaccctctcctgcagggccagtcagagtgctggcagactaacttagcctaggtaaccaaacaaaacctggaccagacctccagcctcctcatctatgatcgacactacccaccgacgggcccacgtcggacacgtccccagtaccgtacggttcaacggtggccgtaaggttcgggtaccgttagggggaacctaacggtaccctttacgaccttacctacccgtacctacgtccacgtaccgacgtacccgtaaggtaccgtaccgtagtaacgttacgtttttacggcctaaggtttcgttaacgtttacgtcgtacgacgtacgtaacggttacggttattacgtaacgttccgtaccggtaccgtttaccgggaaccgtaacggggaaccgtaaggtacggtaaaacgtaccggaaaacgttacgtaggtacgtaccgtacgaccgtacctagttcctttacggttaccttaccgtacgttccctcccggtacc

SEQ ID NO: 109466 - DNA, 562 bp, Homo sapiens
  misc_feature: GYAE6OF01AVU7J.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaagagccaccctctcctgcagggccagtcagagtgctggcagcaacttagcctggtaccaaacaaaacctggaccagactcccaggcctcctcatctatgatgcatccaccaggccactggcactcccagccaggttcagtgcaggtggtctgggacagacttcactctcacatcagcacgcctagacgtcctgaagtattttaggctaagttttagttactggttcctgctagcgtagcaacgtcggacctacgaccgttcggaccaagggacaccgacgtggtaagaacgttaaacggaccttggtaggcctcggacctacctacgttccttcggttacctttcgacccttcgttacccccg

SEQ ID NO: 109467 - DNA, 741 bp, Homo sapiens
  misc_feature: GYAE6OF01B84GQ.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggcctcccagataccgaccggggaattgtgttgacacagtctccagccaccctgttctttgtctccgaaggggaaacgcgccctaccctctcgttggacggccagtacgagtaggttgttacgacgacgactaaaccttaccgttacgccgttacggtaaccagaccgacgaccgaccgtcggaccgacggtacccgtacccggacggtcccttccgtactacctccgtaggtcggtacgccctaccgtaccccgaaccggtaccggggaccctacggtccggaacctacccgtacccgaaggtaccggttacgggtacgtaggtcggtacgtacggggtcgggtacggtacgggactacggttaccttcgtacgttcctaccgactacgccgtacgacgtacgacgtacggaccgtcgttaaaggtacgtttactttcgtactttaacgtttactacgttccgtagtcgacggtacgtagtaccgacgtaccggttcgtaaccctaaccgtccggtaccgaacgtaccggacacgtaggagtaacgtaaacgttaaggcgttaggcgtcgaccgtacgaacttgtaccgttgttacctcgtcccgttcccg

SEQ ID NO: 109468 - DNA, 641 bp, Homo sapiens
  misc_feature: GYAE6OF01BS31Z.33.70.G04.1.454.CMB.1.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
  modified_base (590)..(590): a, c, t, g, unknown or other
  misc_feature (590)..(590): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctgctcccagataccaccgggaaattgtgttgacacagtctccagccaccctgtctttgtctccgaggggaaanagccaccctctcctgcacgggccagtcagagtgctggcagcaacttagctggaccaacagacgacctggccaggcctccgagcctcctcttcgatgatcgcatcccaancgggccacgtggcactcccgagccgtacggttcaggtggcggtagggtcgtaggggacagtaccttcgacctcgttacacctacgtcgaagccaacgccgttaaggactaccgtagaagttacgttttagacgttaagttttaacttacgttcgtacacgtactacgtcgttacgacgtaacgttcggtacgttacgggtaccggttaccgggaaccgtaaacggggtaaccgtaaacgggtaacggtaaacgttacgaaaacgtaacgtggtacggtanacggaccaccgtagttcgttacggttacttagaccgtttcccttccgtacc

SEQ ID NO: 109469 - DNA, 696 bp, Homo sapiens
  misc_feature: GYAE6OF01EVZBD.33.70.G04.1.454.CMB.1.raw
  modified_base (150)..(150): a, c, t, g, unknown or other
  misc_feature (150)..(150): n is a, c, g, or t
  modified_base (211)..(211): a, c, t, g, unknown or other
  misc_feature (211)..(211): n is a, c, g, or t
  modified_base (687)..(687): a, c, t, g, unknown or other
  misc_feature (687)..(687): n is a, c, g, or t
  modified_base (692)..(693): a, c, t, g, unknown or other
  misc_feature (692)..(693): n is a, c, g, or t
  modified_base (696)..(696): a, c, t, g, unknown or other
  misc_feature (696)..(696): n is a, c, g, or t
tcagtacacacactcacgaccggtgctcgatttagtgtagtgtgaagggaaagggggaggaactgctcagttaggacccagagggaaccatggaagccccagctcagcttctcttcctcctgcctactctggcctacccgaaggggaaanacgcccacccttctcctgcacgggccagtcagagtgttagccggtactagcctggaccaanagacgacctggccaggcctcccgagccttcctacttctatcgatcgacctactcccaacgacgggcccacgtggaccactcccgagcccgtaggttccgaggtcggacgtagggttcgggtcgtagggacctaggtacctttccaccgttcctaccaaccctaagttccgaagaccgtaacggtacccgttaaaggccgttaccgtaaggtaaacgttttacgtttttcgaacttttaaggtttttaacttacgtttcggtacctcgtacgtaaccggtacgttaacgaccgtaacgtaccggtaccctaaccgtacccgttaccggaccgaacgacgacgacgtaggaacgtaaacgtaacgtacgtgtacgtacgtagacctactctacgttcgtaccttaccgtacttccctaccctgtactacgtagtagtcgttgtacgtacgtcggacgtcggcgtagacggacgtcganagtcnncgn

SEQ ID NO: 109470 - DNA, 907 bp, Homo sapiens
  misc_feature: GYAE6OF01E4PH7.33.70.G04.1.454.CMB.1.raw
tcagtacacacactcacgaccggtgctcgatttagtgtagtgtgaaggggaaagggggaggaactgctcagttaggacccagagggaaccatggaagccccagctcagcttctcttcctcctgctactctggcctcccagactaccgaccggggtaattgtgtgacacagtcctccacgccctacccttgttcctttcgtcctaccggaagggggaaacgacgccctacccttcctcctggccgacgggccagtcaggtagtcgcgtgggcacgacctaaccgtttacggcccgttaacggtaaaccccaaaaaccgtaaaaaacccgtcgggaacccaaacggtaccccttaccccggaacggttccctaccctactaacttcgtaagtggtaactccgacctaccgtaaccccggaaccggaccgggtacccgtaaccggtacggaccctacccgtaccccggaccggttaccggttaacgggttaccgtacggggttacgggtaccgggttaacggggttcggggtaccggtacggggtaaccgttaaccggttacccttaccgtaacccttaccttaacccgaaacctacgtaccgaacgaccgtaccgtaccgtaacggtaccgtacgttaaggtttaacgttacttttacgtacgtttattttaacgtccgtcgtaccgtcgtacgacggttcgaacgtaccgtaacgtcccgggtaaccctaacccgggttacccggtaaccggtaccgggtaaacggacccgtaaacggtaacggttaacggtaaacgtttaaaaccgtaaaccgggtggttcggttaccggacccttaccggtaacccttaaccggttccttaacccggttcttacccgttcccgttacccgttccccggttaacccg

SEQ ID NO: 109471 - DNA, 739 bp, Homo sapiens
  misc_feature: GYAE6OF01CV3O3.33.70.G04.1.454.CMB.1.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (327)..(327): a, c, t, g, unknown or other
  misc_feature (327)..(327): n is a, c, g, or t
  modified_base (693)..(693): a, c, t, g, unknown or other
  misc_feature (693)..(693): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggcctcccagactaccgaaccggggaattgtgttgacacagtcctccagccctacctgttctttgcctacgaaggggaaancgcccaccctctcngcacgggccagtcagagtcgctggacagctaacttgcctaggtaaccaaactaaaaacgtcggaccaagaccctcccaaggtcctacctcattactaatgatnacactccaccgacggccacgtggctacctccgacgtaccgtacggtacaggtcggaccgtgggttcgggtacgtacggggtacaccgttaacctttcgaaccttaccacctaacctaataccgacgaaccgtcgtaaccgtaacgccgtaaccgttaagggtaaaccgtttagttttaccgtaaacttttaaacggttttaccgttttaacggtacgttaccggtagtaccggtacggttaaccgtaacggtaacccgtaacggtttaccgtaaaccccgtaaacccgtaccgggttacccggaaacgggtaacccgaacgtacgtaacgaagggtaaacgttaaacggtaaactaggtcggtacncgtaccactacctagtaccttactcttaccctccgttccctacccg

SEQ ID NO: 109472 - DNA, 655 bp, Homo sapiens
  misc_feature: GYAE6OF01BBQZN.33.70.G04.1.454.CMB.1.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
  modified_base (366)..(366): a, c, t, g, unknown or other
  misc_feature (366)..(366): n is a, c, g, or t
  modified_base (394)..(394): a, c, t, g, unknown or other
  misc_feature (394)..(394): n is a, c, g, or t
tcagtacacacactcacgaccggtgctcgatttagtgtagtgtgaagggaaagggggaggaactgctcagttaggacccagagggaaccatggaacgccccagctcagcttctcttcctcctgctactctggctcccagataccaccggggaattgtgttgacacagtctccagccaccctgtctttgtctccgagggaangcccacctctcctgcgacgggccagtcagagtgctggcagcaacttagccgtaggtaaccaaacaaaacctggaccagactcccgagctacctnatctatgatcgacactccgacgacgggccacgtggccaactcccagcctaggttcagtcggcaggtcggtntcgggacagtacttcacgtctacacctntacaggtacacgtacccgtagacgacctagtaacgttattttaggaccttaggtttaacttcgtagttcgtgacctggtaccgttacgaccgttaacgtccggtaacccttaacccgtaccgttacccgggaccgtaaacgggtccaccgtaacggtacggaacgtaaaccgttaaaacggtacggtcggtacggtaccgttacgaccgtaaaccttccttacgttacgttacccttactaaccgttcccccgtttacccg

SEQ ID NO: 109473 - DNA, 616 bp, Homo sapiens
  misc_feature: GYAE6OF01EF0U5.33.70.G04.1.454.CMB.1.raw
  modified_base (602)..(602): a, c, t, g, unknown or other
  misc_feature (602)..(602): n is a, c, g, or t
tcagtacacacactcacgaccggtgctcgatttagtgtagtgtgaagggaaagggggagtcagtctcagtcaggacacagcatggacatgagggtccccgctcagctcctggggctcctgctcctctggctccgaggtgccagatgtgacgtcagatcgacccagtctccatcctcctgtcttcatctgtaggagacagagtcaccatcacttggccggcaagtgagagctattacgaaccttatttgaattggtatcagcagacgaccgaggaacgacccccaactccgtagctctctcgccgactactacgtaactttaccaacgtaacgtcggggtacccagtacggtacggttcgtacgggtggacgtaggtacggtagtcgtcggggactagtacttcacttctacactataagcattcgagtaacgtagagttagttaggaatacttacttagtactacgtaacacgttaacttaagtaaccgttaacccgttacgttaccggttttaccggaacggtacgggtaaccaggtccgtaggacgtaagtacgaacggtacggtaaggttcggacggtccgtacgccgtaactacgttnttcgttcttacccg

SEQ ID NO: 109474 - DNA, 678 bp, Homo sapiens
  misc_feature: GYAE6OF01CZE8Z.33.70.G04.1.454.CMB.1.raw
  modified_base (220)..(220): a, c, t, g, unknown or other
  misc_feature (220)..(220): n is a, c, g, or t
  modified_base (458)..(458): a, c, t, g, unknown or other
  misc_feature (458)..(458): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagactaccgaccggggaattgtgttgacacagtctccagccacccttgtctttgtctaccgaggggaaagcgcccaccctctccngcgacgggccagtcagagtgctggcagacaacttgcctaggtaaccaaacgaaaaccgtggaccaagacctccgaggtcctcctacatctatgatcgcactaccgaccgacgggccacgtcggaccactcccgacgaccgaggttcgacggtcggacgtaggtcggtacgtcgggaactagtacttcgactctaccaactactacgagcacgtcgtaacgacgtcgtaagtaacgttnttttacggactttaaggttttactacttcggtctcgacgtagacgtacgaccgtacgttacgtaacccgttaaccgtcccggttaccgggaccgtaaaccgggtaccgacggttaaccgtaggggtaaacttaaacggttaaaaccggtacgttacggttaccggacttacggacctaccttacgttctacggttcctttaacgcctttccgttaccccg

SEQ ID NO: 109475 - DNA, 713 bp, Homo sapiens
  misc_feature: GYAE6OF01A0VO8.33.70.G04.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagactaccaccggggaaattcgtgttgacacagtctccagccaccctgtctttgctccgagggaanagccacctcncctgcagggccagtcagagtgctggcagcaacttancctaggtaaccaaacaaaaaccgtggaccacgtactcccaaggctcctcatctatgatcgcactacccaccaggccacgtggcactcccagccgaggttacaggtcggcgtaggtgggtcgtacgggacacgtaccttccactctaccgtacctactccgacgacgacgtaccctaaggtacgtcccgtaagaaagttgttttacggcttaaggttttttaacttacgttcgtaccgtagtcgtaaggttccgaaggaccttaaacgttccggtaacccttaaacccgttaccccggtttccgggaaacccggtaaacggggtaacccaaccgggtaaccggtaagggtaacggttaaaacccgttaaaacggtacggttcggtacgggttctaccgggaaccctaccggttacttaccggttacgtttaccttaacccgtacgtttccccccggttaacccggg

SEQ ID NO: 109476 - DNA, 767 bp, Homo sapiens
  misc_feature: GYAE6OF01E2631.33.70.G04.1.454.CMB.1.raw
  modified_base (299)..(299): a, c, t, g, unknown or other
  misc_feature (299)..(299): n is a, c, g, or t
tcagtacacacactcacgaccggtgctcgatttagtgtagtgtgaagggaaaggggggaggaactgctcagttaggacccagagggaaccatggaagccccgggctcagcttctcttcctcctgctactctggctcccagataccaccggggaattgtgttgacacagtctccagccaccctgtctttgctcagggaagagcaccctctcctgcagggccagtcagagtgctggcagcaacttagcctggtaccagcagacacctggccaggctcccgaggcctcctcactccatggtncgactcccgaaccgacgggcccacgtcggcctaactccccaggccctaggttcgacggtggacgtaggtcgggtcgtaggggaactacggtacctttacacgttccctaccgaaccgtataccggaagcccgtaacggacccgtaaacggaccgtacccgttaagggtaaacggtttagtttttacggacgtttaaggttttaaccgtttaaccgttcggttaaccgaacgtaccgtaacggtacccggttaagaccgttaacggtttacggttaccgggttacgggttaacccggtttaccgggaaccccgggttaacggggaaacccggttaaggggttaaaccgggtaaaccgttaaaccggttaaaacccggtaacggttaacggtagggtacccggtcgacccgtaacccggtacggttccgttaccgtttacctttaaccgtccgttccccgttaaccccgg

SEQ ID NO: 109477 - DNA, 750 bp, Homo sapiens
  misc_feature: GYAE6OF01DZFW2.33.70.G04.1.454.CMB.1.raw
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
  modified_base (318)..(318): a, c, t, g, unknown or other
  misc_feature (318)..(318): n is a, c, g, or t
tcagtacacacactcacgaccggtgctcgatttagtgtagtgtgaagggaaagggggaggaactgctcagttaggaccagagggaaccatggaagccccagctcagcttctcttcctcctgctactctggctcccagactaccgaccggggaattgtcgttgacacagtctccagccacctgttctttgctcgaggggaaanacgcccacctctctgcgacggccagtcagngtgcgtggcagctaactcgccgtacggtaaccaaacaaaacgtcggaccaacgacctccgacggtcctacctactacttctaagtntacttcgactacctaccgaaccggacggccctacgcgacctacctcccgacgtaccgtaggttaccgaggtcggtaccgtagggtcgggtacgtacggggactacgttactaacctcctacgtacccgtaactacgtacgacgaccgtacgtaaccgtagtaccgtaccgttaggttaaactttgtttaacgaacgttttagttttactaccggttgtaccgtggactaacgggtcttaacgacccggttacggtaacccggttaccctttaaaacccggtccggtttaacgggaaccgtaaacggggtacccgtaaggtaaccgggttaacgggtaaaacttaaccggttaaaccggtagtcgggtacggtcttaacgaacccgttaccacgttcttaacgtttctaccgttaccgttcccgtaaccccgg

SEQ ID NO: 109478 - DNA, 751 bp, Homo sapiens
  misc_feature: GYAE6OF01CUFAK.33.70.G04.1.454.CMB.1.raw
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
tcagtacacacactcacgaccggtgctcgatttagtgtagtgtgaagggaaagggggaggaactgctcagttaggaccagagggaaccatggaagccccagctcagcttctcttcctcctgctactctggctccagataccaaccggggaattgtgttgacacagtctccagccaccctgtctttgtctccgaggggaaanacgccaccctctcctgcagggccagtcagagtgctggcagcaacttagcctaggaaccaaacaaaactggccagactccagctccncatcatgactgctactccacgacgggcctaacgtcggacacgtaccccgagacctaggttacctaggtcggcgtaggttcgggtcgttacggggactaacgacctttacgacccttaccaccgaaacccgtaacttaccgaacgaccgtacggtaacccgttaacggtacggtaaccccgtttaagtaaacgttaacgttttttccggaacctttaaagggttttttactttaccgtttagttaccgttacggtaccttaagggtaccggttaacggtaaccgttaaacggttccggtaacccttaaacccgttaaccccggtttaccggaaaccggttaaacggaacccgtacggtaaccggtaaagggtaacgtaaaccgttaaaacggtaaccgttggtacggtcgtaccgtaccaacgttacttacgtacgttaccgttactacttcccgttaacccccg

SEQ ID NO: 109479 - DNA, 878 bp, Homo sapiens
  misc_feature: GYAE6OF01BCLOP.33.70.G04.1.454.CMB.1.raw
  modified_base (165)..(165): a, c, t, g, unknown or other
  misc_feature (165)..(165): n is a, c, g, or t
tcagtacacacactcacgaccggtgctcgattttagtgtagtgtgaagggaaagggggaggaactgctcagttaggacccagagggaaccatggaacgccccagctcagtcttctcttcctcctgctactctggctccagataccgacgggtaattgtgttgacncagtcctccacgccctaccttgttcctttcgtactaccggaagggggaaaacgtacgacccctaccccttccttcccgtcggaccgacggggccctagttaccgaaggacggtcgtcgtggccacgtacctaaccgtttcggccgttaaccggtaaacccaaaaaccgtaaaaccgtcggaacccaacgtacccttacccgacgttcccttacccgttactactttactacttacgaccttcggaacctaacccgtaccccgaacccggaaccggggtaccctagggttaccccgacctaacccgttaccccgaacggttacccgttaacgggttccggaacggttcgggaaccggttacgggggttcgggttaaccgtacggggtaaaccctacgggtaacccctttccgtacctacccgttaccgaacccttgtacccgaggacccgtaacggtccgtacggtaccgttaccgttaaggtaaccttttagtttacgacggtttaacttttacttacgttacgtcgtacgtcgtagtaccgtacgtaacccgtaccgttacccgggtaacccttaaccggtcccgggttaaacggtaaccgacgggttaacccaaggttaacgtacggttaacgaaaacgtttacggaacgttcggaccttacgcgtaccacgtttcttacgttacctccgtaacccttcgtcccgttaccc

SEQ ID NO: 109480 - DNA, 760 bp, Homo sapiens
  misc_feature: GYAE6OF01BA4IO.33.70.G04.1.454.CMB.1.raw
  modified_base (214)..(214): a, c, t, g, unknown or other
  misc_feature (214)..(214): n is a, c, g, or t
  modified_base (422)..(422): a, c, t, g, unknown or other
  misc_feature (422)..(422): n is a, c, g, or t
tcagtacacacactcacgaccggtgctcgatttagtgtagtgtgaagggaaagggggaggaactgctcagttaggaccagagggaaccatggaagccccagctcagcttctcttcctctcgctactctggctcccagataccgaccggggaattgtgttgacacagtctccagccaccctgtctttgtctcgaggggaagacgccacctctccngacgacgggccagtcagtagtgctagacgatacgaactttgccgtacggaaaccctaaaacggtaaaaaccctggaccaacggtaacctacccgtacgggaccttccctacgtaattactaacttacggtcttacggacctaactccctaaccggaccggtaccacggttacggacctactaccccgacggtaccgtaaggttaccgngggtacgaccgtaaggttcgggtacgttacggggacaacggttactactaacccgtctcccgaaacctacgtaccaacggtactaacggtacctacgggtaacgtcccgtaagtaaacggtttacggtttttacggtttaaggtttaacctttacgttcgttacgttgtaaccggtacgtcggtaaacctaccggtaacgtccggtaacccttaaaccgccggttaaccgggtaaccgtaacggaaccgttacgaggtaacgtaggttaaaccgaacgtaagtgggtacgtacgtacaccgttaccgtgaccgttatcctagttcttccccgtcgtac

SEQ ID NO: 109481 - DNA, 1008 bp, Homo sapiens
  misc_feature: GYAE6OF01B1HY5.33.70.G04.1.454.CMB.1.raw
  modified_base (464)..(464): a, c, t, g, unknown or other
  misc_feature (464)..(464): n is a, c, g, or t
tcagtacacacactcacgaccggtgctcgatttagtgtagtgtgaagggaaagggggaggaactgctcagttaggacccagagggaccatggaagcccagctcagcttctcttcctctgctactctggctcccagataccgaccggggaaattgtgttgacacagtctccagccaccctgttcctttgtcctccgaagggggaaagacgcccaacccttctcccgtagccgacggggacctaaatccaagggaagttcgttaacgacgtaagttaaaaccgtttaggttcctagggtaaacccaaaactattaacggacctacgaaccgaacggcctacccgaggacccttacctacactaccgttaaccggagtcggtaccgtaacccgtaaacgaaccggggacccaaaccgttcggaaccaactacccccgaaggaccccgtaagggttttacctaagggnggtacccgtaggtttcgggggtccgttagggggaacctaaacggggtaccctttacgtaaacccgttacctaacccgtaaccctaaacttaccgaacggtaaaccctaaaacccgttaaacggtaaaacctttacggtaaaagtttaaccttttttttaagttaacgttttttttaaacttttaacccgttaacggtttaacccaaaacgttaaaccgttacccgttaacggggaacccttaaacgggtcccttaccggggttacccctttacccgttaaccggtttaaacccggtttttccggggggtaaaccccggggaaggggggttaaaaccccccgggtaaaggggtttaacccggggaaacggtttaacccccgtaaacggttaaaaaaccccgggaaggttttaaccggtcgggtaaccccgtaacgggtaaccccggtaaaccttaaccgttttacggacccgttttacgttttaacccacccggtttttaccccgtaaccccccgttacctttaaccgtttacccggttaagggg

SEQ ID NO: 109482 - DNA, 741 bp, Homo sapiens
  misc_feature: GYAE6OF01A6TVG.33.70.G04.1.454.CMB.1.raw
  modified_base (201)..(201): a, c, t, g, unknown or other
  misc_feature (201)..(201): n is a, c, g, or t
  modified_base (203)..(203): a, c, t, g, unknown or other
  misc_feature (203)..(203): n is a, c, g, or t
  modified_base (731)..(731): a, c, t, g, unknown or other
  misc_feature (731)..(731): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctgctccagataccgacgggtaattgtgtgacacagtcctccagcccaccttgttctttgcctcgaaggggaancnccaccctctcctagcgacgggccagtcaaggtacgtgcgtcggacaggtacctaacgtttacgccgtacggtaaaaccaaaacctaaaaaccggtcggacccaacgtaccgtaccccgaggtccttacctactacttcgtacgtgtaatcgacctaccgtacccgaaccggacggaccctacgtaccggacaccctcccgacgtaccgtacggttacgacggtcggaccgtaggggttcggtcgtaacggggaactaacgtccgttactaccgtccctaaccgaaccttcgtacgaccgcgaacccgtcgtaagaaccgtccgttaagtaacggtttgtttacgtaacgttttaagttttactaccgtttcgtcggtacgtacgacggttacgaacgtacccgttaaagtcccggtaaaccttaacccggttcccgtaaccggtacgtaaacgggaacctcggaacgtacgtaacgttaacgtaaacgtgtcggtacgtcgtacgctacgtacctgttactacgtccncgttccgtcc

SEQ ID NO: 109483 - DNA, 709 bp, Homo sapiens
  misc_feature: GYAE6OF01DDH77.33.70.G04.1.454.CMB.1.raw
  modified_base (200)..(200): a, c, t, g, unknown or other
  misc_feature (200)..(200): n is a, c, g, or t
tcagtacacacactcacgaccggtgctcgatttagtgtagtgtgaagggaaagggggaggaactgctcagttaggaccagagggaaccatggaagcccagctcagcttctcttcctcctgctactctggctccagataccgaccggggaattgtgttgacacgagtctccagcccacctgttctttgctccgagggaaancgccaccctctccgtgcgacgggccagtcagagtgctggcagctaacttcgcgtacgtaaccaacgaaaacctcgaccaagacctccgaggtcctacctactaactcgtaatcggtatcggactactccgaaccgacgggtcccacgtcggacacgtaccccgagaccgtacggttaccgaaggtcgtacgtaggttcggggtacgtaggggactacgtacgtttcaccgttacctccgtaacctaacttcgaacgtcgtacgtccgttacgacccgttaaacttagtaaacgttagtttacgtaccgtttaaactttccgttacgtaactacccgtaaaacgttacttaaccggtttaactaacttacccgttaccgttaacgttacccgtttacggaaccgttacgggtaacctacgtacggttacgacggtacgtaccgtacgggtacgtacgtacggtgacgtcggacctacgcttccgttacgttctacttcgttcccgtaccg

SEQ ID NO: 109484 - DNA, 833 bp, Homo sapiens
  misc_feature: GYAE6OF01EHR1J.33.70.G04.1.454.CMB.1.raw
  modified_base (204)..(204): a, c, t, g, unknown or other
  misc_feature (204)..(204): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagactaccgaccggggaaattgtgttgacacagtctccagccaccctgttctttgtctccgagggaancgccaccctctcctgcgacggccagtcgagagtcgctggcagacctaacgttacgccgttaggtaaaccaaactaaaaaccgtggacccagacctcccaggcctcctcattcgtatgactcgctactacccgacccgacgggcctaacgtcggacctacgtaccccgaacggtacccgtacgggtttcgaacgggtcggaccggtaagggttcggggttaccggtaggggtaaccgtacggtaacctttaccgtaactttccgtaaccctaacccgtactaccgtaacggacctaacggtaccgtagggtaaccgtcccgttaagggtaaacgttttacgttttacggacggtttaacggtttaacgtttacgtttacggtttacgtacgtacgttaaccggttaacgggtttaaccggtttagtttaccgtcgttaacccgttaccgggttaacccgggttaccggaaccccgggtaaacgggaacggttaacggggtaaacgtaaaaccgtaccgaaaaaccgggttaaccgttcggggtaccaacggttacctacccggtacttaaccggtttaccgttacgttaccgtttacccttcccggtttccccgttaccccggtaacccg

SEQ ID NO: 109485 - DNA, 692 bp, Homo sapiens
  misc_feature: GYAE6OF01C0UH3.33.70.G04.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
  modified_base (685)..(685): a, c, t, g, unknown or other
  misc_feature (685)..(685): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaattgtgttgacacagtctccagccacctgtctttgtctcgaggggaaangcccaccctctcctgcaggccagtcagactgttagcagcgcttctagcctgaccagcaacgaacctggccaggcctccgaggtcctcctcctctagtggtnctactcccgaccgacgggcccacgtcgggacctaccgtccccgaaggacgtacgggttaccgagggttcggaccgtgggttcggggtaccgtgggggaaccaggttactttccgaccttcccgtaccgaaccctacgtaccgaactacggtacgtagggaccgtccgtaggtaagttcgtttacgacttaggttacttagtttacgtcgtacgtagactaaggtttagtcggtaggggtacgttaaccgggttccggaaccggtaaggggaacggtaacgggttaggaaaccgtaccgtaaacgggtacgttgggacggtacgtcgaccgtacgttacttcgttcttaccttccgtaacgttccccttacccgacttcggttntaacggg

SEQ ID NO: 109486 - DNA, 766 bp, Homo sapiens
  misc_feature: GYAE6OF01EMVJ3.33.70.G04.1.454.CMB.1.raw
  modified_base (210)..(210): a, c, t, g, unknown or other
  misc_feature (210)..(210): n is a, c, g, or t
tcagtacacacactcacgaccggtgctcgatttagtgtagtgtgaagggaaagggggaggaactgctcagttaggacccagagggaaccatggaagccccagctcagcttctcttcctcctgtctactctcggctcccagactaaccgaccggggaaattgtgtgacacagtctccagcccacctgttctttgtcctacgaaggggaaanacgcctaccctctcctggcgacgggccagtcagtaggtcgcgtggcagtacctaacgtacgcctacggtaacccaaaacaaaaccgtggaccacgtacctcccgacgtcctacctctacttctatgtactcgacctacgtacccgacggacgggcctagtcgctacgtacccgagtccgtacggtcacggtggtacgtacgggttcgggtacgtacgggactaagtacttccgtacctcctaaccgacctaactacgtaccgtcaaccgtacgtaacgacgtacgtaagttaagtttacgtttacgtacgttttacggttttaactttacgttcggtttacctacggttaccgtaaccggtacgtttaacggtaccgtaaccgtacccggttaaaccctttaacccggtacccgggtttaccggaaccgggtaaaccgggaacctaccgggtaacggtaagggaaccttaaacggttaaacgtcggttaaggtacgcggtaacccgactaccgttacgttcccttcttaacctttccgtaacccttccggttaccc

SEQ ID NO: 109487 - DNA, 693 bp, Homo sapiens
  misc_feature: GYAE6OF01AFOQC.33.70.G04.1.454.CMB.1.raw
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggtaaattgtgttgacacagtctccagcccacctgtcttgtctccgagggaanacgccaccctctcctgcgcggccagtcagngtgcgtggacagctaacttcgccgtacggtaaccaaaaccaaaaccgtgacccaagaccctaccgacgtccgtacctactacgtactacgtagtactacgacctaccgtcccgaaccggaccgggtaccacggttacggacctaaccgtccgacgtaccgtaggttacgaggtcggtcggtacggtcggtacggacggacgtacggtccttaccacgtcctaccgacctactacgacgctaaccgtcgtaacgcgtaccgtagtaagtttactttgacttagtttaacgtacgtcgttacgagtacgactacggtactacgtaacgtcgtaaccctaacggtaccgtaccggaacggtacgaacgtaccgaaggtcggaacgttaaaccgtaacggtgttcgggtaccgatcccgtacctacgtgtttccgtagttacctccgttaccgtccccgttaacg

SEQ ID NO: 109488 - DNA, 783 bp, Homo sapiens
  misc_feature: GYAE6OF01B3AQ3.33.70.G04.1.454.CMB.1.raw
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
tcagtacacacactcacgaccggtgctcgatttagtgtagtgtgaagggaaagggggaggaactgctcagttaggacccagagggaaccatggaagccccagctcagcttcctcttcctcctgctactctggcctcccagataccgaccggggtaattgtgttgacacagtctccagcccacctgttctttgcctcgagggaancgcccacctctctgacgaggccagtcaggagtcgctggacanactaacgttacgcctacggtaaccaaaacgaaaaccgtggaccacgtacctcccgagcctcctcatctagtgatcgactacgtcccgaccgacggccacgtcggacctacctaccccgacgtaccgtaaggtctagggtcggaccggtagggttacgggttacgtacggggaactaccggtttaaccttcccgtaaccgttccgtaacccgtaacctacgtccgaacggtccggtaacgtaccggtaacggaccggtacgttaaggtaaacgtttcgtttacgtaacgttttacgtttttaacttaccgttcgtttacgtacgggccgtaacggtccgttaacgaccgtacgggttcccgtaaaccgttacccggttaccgtccgggaaaccgtaacggacccggtaacgtacgggttaacggtaaacgttaaaaccggtaaaccggttagggtcgttaccggaaccgttccgacccttaaaccgtcgtttaccgttaccgttaccgtttacccgtaccgtttcccccggtaacccg

SEQ ID NO: 109489 - DNA, 840 bp, Homo sapiens
  misc_feature: GYAE6OF01CWRD6.33.70.G04.1.454.CMB.1.raw
tcagtacacacactcacgaccggtgctcgatttagtgtagtgtgaagggaaagggggaggaactgctcagttaggacccagagggaaccatggaacgccccagctcagcttctcttcctcctgctactctggctcccagataccgacgggaattgtgtgacacagtcctccacgccctacccttgttcctttgtcctaccggaaggggaaacgacgacccacccgtcctcccgtcgacgacggccagtcgaaggacgtcgcgtggacgacgacctaacgttcgacccgtaacggtaaccaaaaccgtaaaaccgtcggacccaacgtacccgtacccgaacggtcctcctactactaccgtatacggactcgaccgtactacccgaccggaccggacctacggtacgaccctaaccgtacccgaacggtaccgttaaggtaccggtacgggtacgtacggtaaccggggtttcgggtaccggttaacggggaaccgttaccggttaaccctttaccggaccctttacccgaccgtaaaccctaacgtaaccgtaaacggaacccttaaaccggttaacgtaaacgtttaaggtttaaacttttaccgttttttaacttaattttttaaaccgtagttaaccgttaaactaaccggtacttaccggaccggtagtacgtccgtagtacccttcgtaccgtacggtccgggaacgttacggaacgtgggtacacggtacctaacggaaactcggttaaggccgttacgaccgtaccgttccgtacgttaccggtttaccgtccctttacgtacccgtttacccccgtcctaccgttaacggg

SEQ ID NO: 109490 - DNA, 731 bp, Homo sapiens
  misc_feature: GYAE6OF01CQD0S.33.70.G04.1.454.CMB.1.raw
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (576)..(576): a, c, t, g, unknown or other
  misc_feature (576)..(576): n is a, c, g, or t
  modified_base (696)..(696): a, c, t, g, unknown or other
  misc_feature (696)..(696): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagactaccgaccggggtaaattgtgttgacactagtcctaccacgcccacccttgttcttttgtcctccgaagggggaaanacgcccacctctccngcgagggccaggtcaggagtgcgtggacagccaactttacggcctacggtaaaccaaacgaaaaaccgttcggaccaacgtaccctacccgaggtccttcctactactacctagtgactcggtccaacctcccgaccgacgggtcccaacgttcggaccaccgtaccccgacggtaccgtacggttacgaaggttcgaccggtgggttacgggttcgacggggaacctacggtacctttaccgacctttacccgactaaccctagttaccgaccgacgtaccggaaccgtacgggtaccgaccggttaagttaagttacgttttacgtaacttttaacggtttnttacccgtgtcgtacgcgtacgtagtacgtacctaacgttccgtaacctaccggtacccgtcggaacgacgtaccgcgtaagacggaataacgttagtagtccggtatacgactaaccgntaccgttctactttcgaacctcgttcccgtacccg

SEQ ID NO: 109491 - DNA, 745 bp, Homo sapiens
  misc_feature: GYAE6OF01BBOI6.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaaattgtgttgacacagtctccagccaccctgtctttgtctccgaggggaangccacctctcctgcagggccagtcagagtgctggcagctaacttgcctaggtaccaaacaaaacctggaccagacctccaggcctcctcattcctatcgatgacactacccacgacgggccacgtggccacgtcccagccgaggttcaggtggcgtaggtgggtcgtgggaactaggtacttcgacttctaccacgtactacagcctacgccttaggaccgtactacggtaagttacgttttacgacgtttacgtttttaattccgtcggtttacgcgtacgtacggcgttaagaccgtaaccggtttcggaacccctttaacccgtacccgggtttaccgggaaacccggaacggggtaaccccgtaacggtacggttacgggggtaaacccttaaaacggtttaaaaaccccgggacggttcgggttaaccggggtccttacccggggtaaaccctttaaccccgttccgtttttaccggtacccggttttttacccctttaccccttaaacccggttttcccccggtttaaacccccgg

SEQ ID NO: 109492 - DNA, 816 bp, Homo sapiens
  misc_feature: GYAE6OF01DZ4RC.33.70.G04.1.454.CMB.1.raw
tcagtacacacactcacgaccggtgctcgatttagtgtagtgtgaagggaaaggggaggaactgctcagttaggacccagacgggaaccagtggaacgccccggctcagcttctcttcctctgctactctgctccagataccaccgggaattgtcgttgacacagtctccgagccacccttgttctttgtcctccgaaggggaacacgccacccttctcctggcgaggccagtcagtagtcgtcctgacacgacctaacttacgcctacggtaaaccaaacgtaaaaccgtgacccgtaagacctccgaggtcctctacacttacctagttacgacttcgacctaacgtacccgaccggttacgggaccctacggacggacctacgttaccccaggtacccgtaagggtttaccgaaggtcggtacgtagggtttccgggacggtacggtactacggttacctttaccggaactttcccggaaccacgttacgaacgtacgtaggaaccgttaccccgtaaggtaaccttcccggttaagtaacggtttagtttacgttacgtttaacgttttagtttaccgtcgtttaccgttaggacctacggtacgtaacgtaaccttacgtacggtaacccttaaccgtaccggtttaccggaaccgttaacggaccggtaacggtactaaacgggaacttaaaccgttaaaccggtaacgttacggttaccggacctttaaccggacccttaaacccggttacttacccggttcccttaaacgtttaccctttaacccggttccccttaaccgtaccccgg

SEQ ID NO: 109493 - DNA, 741 bp, Homo sapiens
  misc_feature: GYAE6OF01BUB3J.33.70.G04.1.454.CMB.1.raw
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (340)..(340): a, c, t, g, unknown or other
  misc_feature (340)..(340): n is a, c, g, or t
  modified_base (699)..(699): a, c, t, g, unknown or other
  misc_feature (699)..(699): n is a, c, g, or t
tcagtacacacactcacgaccggtgctcgatttagtgtagtgtgaaggggaaagggggaggaactgctcagttaggacccagagggaaccatggaacgccccagctcagcttctcttcctcctgctactctggctcccagataccgacggggaattgtgttgacacagtcctcagcccacctgtcttgtctccgaggggtaaanacgccaccctcncctgcgacggcagtcagagtgcgagcagtaccaatgacccgtaggaaacccaaaagtaaaacctggaccaacggacctacccgaggtacctcctactatacggtaatcgaattcgacttaaccncccgaacccggaccggtaccacggttaccggacctaaccgtacccctaacgggcccgtttaaaggtcccggtaaggtccggggtaacgtaaccgggtggggtttaacccacgggggtaaacccgtataacccggtttaccctaactacccttcccgaaacgtacctaacgcccgaacgtacgtaccgaacggtacaccgttagaaactttgttacgtattacgtttatacgtgttaccgtgaccgtaggtcctaaggtaccctaagtaccctacgtaacgtccggtacggtaacgacgaaccgtagaaccgttagggaacttaaacggaaacgtccggttagtacggacgtacggaccncgttaacgtcttagtacctaacgttcccttacccgtaacccg

SEQ ID NO: 109494 - DNA, 617 bp, Homo sapiens
  misc_feature: GYAE6OF01EY26L.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgttctttgtctccaagggggaaaaagccaccctctcatgcagggccagtcagagtattagcatcttcttggcctggtacaacagaaacctgccaggctcccaggctcctcatccagaatgacattacaaacgagggccacgtggccactccccgaagcccgtaaggttccaggtcgggacaggtcgggtcgtggggactagactttcactctcaaccatcagacacgctaagcgcctaggagtattctgctagtttactactgacagcagtcgtctacaacgtcggccctccggtctacgtacccgttacggaccgtaaacgggacctaaccggtagttacgggtaacgttaagtttaacgggaaccggtaaacgttgggttaccggacgttaccggacccttacccctttacgttcggtttccttccgtaacccg

SEQ ID NO: 109495 - DNA, 741 bp, Homo sapiens
  misc_feature: GYAE6OF01BXZ21.33.70.G04.1.454.CMB.1.raw
  modified_base (165)..(165): a, c, t, g, unknown or other
  misc_feature (165)..(165): n is a, c, g, or t
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (343)..(343): a, c, t, g, unknown or other
  misc_feature (343)..(343): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggcctcccagataccaccggggaattgtgttgacgnagtctcgaggcacctgtctttgtctcgagggaancgccacctctcctgcaggccaatcagagtntagntagtattagcgtgacacatacgctgacagcctccngctcctcatactagngtcgcgtacaacgcggccacgtgctactccgagcctaggtccaggtgctaggtcggtacngggaactggtaccttacgcgtacctccgaactacgtaacgacgtaaccctaaacgtaagttaaccgtttaggtaacttttaacttttttaccttaagttttttaaccgtttacgttaacgttactaaaaccgtcgtttacccggaacggttaccctacggtacccgttcccggttactttacccgttaaccgttccggtttaccggggaaccgggtacgggtaacccttaacggggtaacggtaccgtacgtaaaccggaaaaaccgttcggtacggttaggtaacccgtaccggtaacctacccgtaaaggttttcccgttcggtttaccccgtaaccggttttacccctttaccccggggtttaccccaaccgtttccgttaccggtttaacgggg

SEQ ID NO: 109496 - DNA, 855 bp, Homo sapiens
  misc_feature: GYAE6OF01D7UPZ.33.70.G04.1.454.CMB.1.raw
  modified_base (149)..(149): a, c, t, g, unknown or other
  misc_feature (149)..(149): n is a, c, g, or t
  modified_base (849)..(849): a, c, t, g, unknown or other
  misc_feature (849)..(849): n is a, c, g, or t
  modified_base (851)..(851): a, c, t, g, unknown or other
  misc_feature (851)..(851): n is a, c, g, or t
  modified_base (854)..(855): a, c, t, g, unknown or other
  misc_feature (854)..(855): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccgaagggggaaagngcccaccctctcctgcagggccagtcagagtgtagcgggtactagcctggtaccaacagacgacctggccaggcctcccgaggcctcctcttctatgatgcctagtaccgaaacgacgggtcccaacgtcggaccacctcccgaacgtccgtaggttccgagggtcggggcggggttcgggtcgtaggggaacctaggttacctttccaccttccgtaccaacctataccgacgacctacgacccgttaaggaccgtaccgtagggtaaacgtttacgtttttacggacgttaaggtttacgtttaacgtttaccgtttcgggtaaccgtaacggtaccggttaaagggtttaaccgggttagtttaccctaacggttttccccggttaacccgggttaacccgggtttacccgggaacccggggtaaaccggggtaaaccccgggtaaaggggttaaacggtaaaaacgttaaaccggtaaaaccggttaacggttacgggttaggtacccgtacggtaccctaaccgttaacgtttccgttaccgtttactttaccttaccctttaccccgttaccccgtacctttaaccgttcggttaacggtttacgttgggttaacggttcggttaacggtcggggtaacggggtcccggggtaggttacgggtaccgggaacggtaccggtacgtaagtacggntntgnn

SEQ ID NO: 109497 - DNA, 796 bp, Homo sapiens
  misc_feature: GYAE6OF01AZAFK.33.70.G04.1.454.CMB.1.raw
tcagtacacacactcacgaccggtgctcgatttagtgtagtgtgaagggaaagggggaggaactgctcagttaggacccagagggaaccatggaacgccccagctcagcttctcttcctcctgctactctggctcccagactaccgaccggggaaattgtgttgacgcagtctccaggcacctgtctttgtctccgaggggacagacgcccaccctctccgtgcgacgggtccagtcagtactgttagcagcggtcttcgtacgccgtaggtaccagacaacgaaaccgtggaccgacggccctcccgagtccttcctccgtctaagtcgggtacgcctaacgtcccgaaccgacggggaccctaccggtcggaccctacgtacccgaacgtaccgtaacggttccgaagggtcggacgtaggggttcgggtacggttacgggaacctacggtaccttacgaaccttcctaccaccgtacgtaccggaactacggtaccgtacgggaacctccgtaagggtaaacgtttacgttttacggaccgttaagtttacgttaacgtttacgtacggttacctaacggtcgtaaggtttaacgtacgggttaacgggggtaaccgttaccgggttaccgggtaaaccgggtaaacggggtaacccgtaaaggggttaacggtaaaaccgttaaccggtaaaaccggttacggtacggttacgggaccgtacgaccgttaacgtacgttccgttacgttaccgtacctacgtttaccccgtaccccgtacgttacgtaccgg

SEQ ID NO: 109498 - DNA, 718 bp, Homo sapiens
  misc_feature: GYAE6OF01C4KIS.33.70.G04.1.454.CMB.1.raw
  modified_base (154)..(154): a, c, t, g, unknown or other
  misc_feature (154)..(154): n is a, c, g, or t
  modified_base (165)..(165): a, c, t, g, unknown or other
  misc_feature (165)..(165): n is a, c, g, or t
  modified_base (181)..(181): a, c, t, g, unknown or other
  misc_feature (181)..(181): n is a, c, g, or t
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
  modified_base (319)..(319): a, c, t, g, unknown or other
  misc_feature (319)..(319): n is a, c, g, or t
  modified_base (451)..(451): a, c, t, g, unknown or other
  misc_feature (451)..(451): n is a, c, g, or t
tcagtacacacactcacgaccggtgctcgatttagtgtagtgtgaagggaaagggggaggaactgctcagtaggaccagagggaacatggaagcccagctcagtcttctcttcctctgctactctggcctccagactaccgacgggtaattgtntgacacagtcnccagccacctgtcttnctcgaagggaanacgccacctctcngcgacggccagtcagagtgctggcagactaaacttcgacgtacggtaaaaccaaaaccgtaaaaccgcggaacctacggacctacccgaacggtcctccgtactactcgtaangtaactcgaacaactccgaacgaccgcctacgcggacctacgtaccccgaatccgtaggttacgaacggcgacggttaagggtcgggtaacgtacggaacaacgtactaccggacttaccgtaacacctacncgaacggtacgtactaccgacgtaacgtaccgtaagtaagttaacttttacggacgtttaagtttacgtaccgtgttaccgtacggactccggtaacggactaaccgtaccggtaccgtaaccctaccggtaaccgtacggaaaccgggacgttaaaccgacggtaaactaacgggtaagtaaaaccttaaaccggaggtttccggacggtactcgggaacctacccgttacgttcacggtttaccaggttacccctcccttaaccg

SEQ ID NO: 109499 - DNA, 763 bp, Homo sapiens
  misc_feature: GYAE6OF01BKDUN.33.70.G04.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (325)..(325): a, c, t, g, unknown or other
  misc_feature (325)..(325): n is a, c, g, or t
tcagtacacacactcacgaccggtgctcgatttagtgtagtgtgaagggaaagggggaggaactgctcagttaggacccagagggaaccatggaagcccagctcagcttctcttcctcctgctactcgtggctcccaggataccaccggggtaaatttgtgttgacacagtctccagccacctgtctttgtctcaggggaanacgtcccacctctcctgcacgggcctagcagagtncgtggcagtaccaacttagccgtagtaaaccaaactaaaaaccgtggacccacgacctacccgaaggcctaccctcacttcgtagtanactacgctaacttcccgaacgaaccgggccaacgtcggacctaacccccgtaagccgttacggttacacggtggaccgtaggtccgggttagacggggtactaacggtaacgtttccaaccgtaccgttaccgaaccttatacccgagtacgaaccgttacgaccgttaaccgacgttaaggtaacggttactttttagggaccttttaaacgggttttaatttaacgggttacgttccgtttacgtaacgtcggacgtttacgaacccgtacggtttccgaacccgtttaaccccggtagtttaacccgggaaaccttaaacgggacccgttagaacccgggtttagaacggtaaaaccgtttagtaacgtacgtagggtacccaacggaccttaccgtaacttccttcgtaactttccgtactaccccgttcccgg

SEQ ID NO: 109500 - DNA, 655 bp, Homo sapiens
  misc_feature: GYAE6OF01EZ1QV.33.70.G04.1.454.CMB.1.raw
  modified_base (206)..(206): a, c, t, g, unknown or other
  misc_feature (206)..(206): n is a, c, g, or t
  modified_base (239)..(239): a, c, t, g, unknown or other
  misc_feature (239)..(239): n is a, c, g, or t
tcagtacacacactcacgaccggtgctcgatttagtgtagtgtgaagggaaagggggaggaactgctcagttaggacccagagggaaccatggaacgccccagctcagcttctcttcctcctgctactctggctcccagataccaccggggaaattgtgttgacacagtctccagccaccctgttctttgtctccgaaggggaaancgccaccctctcctgcgagggccagtcagagtncgtggcagcaacttgcctggtaccaaacaaaaacctcggccaagacctcccgaggcctcctcatctatgatgcactccgaccgacgggccacgtcggcactcccgacgtccgtaaggttcaggtcggcgtaggtcgggtcgtaggggacaggtaccttcactctacacactcagtacacgacctagacgtccgtagtaagttattttcgactttagtttaattacttgtcttgacgtacgtcgtagtaccgtaacgtaccggtacccttaaaccgtcccggttaccgggaacccgtaaacggggaacctaacggtaaccgtagggaaacttaaacggttaaaacgttacgtggtacgtcctacggtaccctaacgtacgttcgttacgttaccttacctaactccccggttaaccc

SEQ ID NO: 109501 - DNA, 649 bp, Homo sapiens
  misc_feature: GYAE6OF01BS6N3.33.70.G04.1.454.CMB.1.raw
  modified_base (460)..(460): a, c, t, g, unknown or other
  misc_feature (460)..(460): n is a, c, g, or t
  modified_base (561)..(561): a, c, t, g, unknown or other
  misc_feature (561)..(561): n is a, c, g, or t
  modified_base (623)..(623): a, c, t, g, unknown or other
  misc_feature (623)..(623): n is a, c, g, or t
tcagtacacacactcacgaccggtgctcgatttagtgtagtgtgaaggggaaagggggaggaactgctcagttaggacccaggagggaaccatggaagccccagctcagcttctcttcctcctgctactctcggctccagactaccgaccggggaaattgtgttgacacgacgtcctccgagcccacccttgtcgtttgtccgtaccggaaggggaaacgacgcccaccctctcctgcgacgggcctaggtcgagtgtcgtcgtacggcagctaacgtacgcctaggtaaccaaactaaaaccgtcggaccacggacctacccaggtcctacactactcgtatcgatcgcacgtacccaccggcggacctacgtcggacctaccgtacccacgaccggtacgtagcggtcggcgtaggtcgggtcgacggacctacgtccttcactcctacgacactacncgcgtacgactacggctaccgtaggtaacttagttcgtacttagtttacttacgtcgttctcgtacgtacgtacgtagtactacgtaccgttacctaaccncgggttacgaaccggtacgacacggcgtacggaatacggaacgtcgtcggtgacgtcgaccnctacgtctactatcctagtccctacg

SEQ ID NO: 109502 - DNA, 787 bp, Homo sapiens
  misc_feature: GYAE6OF01CMC1L.33.70.G04.1.454.CMB.1.raw
  modified_base (369)..(369): a, c, t, g, unknown or other
  misc_feature (369)..(369): n is a, c, g, or t
tcagtacacacactcacgaccggtgctcgatttagtgtagtgtgaagggaaagggggaggaactgctcagttaggacccagagggaaccatggaacgccccagctcagcttctcttcctcctgctactctggcctcccagactaccgaaccggggtaaattggtgttcgacacgtagtcctaccgacgccctacccttgttccttttcggtccttaccggaagggggaaactcgccctaacccctcctcctcggacgaacgggcctagtccaaggtacggtgacgtggacacgctaacttacgaccgtacggtaaccaaaacgaaaaccgtcggaccacgtacccgtaccgaacggtccctacccttanacgttaccttaagtcggtaactcgtaccaaccgtacccgaccggaaccgtacccgtaacgtccggaacctcctaccccgagtaccgtacggtacgtacggacgttacgacgggtcggtacgtacgggaacctacggtacttacgaccttaccgtacaaccgtatacggactacgtaccgacgtaacgtacgtaccgtaagttaaacgttcgttttacgacgtttaacgtttacgtaacgttcgttacacggtacgtagtacgtcgaactacgtcgtaacctacgtaccgtacggacgaacgtacgaacgtacgtaaggaaccgttaacgtaaaccgtcgttacggtacgaaccggttcaaccccgttaagttaccgttcgtttaccgtacctttaaccccgtagtttcccccggtaac

SEQ ID NO: 109503 - DNA, 757 bp, Homo sapiens
  misc_feature: GYAE6OF01AGNTE.33.70.G04.1.454.CMB.1.raw
  modified_base (210)..(210): a, c, t, g, unknown or other
  misc_feature (210)..(210): n is a, c, g, or t
  modified_base (380)..(380): a, c, t, g, unknown or other
  misc_feature (380)..(380): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaaattgtgttgacacagtcctccacgccacccttgttctttcgtctaccgaaggggaanacgcccaccctcctcctgcgacgggccagtcaggcgtgcgtgcagcaacgttcgccgtacggtaaccaaaccgaaaaccgtcggaccagaccgtcccacggtcctccctacactctagtgactcacctacctacccgaccgacggcctacgtccggaccacgtaccccgngtaccgtacggttcgacgggtacggcggtaacgggttcgggtacggtacgggacctacgttaccctccttaccgtccctacctacgtactacgacgaccgacttaccggtacgaccgtacgtaggttaatttcgtttacgtacgtttaacgttttacgttaccgttagttcgacgtacgacggttaccgaacgtaaccgtaccgttaaccgaaccccttaccggtacccgggtacggaacccgggaagtacccgtaggtaaccgtaaggtaacgtaaaaccgttaaccgtagggttccgaggttacaaccgtacccgttaacgttcccgtaacgtttccgtttaaccctaccggtttccccgttaccccgtacccgg

SEQ ID NO: 109504 - DNA, 815 bp, Homo sapiens
  misc_feature: GYAE6OF01BUCRD.33.70.G04.1.454.CMB.1.raw
  modified_base (205)..(205): a, c, t, g, unknown or other
  misc_feature (205)..(205): n is a, c, g, or t
tcagtacacacactcacgaccggtgctcgatttagtgtagtgtgaagggaaagggggaggaactgctcagttaggacccagagggaaccatggaacgccccagctcagcttctcttcctcctgctactctggctcccagactaccgaccgggaattgtgttgacacagtctccggccaccctgtctttgtctccgaaggggaaancgcccacctctcctgcgacgggccagtcaggagtgcgtggacagacctaacgttacggccgtaggtaaacccaaaacgtaaaaaccgtggaccagaccctaccgacgtcctacctactactctaatcgtacgtgacctaacgttaccccgaaccggtacggggtaccctaacggtaccggacctaccgtaccccgaacgtacccggttaacggtttacgacgggttcgggtacgtaacggggttcggtacggtacgggtaacgtaacgtaaccgtttccaccgttcctaaccgtaaccctagtacgaccggtaccgacgtacccgtaaggccgtaccttaaggtaaacgttttacggtttacgtaacgttttaacgttttaacgttccgtttcggtacgttacgtaccgtacggttacggtaacgtaacctaaccgggtccgttaacccgttaaaccggttacccggttaccgaaacgggtaaccggaaccgtaacggtacggtaaacggtaaacggtaaacgttaaacggtaacgttcgggtacgtacctaacggtcctacgttacgttcgttaccggttacttaccgtaccgttcccgtaccgtaccg

SEQ ID NO: 109505 - DNA, 753 bp, Homo sapiens
  misc_feature: GYAE6OF01ETM4F.33.70.G04.1.454.CMB.1.raw
  modified_base (150)..(150): a, c, t, g, unknown or other
  misc_feature (150)..(150): n is a, c, g, or t
  modified_base (694)..(694): a, c, t, g, unknown or other
  misc_feature (694)..(694): n is a, c, g, or t
  modified_base (751)..(751): a, c, t, g, unknown or other
  misc_feature (751)..(751): n is a, c, g, or t
  modified_base (753)..(753): a, c, t, g, unknown or other
  misc_feature (753)..(753): n is a, c, g, or t
tcagtacacacactcacgaccggtgctcgatttagtgtagtgtgaagggaaagggggaggaactgctcagttaggacccagagggaaccatggaagcccccagctcagcttctcttcctcctgcttactctggcctcccgaaggggaaanagccaccctctcctgcgagggccagtcagagtgttagcgggtactagccgtggtaccagcagaaacctggccaggcctcccgaggtctcctcctctagtgtcgcactccacgacgggcctacgtggcactcccgagactaggttccaggtcgctaggtgggtcgtagggactacggtaacctttccgaccgttcctaccgaacctacgttaccgaacgacggtaccgtaggacgtaccgtaagtaattacggttttcacgttaacgttacttacttacgttacgtccgtaagtccgtaaagttaacggtaacgggttaacggggggtaccgtaacccgggttttacccgggaaacgggaaacccggggaaacgggtttaaaacggggtaacgtaaaaccggtttaaccgaaaaaccgggtaaccgttagggtaccgttaaccgacggtaacccctaacgtaactttcgttaccgtttcttaccctacgtttacccgttcccgtacctacgttagtacggttaagttcggttagtaccgttacgnggaccggtccgggtacggtggacccggaaggccctaaggtactacgtgcgtcagcangn

SEQ ID NO: 109506 - DNA, 801 bp, Homo sapiens
  misc_feature: GYAE6OF01DOPMQ.33.70.G04.1.454.CMB.1.raw
  modified_base (206)..(206): a, c, t, g, unknown or other
  misc_feature (206)..(206): n is a, c, g, or t
  modified_base (330)..(330): a, c, t, g, unknown or other
  misc_feature (330)..(330): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaaccggggaaattgtgttgacacagtctccacgccacctgtctttgtctaccgaagggaaancgcccaccctctcctagcacgggccagtcgagagtgcgtggcagtctaacttcggaccttacggtaaccaaaaccgtaaaaaccgtcggaaccacgtaccctcccgaacggtcccttaccctanacttaccgttagtagtacgtacgtacctaaccgttacccgaacccggagggtaccccctaaggtccggtaacctaacccgttaccccgaccggtaccggttacggttaccgaacgggtggtaccggtacgggtttcggggacgttacggggaaccgtacgtttaacctttaccaccggtttaccacgtaccaactcgacgtacacggtaccacgacgtcctagtaagttctttacggactttaacgttttactagttccgttacgtcgtactacggtacgtaaccgtacgtaacggttacctaacccgttaacccgttccgttaacccgggaacgttaaccggaacgtaccggaacggttaaggtaaccgtaaacgttaaaccgacggttcggtaacgtaccgttacgtaccccgtagtaacccgtttacgtttacccggtttaccttctaacccgtttcccgtaaccccg

SEQ ID NO: 109507 - DNA, 830 bp, Homo sapiens
  misc_feature: GYAE6OF01CE5OI.33.70.G04.1.454.CMB.1.raw
  modified_base (130)..(130): a, c, t, g, unknown or other
  misc_feature (130)..(130): n is a, c, g, or t
  modified_base (593)..(593): a, c, t, g, unknown or other
  misc_feature (593)..(593): n is a, c, g, or t
tcagtacacacactcacgaccggtgctcgatttagtgtagtgtgaagggaaagggtgaggaactgctcagttaggacccagagggaaccagtggaagccccagctcagcttctcttcctcctgctactcnggcctccagactaccgacgggtaattgtgttgacactacgtcctccgagccctacccgttgttcgttttgccgttacccggaaagggggaaacacgcccctacccgttcctccgtacggccgaacggggccctaggtaccgaggtaggttcgccggttacggacacggtaccttaaccgttcgtacccgtacggtaaaacccaaaaaccgaaaacccgtcggaacccgaacgtacccctacccgaacgtccctaccgtacacttctacgtacgcttacggactaaccgacccgaccgggaacggtccctaccggttgacccctaccgtaccccgaaggtcccgttagggttaccgagggtaccggtcgtaaggggtcgggtacgtacggacgtacgtacgttaccaccgttccgaaccgttacaaccgtgaaccgacgaccgtaccgaacgtcttaaccgggngtttaaacgtttcgttacttacgttttaacggttccttaagttcggtacgtagaccggttaacgaccggtaactacgtaaccgtacccgttaaccctacgggtacccgttacggaacccggttaaggacccttaggtaacgttaacggaaaccgttaaacggttaacgacggttacccggtatacggttaccaccttaccgtctttaaccgttcggttccctacggttcctaacccg

SEQ ID NO: 109508 - DNA, 927 bp, Homo sapiens
  misc_feature: GYAE6OF01BVWVL.33.70.G04.1.454.CMB.1.raw
  modified_base (171)..(171): a, c, t, g, unknown or other
  misc_feature (171)..(171): n is a, c, g, or t
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
tcagtacacacactcacgaccggtgctcgatttagtgtagtgtgaagggaaaggggaggaactgctcagttaggacccagaggaaccatggaagccccagctcagcttctcttcctctgctactctgctcccagactaccgaccgggaattgtgttagacacagtctaccncgccctacctgttctttgtctaccgaagggaacncgccctaccctcgtcctgacgacgggccagtcgaagngtcgcgttcggacgacgtacctaacgttcgcccgttaacggtaaaccctaaaaaccgaaaaacccgtcggtaacccaacgtaacccttacccgaacggtcccttacccttaacgacttacccgtaaggttacggtcgtacctaaccgtacccgaccggaccgggtacctacggtccggaaccttaccgtacccgagtaccggtaggttccgaaggttcggacgtagggttcggtacgtcggaactcgttactttcgtaacgtttcaccgtacccagtacgaacgtccaagggttaccgtacggtaccgtacttaggtaacgtttaggtttacgtacgttaaggtttacgtttaacgtttacgttacgttaaccgtacggttaaccggttaacgggtttaaccggtttaacgtttaaccgtttaaccggttacccgtttaacccgggtacccgggtttaaccgggtaaacccgggaaaaccgggtttaaacccgggttaaaacggggtaaaccggttaaaaacccggttaaaacccgggttaaaccggttaaacggtttacggttaaaccggtacccgttaacgggtaaccccgttaaacccgttacggttttcccgtttaaccgttttacccgttaacctttaacccccgggttttacccttaccccgggtccgtttaaacccgg

SEQ ID NO: 109509 - DNA, 823 bp, Homo sapiens
  misc_feature: GYAE6OF01AFIN7.33.70.G04.1.454.CMB.1.raw
tcagtacacacactcacgaccggtgctcgatttagtgtagtgtgaaggggaaagggggaggaactgctcagttaggacccagagggaaccatggaagccccagctcagcttctcttcctcctgctactctggctcccagataccgaccgggaattgtgttgacacagtcctccagcccacctgttctttgtcctacgaaggggaagcgccaccctctcctgcgagggccagtcaggagtcgcgtggacagacgtaactacggccgtacggtaaacccaaaacgaaaaacccgtcggacccacggtacccgtcccgaacggtccttacccgtactacttacctagttaggacttcaccacctacccgaccgacgggcccacgtccgggaccaccgtcccgacggtaccgtaggttaccgacggtaggccggtagggtcggggttacggtacggggaacctaacgggttacccttaccgtaaccttcccgtaacccgtaacccgtgtacccgaccggtaccgtaaccggtaccgtaagtaaccggttcccgtttaaggtaaccgttttaggtttacggtaacttttaacggtttttaacttccgttaggttactcggtaacgtacggtacgtaaccgtaccgtaaacggtttccgtaaccccgttaacggttaccccgtaacccggggaaccggtaaaccgggtaacctaccgggtaacggtaaggtaaccggtaaaacgttaaaccggtaagtccgggtacggtacctcggaacctaacgtccgtttacgtccttaccgttacctacccgttcccggtaccccg

SEQ ID NO: 109510 - DNA, 733 bp, Homo sapiens
  misc_feature: GYAE6OF01ESYB7.33.70.G04.1.454.CMB.1.raw
  modified_base (127)..(127): a, c, t, g, unknown or other
  misc_feature (127)..(127): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctacnctggctcccagataccaacggggaaattgtgttgacacagtctcagccaccctgtcttgtctccaggggaaagagccaccctctccctgcagggccaatcagagtgttagcagtaacttggtctaggtaccaacagacgacctggcccaggcctcccaggctcctcatcgtatcgatcgcactcccgaacgtccgacgccggcgacgtaccaccgccgacggtccgtacgttaggacgaggtacggtacggttacggggtacggtacgggtaccttacggtacccttctacccttacccgacctaccgaacgaccgaagtacccctaacgtccggtaacgtaccggtaacgtaaggtttaacggttacgtttacgtacgttttaaccgttttagttaaccggtcgtaacgcggttaccgtaacggttcctaaccgtaacggtcctacccggttccggtacctacccgccggtttaacccccggtaacggaaccggaaccgggtacttaacgggtacggtaacgtacggttaacggtaaggaacggttacggcggttaaccggtccgtaccctaccgttccccgttaacgtttccctacgtttaccc

SEQ ID NO: 109511 - DNA, 835 bp, Homo sapiens
  misc_feature: GYAE6OF01EMSOP.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagactaccgaccggggaaattgtgttgacacagtctccagccacctgtctttgctccgaggggaaangccacctctccgtgcgagggccagtcagagtcgcgtggacagcctaaacttcgccttaggtaaacccaaactaaaaacccgtggaccaagaccctcccgaaggtcctacctactatctaatgactgacaactcccaaccggacgggaccctacgtcggactactaccccgaggacccgtaagtttccgaacggttcggaccggtacgggttcggggtaccgttacgggggaaccgtaacgttacccgtttacccgaacctttacccgtaccaaaccgtacgtaaccgtacggtaccgaaccgtaccgtaacgtaaccgtccgtaagtaagttaagttttacgtaaccgtttaagttttaacttacgttcgttacgtacgtcgtaacggtacgttaaccgtacgtaacgttaccggtaaccccttaaaccgtaacccgtttaacccgggaaaccgttaaacggggtaacccgaacgggttaaccggtaaggtaaaccggttaaaacggtttaaaacccgggtaacggttccgggttacgggtaaccgttccgtaacccgtaaccggttaacgtttcccggttaacggtttaaccctttaacgttaaccccgttccccgtttaaaccccccggg

SEQ ID NO: 109512 - DNA, 787 bp, Homo sapiens
  misc_feature: GYAE6OF01AZWTJ.33.70.G04.1.454.CMB.1.raw
  modified_base (202)..(202): a, c, t, g, unknown or other
  misc_feature (202)..(202): n is a, c, g, or t
  modified_base (360)..(360): a, c, t, g, unknown or other
  misc_feature (360)..(360): n is a, c, g, or t
tcagtacacacactcacgaccggtgctcgatttagtgtagtgtgaagggaaagggggaggaactgctcagttaggacccagagggaaccatggaagccccagctcagcttctcttcctctgctactctggctccagtataccgacgggaattgtgtgacactagtcctccagcccaccttgttctttgctccgaagggaacncgcccacccttctcctggacagggcctagtcaagagtcgcgtggcacgactaacttcgaccttacgggaaaaccccaaaacgtaaaaaccgtcggacccacgtaccctcccgacgtcccttacctacgtacttacgtagtgtacgtctaccgtaaccncccgaaccggaacggtaccctaccggtcgacctaccgtacccgacggaccgttacggtcgtaacggtcgggtacgtagggttccgggtacgtcggggtaacaccgttaccgttccgtaccttaccgtaccaaccgtacgtaccgacggacccgtaacggtacctaacggacccttaccgggttaagtaaacgggttttacgttttaccgtaccgttttaaagttttacgtttaccggtcgttaacgtacggtaacccgtaggtacggtaaccacccgttacggtacccggttaaacctcccggtaccgtaccggaacggtacgaacgtaccgtaaggtacggtaataaaccggtacgttaccgtggtaaccgtctcgaaccctacgtacgttacgttcccttacttcgtaacccttcccgtaacccg

SEQ ID NO: 109513 - DNA, 511 bp, Homo sapiens
  misc_feature: GYAE6OF02IBBKO.33.70.G04.1.454.CMB.1.raw
tcagtacacacactcacgaccggtgctcgatttagtgtagtgtgaagggaaaggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccacctctcctgcagggccagtcagagtgctggcagcaacttagcctggtacccaaacaaaaacctggccagactcccaggctcctcatctatgatgcatccaccagggccactggcatcccagccaggttcagtggcagtgggtctgggacagacttcactctcaccatcagcagcctagagcctgaagtattttgctagtttattacttgttctgcagcgtagcaactcggacctaacaccttcggaccgaaggacacgactagagattaacgactgtggctgacacatctgtcttcactctcccg

SEQ ID NO: 109514 - DNA, 508 bp, Homo sapiens
  misc_feature: GYAE6OF02GB2QD.33.70.G04.1.454.CMB.1.raw
  modified_base (395)..(395): a, c, t, g, unknown or other
  misc_feature (395)..(395): n is a, c, g, or t
  modified_base (427)..(427): a, c, t, g, unknown or other
  misc_feature (427)..(427): n is a, c, g, or t
tcagtacacacactcacgaccggtgctcgatttagtgtagtgtgaagggaaaggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactcccaggctcctcatctatgatgcatccaccagggccactggcatcccagccaggttcagtggcagtgggtctgggacagacttcactctcaccatcagcagcctagacgcctgaagtnttttgctagtttattactgttctgcagcgtancaactggacctaacaccttcggaccaagggacacgactggagattaaacgacgtgtgctgcacatctgtctcactctcccg

SEQ ID NO: 109515 - DNA, 606 bp, Homo sapiens
  misc_feature: GYAE6OF02GBUBO.33.70.G04.1.454.CMB.1.raw
  modified_base (428)..(428): a, c, t, g, unknown or other
  misc_feature (428)..(428): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccgggaaattgtgttgacacagtctccagccacctgtctttgtctccgaggggaaagagccaccctctcctgcacgggccagtcagagtgctggcagcaacttagcctggtaaccaaacaaaaacctggaccagacctcccaggcctcctcatctatgatgcactcccaccgacgggcccacgtcggacactcccacgccgtaggttaccaggtcggctaggtcgggtcgtggggacaggtacttcgactcttaccatccagcagcctagacgcctagaagtntttgcttaagtttactactgttctgctagtcgtagactaacgtcgtacctaacgtccgttaccggaccgaacgggaccaacggacgtagggaacgtaacgttaaaccgaacgtggtacggtacgtacgacctaacctagtaccgttcgttaccttacgtactttcccgttcccgtacc

SEQ ID NO: 109516 - DNA, 512 bp, Homo sapiens
  misc_feature: GYAE6OF02GQY5O.33.70.G04.1.454.CMB.1.raw
  modified_base (203)..(203): a, c, t, g, unknown or other
  misc_feature (203)..(203): n is a, c, g, or t
  modified_base (426)..(426): a, c, t, g, unknown or other
  misc_feature (426)..(426): n is a, c, g, or t
  modified_base (472)..(472): a, c, t, g, unknown or other
  misc_feature (472)..(472): n is a, c, g, or t
tcagtacacacactcacgaccggtgctcgatttagtgtagtgtgaagggaaagggggaggaactgctcaggttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttagcctggtaccaacaaaaacctggccagactcccaggctcctcatctatgatgcatccaccagggccactggcatcccagccaggttcagtggcagtgggtctgggacagacttcactctcaccatcagcagcctagagcctgaagtattttgctagtttatacttgtctgcagcgtancaacttggacctaacgaccttcggaccaagggacacgactgggaanattaaacgactgtggctgacacatctgtctcatcttcccg

SEQ ID NO: 109517 - DNA, 547 bp, Homo sapiens
  misc_feature: GYAE6OF02IRFH8.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttgcctggtaccaacaaaaacctggccagactcccaggctcctcatctatgatgcatccaccagggccactggcatcccagccaggttcagtgcagtggtctgggacagacttcactctcaccatcagcagcctagacgcctagaagtattttgactagtttattactgtctgcagcgtagcaacgtggaccctaactaccgttcggaccaaagggaccacggtaacgtgggaacgtattaaaccggaactggtacggctaggaccaacctagttccgttgtctttactacttccctccccg

SEQ ID NO: 109518 - DNA, 515 bp, Homo sapiens
  misc_feature: GYAE6OF02IBIY5.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaacaaaaacctggccagactcccaggctcctcatctatgatgcatccaccagggccactggcatcccagccaggttcagtggcagtgggtctgggacagacttcactctcaccatcagcagcctagacgcctagaagtattttgctagtttattactgtctgcagcgtagcaactcggacctaacaccgttcggaccgaacgggacacgactggatattaacgactgtcgctgaccacatctgtcttcactctcccg

SEQ ID NO: 109519 - DNA, 555 bp, Homo sapiens
  misc_feature: GYAE6OF02H07KZ.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccacctctcctgcagggccagtcagagtgctggcagcaacttagcctggtaccaacaaaaacctggccagactcccaggctcctcatctatgatgcatccaccaggccactggcactcccagccaggttcagtggcagtgggtctgggacagtacttcactctcacatcagcagcctagacgcctgaagtattttgactagtttattactgtctgcagtcgtagactaacgtcggacctacgaccttcggacccgtaaagggaccacggaccgtaggaacgtaacttaaaccggaacgtggtacggctagacccacgtacttcgtgtttacctttacacgttccttaccccg

SEQ ID NO: 109520 - DNA, 532 bp, Homo sapiens
  misc_feature: GYAE6OF02G4N8S.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagccagagtgctggcagcaacttagcctggtaccaacaaaaacctggccagactcccaggctctcttctatgatgcatccaccagggccactggcatcccagccaggttcagtggcagtggtctgggacagacttcactctcacatcagcagcctagacgcctagaagtattttgctagtttattactgtctgcagcgtagcaagtggacctaactccgttcgaccaagggacacgactaggagtaacgttaacgacgtggtacggctaggcaccgtattccgtgttccttcgacttccttcccgacc

SEQ ID NO: 109521 - DNA, 511 bp, Homo sapiens
  misc_feature: GYAE6OF02GD62B.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactcccaggctcctcatctatgatgcatccaccagggccactggcatcccagccaggttcagtggcagtgggtctgggacagacttcactctcaccatcagcagcctagagcctgaagtattttgctagtttatactgtctgcagcgtagcaactcggacctaacaccttcggccaaagggacacgacgtggagattaaacgactggtggctgccacatctgtcttcatcttcccg

SEQ ID NO: 109522 - DNA, 521 bp, Homo sapiens
  misc_feature: GYAE6OF02G7W93.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaacaaaaacctggccagactcccaggctcctcatctatgatgcatccaccagggccactggcactcccagccaggttcagtggcaggtgggtctgggacagacttcactctcaccatcagcagcctagacgcctagaagtatttgctagtttattactgttctgcagcgtagctaactggacctacaccgttcggaccaagggacacgacgtaggagtataacgacgtggtagctgacaccatctgtcttctacttcctcccg

SEQ ID NO: 109523 - DNA, 540 bp, Homo sapiens
  misc_feature: GYAE6OF02GX5FE.33.70.G04.1.454.CMB.1.raw
tcagtacacacactcacgaccggtgctcgatttagtgtagtgtgaagggaaagggggagggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaaacaaaaacctggccagactcccaggctcctcatctatgatgcatccaccagggccactggcatcccagccaggttcagtgcagtgggtctgggacagacttcactctcacatcagcagcctagacgcctagaagtattttgctaagttttacttactgtctgctagcgtagcactggacctaacaccgttcggaccgaacgggacacgtacgtggagtattaaccggacgtcggtaggtactgaccacctatcgttcgtccttactactccttaccccg

SEQ ID NO: 109524 - DNA, 538 bp, Homo sapiens
  misc_feature: GYAE6OF02FXJLI.33.70.G04.1.454.CMB.1.raw
tcagtacacacactcacgaccggtgctcgatttagtgtagtgtgaagggaaagggggagggaactgctcagttaggacccagagggaaccatggaagccccagctcagcttctcttcctcctgctactctggctcccagataccaccggggaaattgtgttgacacagtctccagccacccttgtctttgtctccaggggaaagagccaccctctcctgcagggccagtcagagtgcgtggcagcaacttgcctggtaccaacaaaactggccagactcccaggctcctcatctatgatgcatcccaccaggggcccacgtggcagtcccagaccaggttcagtggcaggtgggtctagggacagtacttcgattctcacatcagcagactggagcctagaagtatttgactagtgtattacttgtcagcagtacgtagttcatcctcgtacgttcggccaagggaccaaaggtagaaatacgaacgacgtggtggactagctaacctagtcgtgtccttactacttccgttcccgtc

SEQ ID NO: 109525 - DNA, 539 bp, Homo sapiens
  misc_feature: GYAE6OF02I8B6Q.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaacctggccagactcccaggctcctcatctatgatgcatccaccgagggcccacgtggcactcccagccaggttcagtgcaggtggtctgggacagacttcactctcaccatcagcagcctagacgcctagaagtattttcgcttagtttactacttgtctgcagcgtagcaacgtcggacctaaccaccgttccggaccgaagggaccacggactggagtacttaaacggactggtcgctgaccaccgtattccgtgtccttcacttcctacccg

SEQ ID NO: 109526 - DNA, 520 bp, Homo sapiens
  misc_feature: GYAE6OF02IYIMO.33.70.G04.1.454.CMB.1.raw
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacaggacttcactctcaccatcagcagcctagagcctgaagattttgactagttttatactgtcagcagcgtagcaactggacctaacaccttcggaccaagggacacgactggaagattaaacgactgtgctgcaccatctgtcttcatccttacccgctattctgtaagtgttagtcgtactggagcgggtactggacaacgggcgacagtacggntcgntn

SEQ ID NO: 109527 - DNA, 501 bp, Homo sapiens
  misc_feature: GYAE6OF02H460Q.33.70.G04.1.454.CMB.1.raw
  modified_base (202)..(202): a, c, t, g, unknown or other
  misc_feature (202)..(202): n is a, c, g, or t
  modified_base (355)..(355): a, c, t, g, unknown or other
  misc_feature (355)..(355): n is a, c, g, or t
  modified_base (464)..(464): a, c, t, g, unknown or other
  misc_feature (464)..(464): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttagcctggtaccaacaaaaacctggccagactcccaggctcctcatctatgatgcatccaccagggccactggcatcccagccaggttcagtggcagtgggtctgggacngacttcactctcaccatcagcagcctagagcctgaagtattttgctagtttattactgtctgcagcgtagcaactggacctaacaccttcggccaagggcacgactganattaacgactgtgctgcacatctgttctcatctcccg

SEQ ID NO: 109528 - DNA, 594 bp, Homo sapiens
  misc_feature: GYAE6OF02IJ5NT.33.70.G04.1.454.CMB.1.raw
  modified_base (203)..(203): a, c, t, g, unknown or other
  misc_feature (203)..(203): n is a, c, g, or t
  modified_base (401)..(401): a, c, t, g, unknown or other
  misc_feature (401)..(401): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagngccaccctctcctgcagggccagtcagagtgctggcagcaacttagcctggtaccaacaaaacctggccagactcccaggcctcctcatctatgatgcatccaccgacgggccactggcactcccagccaggttcagtggcaggtgggtctgggacagacttcactctcacatcagcacgcctagacgcctagaagtnttttgctagtttatactgttctgcagcgtagcaacgtcggtaccctaacgtaccgttccggacccgtaaacggggaccaacggtacgtacgggaacgtaacgttaaaccggtaacgttgggttacggccgttacggaccctaacccgtacttccgttacggttcctttaccgtacgtttccccgttacccccg

SEQ ID NO: 109529 - DNA, 540 bp, Homo sapiens
  misc_feature: GYAE6OF02HCWVF.33.70.G04.1.454.CMB.1.raw
  modified_base (204)..(204): a, c, t, g, unknown or other
  misc_feature (204)..(204): n is a, c, g, or t
  modified_base (434)..(434): a, c, t, g, unknown or other
  misc_feature (434)..(434): n is a, c, g, or t
tcagtacacacactcacgaccggtgctcgatttagtgtagtgtgaagggaaagggggaggaactgctcagttaggacccagagggaaccaatggaacgccccagctcagcttctcttcctcctgctactctggctcccagataccaccggggaaattgtgttgacacagtctccagccaccctgtctttgtctccaggggaaangccaccctctcctgcgagggccagtcagagtgctggcagcaacttagcctggtaccaacaaaacctggaccagactccaggctcctcatctatgatgcactccaccagggccactggcactcccagccaggttccagtcggcagtcggtctgggacaggacttcactctcaccatcagcagcctagacgcctagaatatttgacttagtttatactgtctgcagtcgtanctaactcggacctaacgaccgttcggaccaagggacacgtacgtgaagtacttaaacggacgtggtacgctacgaccactagttctgttcttcacgttccctcccg

SEQ ID NO: 109530 - DNA, 508 bp, Homo sapiens
  misc_feature: GYAE6OF02G4R7Y.33.70.G04.1.454.CMB.1.raw
  modified_base (467)..(467): a, c, t, g, unknown or other
  misc_feature (467)..(467): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactcccaggctcctcatctatgatgcatccaccagggccactggcatcccagccaggttcagtggcagtgggtctgggacagacttcactctcaccatcagcagcctagagcctgaagattttgctagtttatactgttctgcagcgtagcaactggacctaacaccttcggaccaagggacacgatggaanattaaacgactgtaggctgcacatctgtcttcactctcccg

SEQ ID NO: 109531 - DNA, 554 bp, Homo sapiens
  misc_feature: GYAE6OF02F7ACR.33.70.G04.1.454.CMB.1.raw
  modified_base (528)..(528): a, c, t, g, unknown or other
  misc_feature (528)..(528): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaaccaacaaaaacctggaccagacctccaggctcctcatctatgatgcatccaccagggccacgtggcactcccagccaggttcagtggcaggtgggtctgggacagacttcactctcaccatcagcacgcctagacgcctaggaacgttattttgacttagttttactacgttgtcagtctaggtacgttattcagttccgtccgtacgttcggaccgtaagggaccaagggtagaaactacgaaacgtacgtggtacggctagccaacctnttctgttcttcattcccttccgctac

SEQ ID NO: 109532 - DNA, 570 bp, Homo sapiens
  misc_feature: GYAE6OF02GKJXW.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaacaaaaacctggccagactcccaggctcctcatctatgatgcatccaccagggccactggcatcccagccaggttcagtggcaggtgggtctgggacaggacttcactctcaccatcagcagcctagagcctagaagtattttgactagtttattactgttctgcagcgtagctaacgtcggacctaaccaccgttacggaccaaagggaccacggacgtagggaacgtacgttaaacgacgttggtacggtccgtacggaccctaaccgtacttccgttcggttacctttacgtacgttcccttaccccg

SEQ ID NO: 109533 - DNA, 579 bp, Homo sapiens
  misc_feature: GYAE6OF02HB2UX.33.70.G04.1.454.CMB.1.raw
  modified_base (414)..(414): a, c, t, g, unknown or other
  misc_feature (414)..(414): n is a, c, g, or t
tcagtacacacactcacgaccggtgctcgatttagtgtagtgtgaagggaaagggggtagggaactgctcagttaggacccagagggaaccatggaagccccagctcagcttctcttcctcctgctactctggctcccagataccaccggggaaattgtgttgacacagttctccagcccacccttgtctttgtcctccaggggaaagagccaccctctcctgcagggccagtcagatgcgtgcagcaacttagcctggtaccaacaaaacctggccagactcccaggctcctcatctatgatcgcatcccaccgaggggccacgtggcagtcccgagaccaggttcagtggcaggtgggtctagggacagtacttcgattctcacagtcagcagactcggagcctagaaagtntttagactagtgtaattacttgtacagctagttacggtagttcattcgtaccgtagttccggacctaaagggacctaaaggtagtaaacgtaccgaaacgtacgtaggtacggactaggtaccaacctagttacgttagttaccttacacttccgttcccgtacc

SEQ ID NO: 109534 - DNA, 562 bp, Homo sapiens
  misc_feature: GYAE6OF02IVQGC.33.70.G04.1.454.CMB.1.raw
  modified_base (201)..(201): a, c, t, g, unknown or other
  misc_feature (201)..(201): n is a, c, g, or t
tcagtacacacactcacgaccggtgctcgatttagtgtagtgtgaagggaaagggggaggaactgctcagttaggacccagagggaaccatggaagccccagctcagcttctcttcctcttgctactctggctcccagataccaccggggaaattgtgttgacacagtctccagccaccctgtctttgctccaggggaaangccaccctctcctgcagggccagtcagagtgctggcagcaacttagcctggtaaccaacaaaaacctggaccagacctccaggctcctcatctatgatgcatccaccagggccactggcactcccagccaggttcagtgcaggtgggtctgggacagtacttcactctcacatcagcacgcctagacgcctagaagtattttgacttagtttattacgtgttactgactagcgtagcaacgtcggacctaacgtaccttacggaccaacgggaccacgaacgtaggaacgtaagttaaacggaacgtggtacggtactacgacctaccgtactcgtagttccttactacttcccttacccg

SEQ ID NO: 109535 - DNA, 627 bp, Homo sapiens
  misc_feature: GYAE6OF02F1LZJ.33.70.G04.1.454.CMB.1.raw
  modified_base (205)..(205): a, c, t, g, unknown or other
  misc_feature (205)..(205): n is a, c, g, or t
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccgggaaattgtagttgacacagtctccagtccaccctgtcctttcgtctccaggggaaanagccaccgtactcctcgccagggccagtcaggagtgctggcagcaacttagcctggtaccaacaaaacctgaccagactacccaggcctccgtcctcctatcggtcgcatcccaccagggcccacgtcggccactcccgaagaccacggttcagtcggccaggtcgggtcgtggggactaggtaccttacgacgttctcgacctatcgaccagtactggacncctagaacgtnttttcgctagtcttagttactgtactagtcagttatacgtgggacgtacgtttcggacctaagggtacctaagggttacggaacgttaccgaaacgtacgttggtacgacgttgaccgaccgtaagttccgtaggtacctttaccgaacgttccgttacccggacctacgtttccgttacgtaagttcg

SEQ ID NO: 109536 - DNA, 516 bp, Homo sapiens
  misc_feature: GYAE6OF02GTL8E.33.70.G04.1.454.CMB.1.raw
  modified_base (387)..(387): a, c, t, g, unknown or other
  misc_feature (387)..(387): n is a, c, g, or t
  modified_base (447)..(447): a, c, t, g, unknown or other
  misc_feature (447)..(447): n is a, c, g, or t
  modified_base (472)..(472): a, c, t, g, unknown or other
  misc_feature (472)..(472): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactcccaggctcctcatctatgatgcatccaccagggccactggcactcccagccaggttcagtgcagtgggtctgggacagacttcactctcaccatcagcagcctagacncctagaagtattttgactagtttactactgttctgcagtcgtagcaacgtggacctaacnccgttcggaccaagggacacgacgngagataacgacgtgtagctgcgactatctgtcttcatcctcccg

SEQ ID NO: 109537 - DNA, 510 bp, Homo sapiens
  misc_feature: GYAE6OF02G9PQ3.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccagcagacacctggccaggctcccaggctcctcttctatgatgcatccaacagggccactggcatcccagccaggttcagtggcggtgggtctgggacagacttcactctcaccatcagcagcctagagcctgaagtattttgctagtttattactgtcagcagcgtagcaactggtcttggacgttcggccaagggaccaaggtgaatcgaaacgacgtggtaggctgcaccatctgtcttcactcttcccg

SEQ ID NO: 109538 - DNA, 531 bp, Homo sapiens
  misc_feature: GYAE6OF02HX2EJ.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttgcctggtaccaaacaaaaacctggaccagactcccaggctcctcatctatgatgcatccaccagggcccactggcatcccagccaggttcagtgcaggtgggtctgggacagacttcactctcaccatcagcagcctagagcctagaagtattttgctaagttttattaactgttctgctagtcgtagcaagtcggacctaacgaccttcggaccaagggaccacgacgtaggataagttaaacgacgtgtcggctgcacctatcgtgtcttcacttcctcccg

SEQ ID NO: 109539 - DNA, 572 bp, Homo sapiens
  misc_feature: GYAE6OF02F7NDA.33.70.G04.1.454.CMB.1.raw
  modified_base (396)..(396): a, c, t, g, unknown or other
  misc_feature (396)..(396): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactcccaggctcctcatctatgatgcatccaccagggccactggcatcccagccaggttcagtggcagtgggtctgggacagacttcactctcaccatcagcagcctagacgcctgaagtnttttgctagttttatactgtctgcagcgtagcaacgtggaccctaacgacccgttcggaccgaagggaccacggacgtaggaacgtacttaaaccggaacgttggtacggtccttacggaaccctaccgtaacgttccgttacggtttacccttacgttacttccccgttaccccg

SEQ ID NO: 109540 - DNA, 567 bp, Homo sapiens
  misc_feature: GYAE6OF02IB61D.33.70.G04.1.454.CMB.1.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaangccacctctcctgcagggccagtcagngtgctggcagcaacttagcctggtaacccaaacaaaaacctggaccagactcccaggctcctcatctatgatgcatccaccgagggccactggcatcccagccaggttcagtggcaggtgggtctgggacagacttcactctcaccatcagcagctagngcctgaatntttgactagttttattactgttctgcagtcgtagctaactcggacctaacgtaccgtttcggacctaaacgggacaacgacgtagggaagtaacgttaaacggaacgtggtacggtcctcggtaccaccgtacttccgttacgttacctttacgacttccgttacccccgg

SEQ ID NO: 109541 - DNA, 524 bp, Homo sapiens
  misc_feature: GYAE6OF02H6CMA.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaattgtgttgacacagtctccagccaccctgtctttgtctccaggggaaagagccaccctctcctgcagggccagtcagagtgctggcagcaacttagcctggtaccaacaaaaacctggaccagactcccaggctcctcatctatgatgcatccaccaggccactggcatcccagccaggtcagtggcagtgggtctgggacagactcactctcaccatcagcagcctagagcctagaagtattttgctagtttatactgtctgcagcgtagcactggacctaacgaccttcggaccaagggaccacgacgtaggagatttaacgactggtacggctgaccacacttctacgttcctactacgttcctacccg

SEQ ID NO: 109542 - DNA, 852 bp, Homo sapiens
  misc_feature: GYAE6OF02H5GPF.33.70.G04.1.454.CMB.1.raw
  modified_base (135)..(135): a, c, t, g, unknown or other
  misc_feature (135)..(135): n is a, c, g, or t
  modified_base (199)..(199): a, c, t, g, unknown or other
  misc_feature (199)..(199): n is a, c, g, or t
tcagtacacacactcacgaccggtgctcgatttagtgtagtgtgaagggaaagggggaggaactgctcagttaggaccagagggaaccatggaagccccagctcagcttctcttcctcctgctactctggctccngataccaccggggaattgtgttgacacagtctccagccaccctgtctttgctccgaggggaaancgccacctctcctgcagggccagtcagagtgctggcagcaacttgcctggaccaacaaaaaccttcgggaccaacggtaaccgtaccccgaacgggtaccttaccgtacgtaacgttaccgttaacgtcgtacgttcgacctacgtacccgtaaccgtacgggtaccctaacgtcggaccgtaacgtccccgaacggtccgtaacgggttaccgtaacggttcgggtaccgtacggttcggggttaccggtacggggtaaccgtaacggtacccgtttaccgaaccgttccgtaaccgtaacccgtaacgttaccggtaacggtaccgtaacgggtaccgtaaacgggaccgttacccgttaaggtaaacgtttaacgtttttccgggaccgtttaaaggtttttaacgtttaccgtcggtttaccggttacggaccgttaagggtaccgttacggacccgttaaacggtccgggtaaaccttaaaccggtacccgtttacgggaacccgtaaacgggggtacctaaccgggttaacgtacgggtaaccgttaacggttaaaccggtaccgttggtaaccgggtcctaacggtacccgtaaccgttacgttccgttacgttacccgtttacgtaccggtttccgtaaccccgg

SEQ ID NO: 109543 - DNA, 500 bp, Homo sapiens
  misc_feature: GYAE6OF02FTWJ7.33.70.G04.1.454.CMB.1.raw
  modified_base (434)..(434): a, c, t, g, unknown or other
  misc_feature (434)..(434): n is a, c, g, or t
  modified_base (496)..(500): a, c, t, g, unknown or other
  misc_feature (496)..(500): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcattctcaccatcagcagactggagcctgaagattttgcagtgtattactgtcagcagtacggtagttcatctccgacgttcggccaagggaccaaggtggaaatcaaacgactgtggctgcaccatctntcttcatcttcccgcattctgaagtgtgtgtactgaggcgggctgggcaaggcgacgatagnnnnn

SEQ ID NO: 109544 - DNA, 485 bp, Homo sapiens
  misc_feature: GYAE6OF02G5VBE.33.70.G04.1.454.CMB.1.raw
  modified_base (200)..(200): a, c, t, g, unknown or other
  misc_feature (200)..(200): n is a, c, g, or t
  modified_base (375)..(375): a, c, t, g, unknown or other
  misc_feature (375)..(375): n is a, c, g, or t
  modified_base (386)..(386): a, c, t, g, unknown or other
  misc_feature (386)..(386): n is a, c, g, or t
  modified_base (426)..(426): a, c, t, g, unknown or other
  misc_feature (426)..(426): n is a, c, g, or t
  modified_base (478)..(478): a, c, t, g, unknown or other
  misc_feature (478)..(478): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccgggaattgtgttgacacagtctccagccaccctgtctttgtctccaggggaaangccacctctcctgcagggccagtcagagtgctggcagcaacttagcctggtaccaacagaaacctggccaggctcccaggctcctcatccaataatgctattcaacgaggccatgcatccagccaggtcagtgcagtggctgggacagcttcactctcacatcagcagctagacncctgagattcngctagtttattagtgtacagcagctctcaatcgcctcgtncctcgttcgcaagggcacgatggagacttagacgtatgtgctcgctcccgtntcgtctc

SEQ ID NO: 109545 - DNA, 545 bp, Homo sapiens
  misc_feature: GYAE6OF02IWHOB.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaacaaaacctggccagactcccaggctcctcatctatgatgcatccaccagggccactggcatcccagccaggttcagtggcagtggtctgggacagacttcactctcaccatccagcagcctagacgcctagaagtattttgctagtttattactgttctgcagcgtagcaactggacctaacaccttcggaccaaggggacacggacgtagggacgtacgttaaacgacgtggtacggactggaccaccgtattccttaggttacttactacttccttaccccgg

SEQ ID NO: 109546 - DNA, 507 bp, Homo sapiens
  misc_feature: GYAE6OF02FN3UX.33.70.G04.1.454.CMB.1.raw
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactcccaggctcctcatctatgatgcatccaccagggccactggcatcccagccaggttcagtggcagtgggtctgggacagacttcactctcaccatcagcagcctagacgcctgaagtattttgctagtttatactgtctgctagcgtagcaactggacctaacgaccttcggccaagggacacgacgtggagattaacgactggcgctgcacntctgtctcntctcccg

SEQ ID NO: 109547 - DNA, 611 bp, Homo sapiens
  misc_feature: GYAE6OF02HMDKX.33.70.G04.1.454.CMB.1.raw
  modified_base (201)..(201): a, c, t, g, unknown or other
  misc_feature (201)..(201): n is a, c, g, or t
  modified_base (383)..(383): a, c, t, g, unknown or other
  misc_feature (383)..(383): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaanagccacctctcctgcagggccagtcagagtgctggcagcaacttagcctggtaccagcagacaccgtggccaggctccaggctcctcatccagtggtcgcactccaccgagggccacgtggccactcccagacctagggttcaggtcggctaggtgggtcgtgggacaggtacttcatttcncaccatcagacagtacgtggacgccgtagaagttagtttcgactagttacgttaactttacgtgttacgtagacgtacggttacggttacgttactacgttccgtaccgtacgttccggaaccgtaacggaaccgtaagggtaacgtaacgtaaccgaaacggtaacgttacggtacggtacgtacgaccgtaccgtactacgttcgttacttaccgtacgttacccg

SEQ ID NO: 109548 - DNA, 540 bp, Homo sapiens
  misc_feature: GYAE6OF02HSGVA.33.70.G04.1.454.CMB.1.raw
  modified_base (202)..(202): a, c, t, g, unknown or other
  misc_feature (202)..(202): n is a, c, g, or t
  modified_base (450)..(450): a, c, t, g, unknown or other
  misc_feature (450)..(450): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaaacaaaaacctggccagactcccaggctcctcatctatgatgcatcccaccgagggccactggccactcccagccaggttcaggtggcaggtgggtctgggacagacttcactctcacatcagcagcctagacgcctagaagtattttgctagtttattactgtctgctagcgtagacacgtgacctaacnccgttcggaccaagggacacgacgtggagtacttaaacgacgtggtacggctgaccacctattctagttccttacctacttcccttcccg

SEQ ID NO: 109549 - DNA, 664 bp, Homo sapiens
  misc_feature: GYAE6OF02I4MHU.33.70.G04.1.454.CMB.1.raw
  modified_base (203)..(203): a, c, t, g, unknown or other
  misc_feature (203)..(203): n is a, c, g, or t
  modified_base (347)..(347): a, c, t, g, unknown or other
  misc_feature (347)..(347): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaanacgccaccctctcctgcagggccagtcagagtgctggcagcaacttgcctaggtaccaaacaaaacctggccagacctccaggcctcctacactccagtcggtgcactccaccgtagggacccacgtggaccacgtcccagacncggttacagtcggacaggtcggtctacgggacagtacttcgattctacaccactcgacgcctaggaccgtaggacgaccgttaggaaacgttagttttacggacttaggttacgttaacttaccgttagtaccgagtacgttaggttaaccggttattaccgtacgttaccgttacccggtacgtttaccggaccgtaacggggaacctaagggtaggtaaaacctacgaaaaccggtcgttaggtacggactacggaccaacgtacgttacgttacggtccctttacgaaccgttcccgttaccccgtacttaacg

SEQ ID NO: 109550 - DNA, 554 bp, Homo sapiens
  misc_feature: GYAE6OF02G9OXT.33.70.G04.1.454.CMB.1.raw
  modified_base (202)..(202): a, c, t, g, unknown or other
  misc_feature (202)..(202): n is a, c, g, or t
  modified_base (438)..(438): a, c, t, g, unknown or other
  misc_feature (438)..(438): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttagcctggtaaccaacaaaaacctggccagactcccaggctcctcatctatgatgcatcccaccgacgggcccacgtcggcatcccagccaggttcagtggcaggtgggtctgggacagtacttcactctcacatcagcacgcctagacgcctagaagtatttgcttagtttattactgttctgcagtcgtanccaacgtcggacctaactaccgttcggaccgtaagggaccacgacgtggaatacgttaaacgacgtggtcggtctagacctacctagttcttacgttcttactacgttccctcccg

SEQ ID NO: 109551 - DNA, 566 bp, Homo sapiens
  misc_feature: GYAE6OF02GHDN4.33.70.G04.1.454.CMB.1.raw
  modified_base (203)..(203): a, c, t, g, unknown or other
  misc_feature (203)..(203): n is a, c, g, or t
  modified_base (411)..(411): a, c, t, g, unknown or other
  misc_feature (411)..(411): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtctttgtctccaggggaaangccaccctctcctgcagggccagtcagagtgctggcagcaacttagcctggtaaccaacaaaaacctggaccagactcccaggctcctcatctatgatgcactccaccgacgggcccacgtcggcactcccagcctaggttcaggtggcaggtgggtctgggacagtacttcactctcaccatcagcacgcctagcgccgtagaagtntttgctagtttatactgtctgctagcgtagctaacgtcgaccttaacgcccttcggaccaagggaccacggactacgggaactaacgttaaacgaacgttggtacggtactcgacctaacctagttccttgttccttacacttcccgttaccccg

SEQ ID NO: 109552 - DNA, 535 bp, Homo sapiens
  misc_feature: GYAE6OF02FSQY3.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccggccaccctgtctttgtctccaggggaaagagccaccctctcctgcagggccagtcagagtgctggcagcaacttagcctggtaccaacaaaaacctggccagactcccaggctcctcatctatgatgcatccaccagggccactggcatcccagacaggttcagtggcaggtgggtctgggacagacttcactctcaccatcgacagactggagcctgaagtattttgctagtcttattactgtcagcagtatacgtggggagtacggttcggaccgaagggaccgaagggtaggaaatacgaaacgaacgtggtaggctgacaaccgatctgtcttctatcctcccgccactcctgtaacg

SEQ ID NO: 109553 - DNA, 762 bp, Homo sapiens
  misc_feature: GYAE6OF02I38LA.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcgagagtgcgtggacagactaacgttacgccgtacggtaaaccaaaaccgtaaaaccgtcggaccaacgaccctacccgacggtcctacctactacttctaagtcgatcgactacctacccgaaccggacgggaccctacgtcggacctacctacccgacgtaccgtaggttcgaggtcggcgtagggtcgggtcgtagggacctaacggttaccttacgtaccttactaccaacctacgtacgaacgaccgtaacgtaccgtaaggaccgtaccggtaagttaaacggtttacttttcggaacttttaacgttttaacgttacgttacgttcgtacgtacggtacggttaccgtaactacggtaaccggtaccggtaacccttaaccgtacccggttaccgggaaccggtaaacgggtaaccgaccggttaaggaacgggtaaacgttaaccgttaaacggtaacggttgggttaacgcgtaccgaccctacgtacttccgttacgttaccttacttaccgttcccgttacccg

SEQ ID NO: 109554 - DNA, 737 bp, Homo sapiens
  misc_feature: GYAE6OF02F251N.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggagggaactgctcagttaggacccagagggaaccatggaagccccagctcagcttctcttcctcctgctactctggctcccagataccaccggggaaattgtgttgactacagtctccagccacctgtctttgtctccaggggaaancgccaccgtctcctgccagggccagtcagagtgctggcagcaacttacgccttggtaaccaacaaaaacctcggaccaagacctcccaggcctccgtcactctatgatgcactccaccgacgggccacgtcggccactcccagccgtaggttccaggtcggcgtaggtgggtcgtgggacaggtacttcactcctccaacctactcgacgccacgtcccgtaaggacgtcccgtaggtaaacgtttacgtttttacgaccgtttaaggtttttaacctttaaccgtttggtttaccgttggtacccgtaacggggttccgttaacggtacccgttaaaccggttccgggtaacccctttaaacccgtaaccccggtttccggggaaccccgtaaacgggggaaccctaaccgggtaaccgtaggggaacgttaacgttaaaccgggaacgtttcgggtaaccggtaccgttcggacccacccgttacgttccgtttaccgttccgtttaccgtaccgtttcccgtttaccccgg

SEQ ID NO: 109555 - DNA, 569 bp, Homo sapiens
  misc_feature: GYAE6OF02IQBQV.33.70.G04.1.454.CMB.1.raw
  modified_base (201)..(201): a, c, t, g, unknown or other
  misc_feature (201)..(201): n is a, c, g, or t
  modified_base (415)..(415): a, c, t, g, unknown or other
  misc_feature (415)..(415): n is a, c, g, or t
  modified_base (449)..(449): a, c, t, g, unknown or other
  misc_feature (449)..(449): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccaggggaaanagccaccctctcctgcagggccagtcagagtgctggcagcaacttgcctggtaccaacaaaacctggccagactccaggctcctcatctatgatgccatcccaccgacgggcccacgtcggccactccccaagcctaggttcaggtggcaggtgggtctcggggactaggacttcactctacaccatcagcacgcctagacgccgtagaagttntttgacttagtttatacgtgttctgcagtcgtanctaacgtcggacctaacgaccttcggaccgaagggaccacgacgtaggaactacgttaaaccgagtcggtacgacgttcgacctacgtacttcgtagttccttactactcccgttacccg

SEQ ID NO: 109556 - DNA, 527 bp, Homo sapiens
  misc_feature: GYAE6OF02FKZPN.33.70.G04.1.454.CMB.1.raw
  modified_base (202)..(202): a, c, t, g, unknown or other
  misc_feature (202)..(202): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
  modified_base (447)..(447): a, c, t, g, unknown or other
  misc_feature (447)..(447): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaacaaaaacctggccagactcccaggctcctcatctatgatgcatccaccagggccacgtggcactcccagccaggttcagtggcagtggtctgggacagacttcactctcaccatcagcagcctagacgcctgaagtatttgacttagtttattactgttctgcngcgtanctaactgtaccctaacnccgttcggaccaaagggcacgagtcggaagattaaacgacgttgtacggctgcactactctgttccttctactcctcccg

SEQ ID NO: 109557 - DNA, 588 bp, Homo sapiens
  misc_feature: GYAE6OF02GX43L.33.70.G04.1.454.CMB.1.raw
  modified_base (202)..(202): a, c, t, g, unknown or other
  misc_feature (202)..(202): n is a, c, g, or t
  modified_base (372)..(372): a, c, t, g, unknown or other
  misc_feature (372)..(372): n is a, c, g, or t
  modified_base (401)..(401): a, c, t, g, unknown or other
  misc_feature (401)..(401): n is a, c, g, or t
  modified_base (439)..(439): a, c, t, g, unknown or other
  misc_feature (439)..(439): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttagcctggtaaccaaacaaaaacctggaccagacctcccaggctcctcatctatgatgcatccaccgaggccactggcactcccagccaggttcagtgcaggtgggtctgggacagtacttcactcncacatcagcagcctagacgcctagaagtntttcgacttagtttattacttgtctgacgtagtcgtanaccgtaacgtcggacccttaacgtcccgttacggaccgtaagggacctacgaacgtaggtaacgtaacgttaaacgtacgtggttacggacttacggacctaccgtacgttccgttacgttcctttacctacgttaccccgttaccccg

SEQ ID NO: 109558 - DNA, 555 bp, Homo sapiens
  misc_feature: GYAE6OF02HI9O5.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttagcctggtaccaacaaaaacctggccagactcccaggctcctcatctatgatgcatccaccagggccacgtggcactcccagccaggttcagtggcaggtgggtctgggacagacttcactctcaccatcagcagcctagacgcctagaagtattttgacttagtttattactgttctgctagcgtagctaacgtcggtacctaacgccgttcggaccgaagggacacggactaggaatagttaaacgacgttggtacggtctacgaccaaccgtacttccgtacgttcttactacttcccgttacccg

SEQ ID NO: 109559 - DNA, 568 bp, Homo sapiens
  misc_feature: GYAE6OF02HW4K7.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttagcctggtaaccaacaaaaacctggaccagacctcccaggctcctcatccatggtgcatccaccagggccactggcactcccagacaggttcagtggcagtggtctgggacagacttcattctcaccatcagcagactggagcctagaagtattttgctagtgtattactgtcagcagtacggtagttcattccgtccgtacgtttccggaccgtaagggaccctaaagggtacggaaactacgaaaccggtacgttggtacggcttacgacctaacccgtagttccgtcgttcctttacactttccctttccccgcctacg

SEQ ID NO: 109560 - DNA, 514 bp, Homo sapiens
  misc_feature: GYAE6OF02HNGWM.33.70.G04.1.454.CMB.1.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
  modified_base (393)..(393): a, c, t, g, unknown or other
  misc_feature (393)..(393): n is a, c, g, or t
  modified_base (417)..(417): a, c, t, g, unknown or other
  misc_feature (417)..(417): n is a, c, g, or t
  modified_base (436)..(436): a, c, t, g, unknown or other
  misc_feature (436)..(436): n is a, c, g, or t
  modified_base (468)..(468): a, c, t, g, unknown or other
  misc_feature (468)..(468): n is a, c, g, or t
  modified_base (483)..(483): a, c, t, g, unknown or other
  misc_feature (483)..(483): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccaggcaccctgtctttgtctccaggggaaanagccaccctctcctgcagggccaatcagagtgttagcagtaacttagtctggtaccaanatagacctgaccaggctcccaggctcctcatctacgatgcgtaccaacgagggccacgtggccatcccagccaggttcagtggcagtggtctgggacagacttcactctcacatcagcaactgacttgaatnttttcattttatactgtacaactntcacggcagctgctctctnttcggcgaggactaaggtggagctacaaacgntgacgctagccactntctcgtctctactccttacccgatctcgtag

SEQ ID NO: 109561 - DNA, 567 bp, Homo sapiens
  misc_feature: GYAE6OF02G0K1F.33.70.G04.1.454.CMB.1.raw
  modified_base (202)..(202): a, c, t, g, unknown or other
  misc_feature (202)..(202): n is a, c, g, or t
  modified_base (407)..(407): a, c, t, g, unknown or other
  misc_feature (407)..(407): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttgcctggtaaccaaacaaaaacctggaccagactcccaggctcctcatctatgatgcatccaccgagggccacgtggccactcccagccaggttcaggtggctaggtgggtctgggacagtacttcactctccacatcagcacgcctagacgcctagaagtntttcgcttagtttactactgttctgactagtcgtagcacgtcggtacctaacgccgttccggaccgtaagggaccacggacgtggaagtacgttaaacgacgttggtacggtctacgacctacctacgttccgttgttaccttctacgttcccttccccg

SEQ ID NO: 109562 - DNA, 617 bp, Homo sapiens
  misc_feature: GYAE6OF02HAVLP.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttagcctaggtaccaaacaaaaacctggaccagacctcccaggcctcctcatctatgatgaacactccaccgacgggccacgtggaccactcccacgccacggttcagtggcaggtgggtctgggacagtacttcactctaccaccatccagcacgccgtagacgtcctaggaagttattttagcttaagttttacttacgtgttctgcagtcgtacgctaacgtcggtacctaaccgtaccgttaccggaaccgtaagggacctacggtaccgtaggtaaacgtacgttaaaacggaccgttagggtcggtacgtacgaccctaaccgtacttccgttacgttccctttacgacgtttccccgttaccccgg

SEQ ID NO: 109563 - DNA, 611 bp, Homo sapiens
  misc_feature: GYAE6OF02I5VXI.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttgcctggtaaccaacaaaacctggaccagacctcccaggctcctcatctatgatgcatccaccgagggcccacgtggcactcccagccaggttcagtggcaggtgggtctgggacagtacttcactctcaccatcacgcacgcctaaggacgtcctaggaagttattttgacttagttttacttacgttgttctgcaggtcgtaagctaacgttcggaccttaaccgtacccgttacggacccgaaacgggtaccaacggtacgtacgggaactaacgttaaaaccggacgttggtaccgggtacttaccgacctaacccgtacgttccgttacggttcctttacctactttccccgttacccccg

SEQ ID NO: 109564 - DNA, 583 bp, Homo sapiens
  misc_feature: GYAE6OF02GNXX0.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaaccaaacaaaaacctggccagacctcccaggcctcctcatctatgatgcactcccaccgacgggccacgtcggcactcccagccgtaggttcagtggctaggtgggtcgtgggacagtacttcactctacactatcagcacgcctagacgcctaggaggtattcgtgtactagttttaacttacgttcgtacagcagtccgtctacctaacgtcggtcccttccgtcgtaccgtacccgttcgggaccgtaaacggggaccacggtagttcggagtaagttaacgacgtaacgtggtcggctcgtccctaccctcgtcgtccttacg

SEQ ID NO: 109565 - DNA, 578 bp, Homo sapiens
  misc_feature: GYAE6OF02F6CNM.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccagggggaanagccaccctctcctgcagggccagtcagagtgctggcagcaacttagcctggtaccaacaaaaacctggccagactcccaggctcctcatctatgatgcatccaccgagggccacgtggcactcccagccaggttcagtggcagtgggtctgggacagactcactctcaccatcagcagcctagacgcctagaatatttgacttagtttatacgtgttctgcagtcgtagcaacgtcggacctaacgaccgttacggaccgtaaacgggaccaccggtacgtagggaacgtaacgttaaaacggtacgttggtacgggtacctacggacctaaccgtacttccgttacgttcctttacctacttcccgttaccccg

SEQ ID NO: 109566 - DNA, 588 bp, Homo sapiens
  misc_feature: GYAE6OF02IC5SW.33.70.G04.1.454.CMB.1.raw
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (358)..(358): a, c, t, g, unknown or other
  misc_feature (358)..(358): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccaggggaangccacctctcctgcagggccagtcagngtgctggcagcaacttagcctggtacccaaacaaaaacctggaccagacctcccaggctcctcatctatgatgcatcccaccagggccactggcactcccagccaggttcaggtgcaggtggtctgggacngacttcactctcaccatcagcagcctagcgccgtagaagtattttgacgttaagttttattaactgttaccgtgtaccgtagacggttagacctaacgttcgggtacccttaaacgtacccgtttccgggaaccgtaaagggacccacggtaacctagggaataaccgtttaaacgacgtggtacggctacggaccacgtatcgtacgtttctacgtacttccctccccg

SEQ ID NO: 109567 - DNA, 568 bp, Homo sapiens
  misc_feature: GYAE6OF02IZE0V.33.70.G04.1.454.CMB.1.raw
  modified_base (202)..(202): a, c, t, g, unknown or other
  misc_feature (202)..(202): n is a, c, g, or t
  modified_base (400)..(400): a, c, t, g, unknown or other
  misc_feature (400)..(400): n is a, c, g, or t
  modified_base (443)..(443): a, c, t, g, unknown or other
  misc_feature (443)..(443): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttgcctggtaccaacaaaacctggccagactcccaggcctcctcatctatgatgcatccacgacgggccacgtggcactcccacgcctaggttcaggtcggcaggttgggtctgggacagtacttcgactctcaccatcacgcacgcctaggacncctagaagtatttgactagtttactactgttctgcagtcgtancacgtcgacctaacgtccgttcggaccgaacgggctacggacgtagggaagtacgttaaaacgtacgtggtacggtactacgaccgtaacacgttcgttcgttccttactacctccgttaccccg

SEQ ID NO: 109568 - DNA, 552 bp, Homo sapiens
  misc_feature: GYAE6OF02HM9LD.33.70.G04.1.454.CMB.1.raw
  modified_base (431)..(431): a, c, t, g, unknown or other
  misc_feature (431)..(431): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaaacaaaaacctggccagactccaggctcctcatctatgatgcatccaccagggccactggcatcccagccaggttcagtggcagtgggtctgggacagacttcactctcaccatcagcagcctagacgcctgaaagtatttgactagttttattacttgtctgcagtcgtancaacgtggacctaacgtaccttcggaccaagggaccaacgaccgtaggagtattaaaccggaacgtcggtggactcggaccaccgtacttctcggttactttcgtacttcccgttaccccg

SEQ ID NO: 109569 - DNA, 545 bp, Homo sapiens
  misc_feature: GYAE6OF02G4A6K.33.70.G04.1.454.CMB.1.raw
  modified_base (202)..(202): a, c, t, g, unknown or other
  misc_feature (202)..(202): n is a, c, g, or t
  modified_base (388)..(388): a, c, t, g, unknown or other
  misc_feature (388)..(388): n is a, c, g, or t
  modified_base (397)..(397): a, c, t, g, unknown or other
  misc_feature (397)..(397): n is a, c, g, or t
  modified_base (427)..(427): a, c, t, g, unknown or other
  misc_feature (427)..(427): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaacaaaaacctggccagactcccaggctcctcatctatgatgcatccaccagggccactggcatcccagccaggttcagtggcaggtgggtctgggacagacttcactctcaccatcagcagcctagacncctgaagtntttgctagtttatactgtctgcagtcgtancaagtcgacctaactccgttcggaccaagggacacgaacgtggaagtacgttaaacgacgttgtacggacttcggaccacctacgtcttacgtacctttactacgttccctaccccgg

SEQ ID NO: 109570 - DNA, 607 bp, Homo sapiens
  misc_feature: GYAE6OF02F26GZ.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaacaaaaacctggccagactcccaggctcctcatctatgatgcatccaccagggccacgtggcatcccagcccaggttcagtggcagtgggtctgggacagacttcactctcaccatcagcagcctagacgcctagaagtatttgacttagtttattacgtgttctgtcaggcgttagccgtaacgttggacccttaaaccgtacccgtttccgggacccgaaacggggaccaaccggaaccgttaggaacggtaacgttaaaaccggaaccgttgggtacggtaccgtacggtaccctaacccgtagttccgttacgttacctttaccgtactttcccgttacccccg

SEQ ID NO: 109571 - DNA, 606 bp, Homo sapiens
  misc_feature: GYAE6OF02FVT0A.33.70.G04.1.454.CMB.1.raw
  modified_base (203)..(203): a, c, t, g, unknown or other
  misc_feature (203)..(203): n is a, c, g, or t
  modified_base (400)..(400): a, c, t, g, unknown or other
  misc_feature (400)..(400): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtctttgctccgaggggaaancgccaccctctcctgcagggccagtccagagtgctggcagcaacttagcctggtaaccaacaaaaacctggaccagactcccagctcctcatcatcgatcgcactcccaccgacggccacgtcgcactcccgagcctacggtcagtcggctaggtcgggtcgtgggactagtacttcgactctacacctatcgaacncacgtcctagacgtccagtaacgtactttcgacttagtttactacgttgttactgtacagtctagactacgttcggtacgttcggtaccgttcggacgtaaacgggtacctaacgggtaagaaacgtaccgaaacggtaccgtaggtcgggactacgacctaacctacgttcttacggttaccttacctactttcccgttcccgac

SEQ ID NO: 109572 - DNA, 539 bp, Homo sapiens
  misc_feature: GYAE6OF02JDVFA.33.70.G04.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (412)..(412): a, c, t, g, unknown or other
  misc_feature (412)..(412): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctntcctgcagggccagtcagagtgctggcagcaacttagcctggtaccaacaaaacctggccagactccaggctcctcatctatgatgcatccacaggccactggcatcccagccagttcagtgcagtggtctgggcagcttcactctcacatcancancctagacgctgaacgtnttttgactagtgttattactgtctancgtagtacgttagttcatcctccggtacgttcggccgtaagggaccctaaagggtcgaaactcgaaacgtacgtcggtggcttcggaccacctagtcttcgtccttctacttcccgttccgtaaccg

SEQ ID NO: 109573 - DNA, 620 bp, Homo sapiens
  misc_feature: GYAE6OF02G4HCK.33.70.G04.1.454.CMB.1.raw
  modified_base (201)..(201): a, c, t, g, unknown or other
  misc_feature (201)..(201): n is a, c, g, or t
  modified_base (423)..(423): a, c, t, g, unknown or other
  misc_feature (423)..(423): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagataccaccggggaattgtgttgacacagtctccagccaccctgtctttgtctccgaggggaaangccaccctctcctgcagggccagtcagagtgctggcagcaacttagcctaggtaaccaaaacaaaaaccgtggaccaagacctcccgaggctcctcatctatgatgacactccaccgacgggcccacgtcggacactcccacgcctaggttcaggtggcgaggtcgggtcgtgggacaggtacttcactctcacctatcagcagcctagacgctagaagttntttcgacttagtttactacttgtctgcaggtctacgactaacgtcggtacccttaacgtaccgttaccggaccgtaaacgggcctaacggtaacgtagggtaaagtaacgttaaaaccgtacggttacggtacggtaccgtacgaccgtaactacgttccgttacgtttacctttaccgtactttacccgttacccg

SEQ ID NO: 109574 - DNA, 557 bp, Homo sapiens
  misc_feature: GYAE6OF02JEXIN.33.70.G04.1.454.CMB.1.raw
  modified_base (394)..(394): a, c, t, g, unknown or other
  misc_feature (394)..(394): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccaatcagagtgttagcagtaacttagtctggtaccaacatagacctgaccaggctcccaggctcctcatctacgatgcgtccaacagggccactggcatcccagccaggttcagtggcagtggctgggacagacttcactctcaccatcagcagactggagcctagaagtntttgactagtgttattactgtcgtgctagtcgtagcaacgtcggaccttaaccgaccgttacggaccgaacgggaccaaccggacgtaggaagaacgttaacgaacgtggtcggacgtgacctaccgattcgtcgttaccttactacttcccgttcccgtacc

SEQ ID NO: 109575 - DNA, 556 bp, Homo sapiens
  misc_feature: GYAE6OF02IV20J.33.70.G04.1.454.CMB.1.raw
  modified_base (203)..(203): a, c, t, g, unknown or other
  misc_feature (203)..(203): n is a, c, g, or t
  modified_base (402)..(402): a, c, t, g, unknown or other
  misc_feature (402)..(402): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagngccaccctctcctgcagggccagtcagagtgctggcagcaacttagcctggtaccaacaaaaacctggccagactccaggcctctcatctatgatgcactccaccacgggccacgtggccactcccagccaggttccagtggcaggtgggctgggacagtactcactctcaccatcagcagcctagacgcctagaagtnttttgctaagttttactacttgttctgactaggcgtagctaacgtcggaccttaactaccgttacggaccgaagggaccacggacgttaggacgtattaaacgaacgtgtacggctagccgaactatccgtgttaccttcacttccttaccccg

SEQ ID NO: 109576 - DNA, 732 bp, Homo sapiens
  misc_feature: GYAE6OF02JB1G7.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctacctctgctccagataccaccggggaattgtgttgacacagtctccagccaccctgtctttgtcctccgaggggaaagagccaccctctcctgcagggccagtcagagtgctggcagcaacttagacctaggtaaccaaactaaaaaccgtggaccaagacctcccaagcctcctcatcctatgatgcatccaccgagggccacgtggaccactcccgacggcctacggttcaaggtggctaggttcggggtcgtcgggaacctaggtacctttacgaccttcgtaccgtaacccaacttccgaacgtccagtaccccgtaaggaccgtcccgtaaggtaaacgttacgtttttacggactttaacggtttttacttaacgttcgttaccgttgtaccgtaacggtacgttaacgaccgtaaacgttcgggtaacccttaaccgtaccgtttaccgggaccggtaaaacgggcccgaaacggtaaccggtagggtaaacggtaacgtttaaaaccgggtacgttacgggttaccggacgttaccgaacccgtaaccgttacgttccgttaccggtttcccttaccgtacccgtttacccgttcccccg

SEQ ID NO: 109577 - DNA, 558 bp, Homo sapiens
  misc_feature: GYAE6OF02FHHE4.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactcccaggctcctcatctatgatgcatccaccagggccactggcatcccagcccaggttcagtggcagtgggtctgggacagacttcactctcaccatcagcagcctagagcctagaagtatttgctagtttatacttgtctgcagcgtagctaactggacctacaccgttcggaccaagggaccacggactagggagtacgttaaacgacgttggtacggaccttacggacctaaccgtattccgttacgttacctttccgtacgtttcccgttacccccg

SEQ ID NO: 109578 - DNA, 576 bp, Homo sapiens
  misc_feature: GYAE6OF02I9RKF.33.70.G04.1.454.CMB.1.raw
  modified_base (149)..(149): a, c, t, g, unknown or other
  misc_feature (149)..(149): n is a, c, g, or t
  modified_base (345)..(345): a, c, t, g, unknown or other
  misc_feature (345)..(345): n is a, c, g, or t
  modified_base (570)..(570): a, c, t, g, unknown or other
  misc_feature (570)..(570): n is a, c, g, or t
  modified_base (573)..(573): a, c, t, g, unknown or other
  misc_feature (573)..(573): n is a, c, g, or t
tcagtacacacactcacgaccggtgctcgattttagtgtagtgtgaagggaaagggggtagggaactgctcagttaggacccagagggaaccatggaagccccagctcagcttcgtcttcctcctgctactctggctcccaggggaaanagccaccctctccgtgcagggccagtcagtagtgttagcgggtacctacgcctggtaccaacagagtacctggccaggctcccaggctcctcttctatcgatgcatccaacgacgggccactggcactcccagccaggttcaggtcggaccggtggtctgggacagacttcactctcaccatcagcagcctagacncctagaagtatttgactagttttatactgtcagcagtcgtacgcgaacgttggtcttggacgttcggaccgtaacgggaccgaaggtagaaactacgaaacgtaacgtggtacggactacgcaaccgtatctgttactctacttccttcccgactacttccgtagtaacgttgtacgtcgtacgtagacggtccgggtatagggaccgtaggtcacgtacagtgntcngac

SEQ ID NO: 109579 - DNA, 596 bp, Homo sapiens
  misc_feature: GYAE6OF02GO40X.33.70.G04.1.454.CMB.1.raw
  modified_base (447)..(447): a, c, t, g, unknown or other
  misc_feature (447)..(447): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggagaaattgtgttgacgcagtctccaggcaccctgtctttgtctccaggggacagagccaccctctcctgcagggccagtcagactgttagcagcggcttctagcctggtaccagcagaacctggccaggcctcccaggcctcctcctctatggtgcctatcccgaccacgggcccacgtcggccactcccagacgtaggttcaggtggcgtaggtgggtctggggacagtacttcactctcacatcgacagacgtggacgctagaagtagtttagctacgtacttattactgtacgagngtagttacgtacgtgggtacgtacggttcggaccgtaacgggtaccgtaagggtacggtaaacgtaacgaaacgtaacgtggtacggtacgtacgacgtaccttagttacgttcgttacttacgtactttcccgttacccgtccttacg

SEQ ID NO: 109580 - DNA, 541 bp, Homo sapiens
  misc_feature: GYAE6OF02JHJ5F.33.70.G04.1.454.CMB.1.raw
  modified_base (202)..(202): a, c, t, g, unknown or other
  misc_feature (202)..(202): n is a, c, g, or t
  modified_base (311)..(311): a, c, t, g, unknown or other
  misc_feature (311)..(311): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaacatagacctgaccaggctcccaggctcctcatctacgatcgcgtccaacgngggcccactcggcactcccagccaggttcagtggcagtgggtctgggacagacttcactctcaccatcagacctaactagaaccttgaattattttcattttatactgtacaactatcacgcagctgcctctctacgtttcggacgacggaccgtaagggtcggagctacgaaacgtactggtcggctacgctaacctattccgttgtccttcacttcccttccgctacg

SEQ ID NO: 109581 - DNA, 533 bp, Homo sapiens
  misc_feature: GYAE6OF02GH1O7.33.70.G04.1.454.CMB.1.raw
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
  modified_base (398)..(398): a, c, t, g, unknown or other
  misc_feature (398)..(398): n is a, c, g, or t
  modified_base (440)..(440): a, c, t, g, unknown or other
  misc_feature (440)..(440): n is a, c, g, or t
  modified_base (502)..(502): a, c, t, g, unknown or other
  misc_feature (502)..(502): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccaggggaaangccaccctctcctgcagggccagtcagagtgctggcagcaacttagcctggtaccaacaaaacctggaccagactcccaggctccncatctatgatgcatccaccacgggccacgtggcacgtcccagcccaggttcaggtcggctaggtcgggtcgtgggacagtacttcactctcacctatcagcagcctagacncctgaagtatttgactagtttactacttgtctgcagtcgtanacagtcgacctacgtaccgttcggacgaaggcacgagtgaatataaacgacgtgtacggtcncgtcactatcgtcgttctcacttcctacccg

SEQ ID NO: 109582 - DNA, 603 bp, Homo sapiens
  misc_feature: GYAE6OF02I2YHU.33.70.G04.1.454.CMB.1.raw
  modified_base (200)..(200): a, c, t, g, unknown or other
  misc_feature (200)..(200): n is a, c, g, or t
  modified_base (380)..(380): a, c, t, g, unknown or other
  misc_feature (380)..(380): n is a, c, g, or t
  modified_base (410)..(410): a, c, t, g, unknown or other
  misc_feature (410)..(410): n is a, c, g, or t
  modified_base (453)..(453): a, c, t, g, unknown or other
  misc_feature (453)..(453): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccacctgtctttgctccaggggaaangccacctctcctgcagggccagtcagagtgctggcagcaacttgcctggtaaccaaacaaaacctggccagacctccaggcctaccccatctatgactgcatccacgacggccacgtcggacactcccagcctaggttcagtcggcagtggtctagggacagtacttcgactcgtacacntacgagcagtcctaggactcgtagaacgtnttttggacttagtttaatacgtgtctcggtactaggtcgttanacgttaaccgtcggtaccttaaaccgtccgttaccgggaaccgtaacggaccgaacgtacgtaacggactaaacgtttaacgaacgttggtaacggcttacggaactaccgtagttccgttacggttacttcgtaccttccgtcccgtac

SEQ ID NO: 109583 - DNA, 545 bp, Homo sapiens
  misc_feature: GYAE6OF02G2FJJ.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttgcctggtaccaacaaaaacctggccagactcccaggctcctcatctatgatgcatccaccagggccactggcactcccagccaggttcagtggcagtgggtctgggacaggacttcactctcaccatcagcagcctagagcctgaagtattttgctagtttattactgttctgcagtcgtagacaacgtggaccctaacgtacccgttcggaccaagggaccacgacgtagggaagtacgttaaacgaacgttggtacggtctagaccaccgtattcctgtctttctatcccttcccg

SEQ ID NO: 109584 - DNA, 559 bp, Homo sapiens
  misc_feature: GYAE6OF02FJLVI.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaccaacagaaacctggccaggcctcccaggctcctcatccagaatgcattcaacagggccactggcatcccagccaggttcagtggcagtgggtctgggacagacttcactctcaccatcagcagccctagacgcctaggaggtattcgtgactagtttacttacgttcgtacagcagtccgtctcaactcggcccttccgtgccctaccgttccggaccgaagggaccacggtagttcggaagtaacgttaagaaccgtaacgtggtaggctcggaccctacccgtcgttccggttcttaccg

SEQ ID NO: 109585 - DNA, 624 bp, Homo sapiens
  misc_feature: GYAE6OF02HW57K.33.70.G04.1.454.CMB.1.raw
  modified_base (205)..(205): a, c, t, g, unknown or other
  misc_feature (205)..(205): n is a, c, g, or t
  modified_base (304)..(304): a, c, t, g, unknown or other
  misc_feature (304)..(304): n is a, c, g, or t
  modified_base (478)..(478): a, c, t, g, unknown or other
  misc_feature (478)..(478): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaatttgtgttgacacagtctccagccaccctgttctttgtcctccgaggggaaanacgccacctctcctgcagggccagtcaagagtcgcgtggcagcaaacgttgccgttggtaacccaaaacaaaacctggaccagacctccgaggcctccncatctatcgatgaccatccaacgaggcccacgtcggcacgtccagcctaggttcaggtgcaggtggtcgtggacagacttcgactctccacatcagcacgaccgtagacgtcgtagaacgttatttcggacttaagtttttactacgtcgttagtcgtacgaacggttcgtaanccgtaaacgtcggtaccctaaccgtacccgttcggaaccgtaaggactacgacgttagggactaaacgtttaacgacgtggtacggctaacggaccctaacgtcgttaccgttacgttaccgtttactccgttttcccgaaccccg

SEQ ID NO: 109586 - DNA, 634 bp, Homo sapiens
  misc_feature: GYAE6OF02G0ULO.33.70.G04.1.454.CMB.1.raw
  modified_base (382)..(382): a, c, t, g, unknown or other
  misc_feature (382)..(382): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactccaggctctcatctatgatgcatccaccagggccactggcactcccagccaggttcagtgcagtgggtctgggacagcttcactctcacatcagcagcctagancctagaagtatttgctagtttatactgtctagcagtcgtagtccaaacgttcggacccttaacgacccgtttaccgggaccctaaacgggggacctaaacccggtaacgtacgggtaacggtaacgttttaaaaaccgggaacccgtttagggttaccgggtaccgttacgggtaacctaaccccggttaaacgtttcccgttaccggtttacccgttttaccgttaacccgttccccgtttaaccccccgg

SEQ ID NO: 109587 - DNA, 576 bp, Homo sapiens
  misc_feature: GYAE6OF02FVFQZ.33.70.G04.1.454.CMB.1.raw
  modified_base (202)..(202): a, c, t, g, unknown or other
  misc_feature (202)..(202): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttagcctggtaaccaacaaaaacctggaccagactcccaggcctcctcatctatgatgcatccaccgacgggccactggccactcccagcccaggttcagtggcaggtgggtctgggacagacttcactctcacatcagcagcctagacncctgaagtntttgcttagtttatacttgttctgactagcgtagccaacgtcggaccttaacgcccgttcgggacccgtaaagggaccacggtacgtaggacgtaacttaaacggacgttggtacggtactacgaccctaaccgtacgttccgttagttccttacctacttcccttaccccg

SEQ ID NO: 109588 - DNA, 630 bp, Homo sapiens
  misc_feature: GYAE6OF02JG035.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttgcctggtaccaaacaaaacctggccagactcccaggctcctcttctatgatgcactaccaacgcgggaccacgtcggcactcccgagcctaggttcaggtgggcggtggtcgtgggacagtacttcactctcacatcagcacgcctagacgccgtagaagtattttacgacgttagttttacttacgtgtacgagtcgagtcgtaagcctaacgtcgggttcgttagggtacccggttcggtaccgtaaacggggaccgttaaagggtacggaaacttaccgaaacggtaacgttaggttacggaccgtaggtaacctaaccgacgttaccgtcgtttaccgttaccgtaccgttcccgtttaccccgtacctagttacccgg

SEQ ID NO: 109589 - DNA, 588 bp, Homo sapiens
  misc_feature: GYAE6OF02F3OFB.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaaccaaacaaaactggccagactccaggctcctcatctatgatgcactcccaccgacgggcccacgtggacactcccagccctagggttccaggtcggcctaggttcggggtcgtggggacaggtacttccgacctctaccaaccatccgagcacgtcctaagacgccgtagaacgttattttgacttagttattacgtgttctgcctagtcgtacgctaaacgtcggacctaacgtaccgttcggaacccgaagggaccacgtacgaggaaccgtagtaaacgtacgtgtacgctagacctacatcgtacgttctactacttcccgttcccg

SEQ ID NO: 109590 - DNA, 697 bp, Homo sapiens
  misc_feature: GYAE6OF02HS8BQ.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgcttctctggctcccagataccaccggagaaattgtgttgacgcagtctccaggcaccctgtctttgtctccgaggggacagacgccaccctctcctgcagggccagtcagagtgttagcagctaactacttagcctggtaccagacagaccaccgtggaccaggcctcccgacggcctcctcactccagtcggtcgcactcccgaaccgacgggcccaacgtcggacctaacctccccgaaggtaccgtacggttaccagggtcggacgtaagggttcggggtacgtaggggaacctaggtacctttcgactttccacctaacccgtatacgacgtacgaacgtaccgtacgggtacgtaccgtaggtaacgttagttttagacgttagttagttacttacgtagtacgtagtacgtacggttaacggttacgttacgtacgttaccgttaccgtaccggttaccggaaccgtaacgggtaaccgtaagggtaacggtaaacgtaacggtaaaccgtaacgtacggtacggtacgtacgaccgtaaccgtacgtaccgttacgttaccgttaccg

SEQ ID NO: 109591 - DNA, 544 bp, Homo sapiens
  misc_feature: GYAE6OF02GTM70.33.70.G04.1.454.CMB.1.raw
  modified_base (202)..(202): a, c, t, g, unknown or other
  misc_feature (202)..(202): n is a, c, g, or t
  modified_base (368)..(368): a, c, t, g, unknown or other
  misc_feature (368)..(368): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctcgtcctgcagggccagtcagagtgctggcagcaacttagcctggtaccaacaaaaacctggccagactcccaggctcctcatctatgatgcatccaccagggccactggcatctcagccaggttcagtggcagtgggtctgggacagacttcattcncaccatcagcagactggagcctgaagtattttgctagtgtattactgtcagcagtacggtagttcatctccgtacgtttcggaccgaaagggacctaagggtagaaatcgaaaacggtacgtggtaggcctaggcctaaccgattccgtaggttcctttacacttcccttaccccg

SEQ ID NO: 109592 - DNA, 572 bp, Homo sapiens
  misc_feature: GYAE6OF02HB87A.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttgcctggtaccaacaaaacctggccagactcccaggctcctcatctatgatgcatccaccgagggccacgtggcactcccagccaggttcagtggcaggtgggtctgggacaggtacttcgactctcaccatcagcacgcctagacgtacctagaacgttatttgacttagttttaacttcgtgttctgacagtcgtagctaacgtcgaccttaacgtacccttcgggaccgtaagggaccacggtacgtaggaagtacgttaaacgacgtggtacggctacggacctactacgttccgttagtcctttacgacttcccgtaccccg

SEQ ID NO: 109593 - DNA, 623 bp, Homo sapiens
  misc_feature: GYAE6OF02H1X5G.33.70.G04.1.454.CMB.1.raw
  modified_base (203)..(203): a, c, t, g, unknown or other
  misc_feature (203)..(203): n is a, c, g, or t
  modified_base (410)..(410): a, c, t, g, unknown or other
  misc_feature (410)..(410): n is a, c, g, or t
  modified_base (422)..(422): a, c, t, g, unknown or other
  misc_feature (422)..(422): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaangccaccctctcctgcagggccagtcagagtgctggcagcaacttgcctaggtaaccaacaaaaacctggaccagacctcccaggcctcctcatctatgatgcactccaccgacgggcccacgtcggaccactcccagccctaggttcaggtggcaggtcgggtcgtgggacagtacttcactctcaccatcgacgcacgtctagacnccgtagtaagtntttcgacttagtttattacgtgttctgctagtacgtacgactaacgtcggtacctaaccgtaccgttacggaccgtaacgggacctaacggacgtagggaacgtaacgttaaaccggtacgttacggtacggtaccttaacggaccctaaccgtaattcccgttaacgttccctttaacctaccgtttcccgttacccccg

SEQ ID NO: 109594 - DNA, 748 bp, Homo sapiens
  misc_feature: GYAE6OF02IRXJF.33.70.G04.1.454.CMB.1.raw
  modified_base (205)..(205): a, c, t, g, unknown or other
  misc_feature (205)..(205): n is a, c, g, or t
  modified_base (299)..(299): a, c, t, g, unknown or other
  misc_feature (299)..(299): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaaattgtgttgacactagtctccagccacctgttctttgactcgaaggggaaangccacctctcctgcgacgggcagtcagagtgctggcagcaacttacgcctaggtaaccaaaacaaaaccgtggaccagacctcccgaggtcccncctacatctagtcgatacgctactacccgaacggacgggaccctacgtacgggacaacttccccgaggtacccgttagggttaccgaagggttcggacgttacgggttgggttccgtaaggggaactaacggtttaaccttacgtaccgtactacctaaccttaagccgaacggtccgaacgtaccgtaaacggtaccgtaccgttaaggtaaacggtttacttttacggaacgtttaaaccgtttttaattaaccgttcgttacgtacgaacgttacggtaacgttaaccgacgtaacggtaccggtaaccctaaaccgtaccgttacccggaacgtaaacgggtaacgaccgtaacggtaaggtaacttaacgttaaacgacggttgacgtacgtagacccgtaagtccttacgttcgtacccttacgttacctcccgttaaccccg

SEQ ID NO: 109595 - DNA, 632 bp, Homo sapiens
  misc_feature: GYAE6OF02JMMB2.33.70.G04.1.454.CMB.1.raw
  modified_base (202)..(202): a, c, t, g, unknown or other
  misc_feature (202)..(202): n is a, c, g, or t
  modified_base (306)..(306): a, c, t, g, unknown or other
  misc_feature (306)..(306): n is a, c, g, or t
  modified_base (390)..(390): a, c, t, g, unknown or other
  misc_feature (390)..(390): n is a, c, g, or t
  modified_base (449)..(449): a, c, t, g, unknown or other
  misc_feature (449)..(449): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccgaggggaaanagccaccctctcctgcgagggccagtcagagtgctggcagcaacttagcctaggtaaccaaaccaaaaacctggaccaagacctcccgagcctcctcaatctangatgcatccacgaggccacgtggcactcccgagcctaggttcaggtggctaggtgggtcgtgggacaggtacttccacgttacncaaccatcacgcacgtactaagacgcctaggaagttactttgacttagtttattacgtnttctagcgtagtcgtaacgacctaacgtcggtaaccttaacccgtaccgttccggaaccgtaaacggggacctacggaaccgtacgggtaagtaaccgttaaaacggcgtttaggacggtcctaacggacccaaaccgttcgttccgtacgttacccttacgttacccgttccccgttacccg

SEQ ID NO: 109596 - DNA, 584 bp, Homo sapiens
  misc_feature: GYAE6OF02HDR8U.33.70.G04.1.454.CMB.1.raw
  modified_base (411)..(411): a, c, t, g, unknown or other
  misc_feature (411)..(411): n is a, c, g, or t
  modified_base (423)..(423): a, c, t, g, unknown or other
  misc_feature (423)..(423): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaagagccaccctctcctgcagggccagtcagagtgctggcagcaacttagcctggtaaccaaacaaaaacctggaccagacctcccaggctcctcatctatgatgcatccaccgagggccacgtcggcactcccagcctagggttccaggtggcgaggtgggtctgggacagtaccttcactctaccaccatccacgcacgccctaggacnccgtagaagttntttgacttagttttactacgtgttctgacagcgtagccgtaactcggacctaccgtccgtacggaccgaacggacacgtacgaggagtaacgttaacgacgtggtacgtacctgacctacgtacttaccgttgttacctttactaccgttcccttaccccg

SEQ ID NO: 109597 - DNA, 559 bp, Homo sapiens
  misc_feature: GYAE6OF02GRCFJ.33.70.G04.1.454.CMB.1.raw
  modified_base (410)..(410): a, c, t, g, unknown or other
  misc_feature (410)..(410): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaaacaaaacctggaccagactcccaggctcctcatctatgatgcatccaccagggccacgtggcactcccagccaggttcagtcggctaggtgggtctaggggacagtcttcactctacaccatcagcagcctaagacgcctagtaaacgtnttttgacttagtttacttacgttgtctgctagcgtacgcaacgtgacctaactacgttcggaccgaagggacacgagtggaatacgttaacgacgtggtacggctacgacctacctagttcctacgttactacctcgttacccttcccg

SEQ ID NO: 109598 - DNA, 620 bp, Homo sapiens
  misc_feature: GYAE6OF02H7BF0.33.70.G04.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccacctgtctttgctcgaggggaaangccacctctcctgcagggccagtcagagtgctggcagcaacttagcctggtaaccaaacaaaaacctggaccagacctcccaggcctccncatctatgatgcatccaccgacggccacgtgcactccagccaggttcagtgctaggtggggtctagggacacgtacttcgactcctacacctatcagcagtcctaagacgtcccgtaggtaaactagttttgacttagttttacttacgttgtcgttacgcgtagtcgtaacactaacgtcggtaaccctaacgtacccgttcggaaccgaaacggggaccaaccggtaacgtacgggtaagtaaaccgttaaaccggaacttgggtaccggtactacgtaccctaacctagttccgtacgtttccgttaacccttcgtccccgttcccg

SEQ ID NO: 109599 - DNA, 596 bp, Homo sapiens
  misc_feature: GYAE6OF02GYP3P.33.70.G04.1.454.CMB.1.raw
  modified_base (285)..(285): a, c, t, g, unknown or other
  misc_feature (285)..(285): n is a, c, g, or t
  modified_base (462)..(462): a, c, t, g, unknown or other
  misc_feature (462)..(462): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggagaagttgtgttgacgcagtctccaggcaccctgtctttgtctccaggagaaagagccaccctctcatgccagggccagtcagatatagcatcttctggcctggtaccaacagaacctggccaggctccagcctccncatccaagaatcgacatttaccaacgtacgggccctaacgcgggtaccacttccccgaacggcccgtaaggtttccgaggttcggccgtagggtcgggtcgtggggacaggacttcgactctcaccatcagcacgccgtaagcgacctggagtattcgtgcgttatttattactgtnacgtcaggtccttctactaccgtcggtcccgtcgtcgaccctaccggtccggaccgaagggtaccacggtagttcgggaacgttagtacggtaacgtacgttacggtcgtaccgtccgaccgttcccttgtccg

SEQ ID NO: 109600 - DNA, 678 bp, Homo sapiens
  misc_feature: GYAE6OF02JIENK.33.70.G04.1.454.CMB.1.raw
  modified_base (199)..(199): a, c, t, g, unknown or other
  misc_feature (199)..(199): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaattgtgttgacacagtctccagccacctgtctttgctccaggggaaangccacctctcctgcagggccagtcagagtgctggcagcaacttgcctggtaccaacaaaactgccagactccaggctcctcatctatcgatcgcactccaccgacggccacgtcggacactcccgacgccgtaggttccaaggtcggaccgtacggttgggtaccgtgggtactacggtaccttacgacttcgtacctacccacgttcgacgtcgtaacgtcccgtaaaggaccgtaccgtacggtaaacggttacttttacggactttaacggttttacttaccggttcgttacgtacgtacgtacggtacgtacgtacctaacggttcggtacccttaaaccgtccggttacggaccgtaaacgggttcaaccggtaccgtagggaacctagttaaaccggcgttacgggacggtacgtaacggacctaccgtacttaccgtacgttaccgttaccgttaccttcccgttaaccccg

SEQ ID NO: 109601 - DNA, 528 bp, Homo sapiens
  misc_feature: GYAE6OF02FEZ30.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactcccaggctcctcatctatgatgcatccaccgagggccactggcactcccagccaggttcagtgggcggtgggtctgggacagtacttcactctcaccatcagcagccctagacgcctgaagtattttgctagtttatactgtctgcagcgtagcaactgacctacaccgttcgaccgaagggaccacgacgtggtaagacttaacgaactgtggctgccaccgatcttgtccttcacttccttcccgacc

SEQ ID NO: 109602 - DNA, 664 bp, Homo sapiens
  misc_feature: GYAE6OF02H21NO.33.70.G04.1.454.CMB.1.raw
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (487)..(487): a, c, t, g, unknown or other
  misc_feature (487)..(487): n is a, c, g, or t
tcagtacacacactcacgaccggtgctcgatttagtgtagtgtgaagggaaagggggaggaactgctcagttaggacccagagggaaccatggaagccccagctcagcttctcttcctctgctactctggctcccagataccaccggggaaattgtgttgacacagtctccagccaccctgtctttgtctccgaggggaagacgccacctctcctgcagggccagtcagagtgctggcagcaacttgcctggtacncagcacacncgcgcgagcctcgagcctctancacngtggcnctaccaccacggacggacctacggacgcctaccgtaccgagtacgtacgttacgaggtcggactagggtcggtcgacggtacaacgtcttaagtcttaccgactacgtacgtcgacgacgtaacgtacggtagaccgtacgtaaggtaacgttacgttcgtacgttacggttacgtttacgtttacggtnttacgtagtacgttaacgggttaacggttacgtacctaccgttaccgtaccggttacggttaccggaacggtaaaccgggaaccgtaagggtaacgttaaacgtaacgtaaaacggtacgttacggtacggttacgacggtaaccacgttcgttactttacgttacctagttacccg

SEQ ID NO: 109603 - DNA, 588 bp, Homo sapiens
  misc_feature: GYAE6OF02HCD35.33.70.G04.1.454.CMB.1.raw
  modified_base (201)..(201): a, c, t, g, unknown or other
  misc_feature (201)..(201): n is a, c, g, or t
  modified_base (257)..(257): a, c, t, g, unknown or other
  misc_feature (257)..(257): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaattgtgttgacacagtctccagccaccctgtctttgtctccaggggaaangccaccctctcctgcagggccagtcagagtgttagcggtaccagcctggtaccaanagagacctggccaggcctcccaggctcctcttctatgatgcactccaacagggccacgtggccactccccagcctaggttcaggtggcggtgggtctgggacagacttcgactctcaccatcgagcacgccgtagcgcctagaagtagttttgacttagtttattacttgtcagtcgagcgtagcaactggtcgttacggtcgttacggaccgtaacggggaccgtaagggtacgtaaagtacgaaacgtacgtaggtacggagttcggaccgtacctactccgttacgttccttccgtacttcccttacccgccttacgtccgttaacgg

SEQ ID NO: 109604 - DNA, 588 bp, Homo sapiens
  misc_feature: GYAE6OF02GX7NZ.33.70.G04.1.454.CMB.1.raw
  modified_base (201)..(201): a, c, t, g, unknown or other
  misc_feature (201)..(201): n is a, c, g, or t
  modified_base (398)..(398): a, c, t, g, unknown or other
  misc_feature (398)..(398): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccaggggaaangccaccctctcctgcagggccagtcagagtgctggcagcaacttgcctggtaccaaacaaaaacctggccagactcccaggcctcctcatctatgatgcatccaccagggccactggcactcccagccaggttcagtggcagtgggtctgggacagtacttcactctcacatcagcagcctagacgccgtagaagtntttgcttagtttatactgtctgcagtcgtagcaacgtcggacccttaacgacccgttcggaccgtaaacggggacctacggtaacgttagggaacgtaacgtttaaaaccggacgttagggtacggtacccgttacggaccctaacccgtagttccgtagtttcccttacgtacttcccgttacccccgg

SEQ ID NO: 109605 - DNA, 736 bp, Homo sapiens
  misc_feature: GYAE6OF02I644K.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaanagccaccctctcctgcagggccagtcagagtgctggcagcaacttgcctaggtaaccaacaaaacctggaccaagacctcccaggtcctacctcattctaatgacttcgacctactacccaccgtacggggaccctacgtcgggacctactccccgaaggtcccgtaagggtttccgacggttcgggaccggtaaggttccgggggttaccgttacgggggaaacctacggtaccgtttacccaacgttccgttacccaacccgtacgttaaccgacgtaacccgtaggaccccttaaggacgtacccgtacggtaaattacgttttacgacctttaaggtttaacttccgttaggttcgtcgaccttaggtcgtacgacccgtaacgtttcggaacccttaacgtcccgttacggacccgaaaggggtaccctacggtaacgtagggaactaacgttaaaccggacgttaggacgtccgtagaccgtaacgctttaacgtccggttacctttaccaccgttcccgttacccgg

SEQ ID NO: 109606 - DNA, 760 bp, Homo sapiens
  misc_feature: GYAE6OF02JV6UA.33.70.G04.1.454.CMB.1.raw
  modified_base (206)..(206): a, c, t, g, unknown or other
  misc_feature (206)..(206): n is a, c, g, or t
  modified_base (746)..(746): a, c, t, g, unknown or other
  misc_feature (746)..(746): n is a, c, g, or t
tcagtacacacactcacgaccggtgctcgatttagtgtagtgtgaaggggaaagggggaggaactcgctcagttaggacccagagggaacctatggaagccccagctcagcttctcttcctctgctactctggctccctagataccaccggggaattggttcgttgacactagttctccagccaccctgtcttgtctccagggaangccacctctcgtgcagggccagtcaggacgtcgctggcagtcaacttgccttggtaccaaacgaaaacctggcctaagacctccgaggcctctcatactagtcgactaggccacgtaccaaccgacggggccctaacggtcgggaccgtacgttaccccacggtacccgtaacgggtttccgaagggttcgggaccgtaagggttacgggggttaaccgttaacgggggtaacccttaaaggggttacccctttaccggtaacctttccgttaacccggaccctaagttacccgaacggccctaaccggtacccttaaggaaccggtacccttaaggtaaacgttaacgttttacgaccttaaagtttttacttaaccgttagttcccgtttaagccgtaaaggttccgttacgaacgttaacgtccggtacttaaaccggtccgttacggaccggtaaacggacctacggtacgttaaggacgttaactaacggtacgtgggtcgtctaacgacgtaccgtaacgttctacggtctacnccgttaccgtcccg

SEQ ID NO: 109607 - DNA, 650 bp, Homo sapiens
  misc_feature: GYAE6OF02HGU9L.33.70.G04.1.454.CMB.1.raw
  modified_base (234)..(234): a, c, t, g, unknown or other
  misc_feature (234)..(234): n is a, c, g, or t
  modified_base (397)..(397): a, c, t, g, unknown or other
  misc_feature (397)..(397): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgttctttgtctccgaggggaaagacgccaccctctcctgcagggccagtcagngtgctggcagacaacttagcctaggtaaccaaaccaaaaaccgtggaccaacggacctcccaggcctcctacatctatgatgccactccaccgacgggacccacgtcggctactccgacgtccgtaggtcaggtcggataggttgggtcgtggacagtacttntacttcgcaaccntcancgacgtacgtggacgtcgtacgtaaagttgtttcgacgttagtacttacgttacttcgtacagttcgtaagttacggtacttacacgttaccgtccggtacgttccggaaccgtaaacggggtaaccgtaagggtaacgtaaacgtaacgaaacgtaagttacgggtacgtacgtacgtacccgaacgttacgtaccttacggtttaccttaccgtacgtttcccgtccccgtacg

SEQ ID NO: 109608 - DNA, 594 bp, Homo sapiens
  misc_feature: GYAE6OF02HVTA3.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggagaaagagcccaccctctcatgcagggccagtcagagtattagcatcttcttggcctggtaccaacagaaacctggccaggcctccaggctcctcatccagaatgctatcaacgcgggccacgtggcactccagcctaggttcagtggcgaggttgggtctgggacagtacttcacctctacacctatcagcagcctaagacgtccgtaggacggtacttcgtgtacttagttttacttacgttcgtccagtccgtaggtcgtacgaccgtaacgtcgggttacgttcgggtaccgtttccggggaaccaaaggggtaccgaaggggttagaaactaccggaaacgtaaccgtgggtacgccgtagacctacgtacgttcgtacgttccttactaccg

SEQ ID NO: 109609 - DNA, 561 bp, Homo sapiens
  misc_feature: GYAE6OF02F2FKS.33.70.G04.1.454.CMB.1.raw
  modified_base (202)..(202): a, c, t, g, unknown or other
  misc_feature (202)..(202): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttagcctggtaccaacaaaaacctggccagactcccaggctcctcatctatgatgcatccaccagggccacgtggcactcccagccaggttcagtggcaggtgggtctgggacagtacttcacttctacaccatcagcagcctagngcctgaacgtnttttgacttagtttatactgttctgacagcgtagctaacgtcgaccttaacgaccgttcgggaccgaaagggaccaacggactagggacgtaacttaaacggacgttgggacgtcgtacgaccaacctagttccttagtccttctacgttcccttccccg

SEQ ID NO: 109610 - DNA, 729 bp, Homo sapiens
  misc_feature: GYAE6OF02G8NP7.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaaccaaacaaaacctggccagactcccaggctcctcatccatggtgcactcccaccgacgggcccacgtcggaccactccccaagacctagggttcaggtcggcgaggttgggtcgtggggacagtactttctactttctaccaacctactccgaagccaagtacgtggggaactcccgttagaaagtttagtttttcggacgtagttacggtttaacttttaccgttgttaccgaggtaccgtaggtacccgttaaggtacctaaacggtttacgggttccgttttacggggtaccgggttttcccggggaacccggttaaacgggggacccggttaaaaggggtacgggtaaaaaccttacggtaaaaaccggtacgtttacggggttacgggtaccgtttaccgggaacctaacccgtagttccgttacggtttacctttaccggtaacctttcccgttacccccgtaccg

SEQ ID NO: 109611 - DNA, 556 bp, Homo sapiens
  misc_feature: GYAE6OF02IRG8C.33.70.G04.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (363)..(363): a, c, t, g, unknown or other
  misc_feature (363)..(363): n is a, c, g, or t
  modified_base (406)..(406): a, c, t, g, unknown or other
  misc_feature (406)..(406): n is a, c, g, or t
  modified_base (440)..(440): a, c, t, g, unknown or other
  misc_feature (440)..(440): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaattgtgttgacacagtctccagccaccctgtctttgctccaggggaangccaccctctcctgcagggccagtcagngtgctggcagcaacttgcctggtaccaacaaaacctggccagactcccaggcctcctcatctatgatgctatcccaccgagggaccacgtcggccactccccagcctaggttcagtcggcaggtgggtctgggacnggtactcactctcacatcagcagcctagacgtcctagaacgtntttcgacttagtttatactgttctgctagtctanctaacgtcggaccttaacgcccgttgaccgtaggaccacgacgtagaactacgttaaacgacgttcggcggtactcgacaccgtacttcgtacttaccgttctacttccctacccg

SEQ ID NO: 109612 - DNA, 570 bp, Homo sapiens
  misc_feature: GYAE6OF02HVAV1.33.70.G04.1.454.CMB.1.raw
  modified_base (202)..(202): a, c, t, g, unknown or other
  misc_feature (202)..(202): n is a, c, g, or t
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (414)..(414): a, c, t, g, unknown or other
  misc_feature (414)..(414): n is a, c, g, or t
  modified_base (447)..(447): a, c, t, g, unknown or other
  misc_feature (447)..(447): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttgcctggtaaccaaacaaaaacctggaccagacctcccaggcctcctcatctatgatgcactcccaccgagggccacgtcggcacgtcccaagccgaggttcagtcggctaggngggttcngggacagtacttcactctcaccatcagcagcctaagcgcctagaagtntttgactagtttactactgttctgctagcgtanacctacgtgacctaacgtccgttcggaccgaaagggtcccaacgtacgtagggaactaattaaaccgacgttggtacggctacgacacctacgtcttcgttcgttactacgtcccttaccccg

SEQ ID NO: 109613 - DNA, 686 bp, Homo sapiens
  misc_feature: GYAE6OF02GNXCE.33.70.G04.1.454.CMB.1.raw
  modified_base (202)..(202): a, c, t, g, unknown or other
  misc_feature (202)..(202): n is a, c, g, or t
  modified_base (433)..(433): a, c, t, g, unknown or other
  misc_feature (433)..(433): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccaggtcagagtgctggcagcaacttgcctggtaccaacaaaacctggccagacctccaggctcctcactctatcgatgacactcccaccgacgggcccacgtcggcactcccagccgtaaggttcaggtcggacgaggttcgggtcgtcgggactagtacttacactcctacacctatccacgacacgtcctaaggcgtccgtagaagttnttttacgacttaaggttttacttacgttgttactcggtacgtacggtacgttaacgacctaaaccggttcgggtaacccttaaacccgtacccgtttaaccgggaacccgtaaacggggaccctaaaccggtacgtacgggtaacgttaacgtttaaaaccggaacggtttcggtaccgggtaccttacggacccgtaaccgtacgtttaccgttacgttacctttaccgtacccttcccgtttaacccccgg

SEQ ID NO: 109614 - DNA, 616 bp, Homo sapiens
  misc_feature: GYAE6OF02HIFZO.33.70.G04.1.454.CMB.1.raw
  modified_base (200)..(200): a, c, t, g, unknown or other
  misc_feature (200)..(200): n is a, c, g, or t
  modified_base (421)..(421): a, c, t, g, unknown or other
  misc_feature (421)..(421): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccaggggaangccaccctctcctgcagggccagtcagagtgctggcagcaacttgcctggtaaccaacaaaaacctggaccagacctcccaggctcctcatctatgatgcactccaccgagggcccacgtcggcactcccagccaggttcaggtgggcgggtgggtcgtggggacacggtacttcgacctctccaccactcacgcacgcccgtaggacgcctaggaacgtnttttacgacgttaagtttacttacgtgttaccaggctaacggtcgtacgctaacgttggttacgttcgggtacgtttccgggaccggtaaacgggtaccgtaaaggggttagaaaacgttaccgaaacgacgttggtacggcttacgaccgtactacgttcctacgttccttctaactttcccgttccgtctacg

SEQ ID NO: 109615 - DNA, 680 bp, Homo sapiens
  misc_feature: GYAE6OF02HA3CA.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactccaggctcctcatctatgatgcatccaccagggccactggcactcccagccaggttcacggttgggcgtaggtcggtcggtacgggacgacgttacctactaccttcctaccaacctactacgacgacgaccgtacgtacgaccgtacgtaaggtaagtttagtttcgacgtttaacgttttaacttacgttcgttacgtcgtacgtacggtacgtacgaaccgtacggtaccggtaaccctaaccgttacccggttaccggaaccggtaaccggaaccgtaaccgtacggtaacgggtaacgttaaacgtaaacgtacggtcgggtacgtaccggtaccgtacctaaccgttacgttaccgttacgtttacccgttacttacccgttaccccttaccccgg

SEQ ID NO: 109616 - DNA, 594 bp, Homo sapiens
  misc_feature: GYAE6OF02FVHYF.33.70.G04.1.454.CMB.1.raw
  modified_base (430)..(430): a, c, t, g, unknown or other
  misc_feature (430)..(430): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaaacctggccagactcccaggctcctcatctatgatgcatccaccgagggccacgtggccactcccagcccgaggttcagtggcgagtgggtcgtgggacagacttcactctcaccatccagcagcctagacgcctagaagtattttgacttaagtttattacgttntctgtcgagtcgtagtcctaacgtcggacccttaaaccgaccgtttccgggaaccgtaacggggaccaaccgtacgtaggtaacgtaacgttaaacgaacgttggtacggtacctcgtaccgacctacgttccgttagttcctttacaccttccgttacccccg

SEQ ID NO: 109617 - DNA, 728 bp, Homo sapiens
  misc_feature: GYAE6OF02JLVVQ.33.70.G04.1.454.CMB.1.raw
  modified_base (205)..(205): a, c, t, g, unknown or other
  misc_feature (205)..(205): n is a, c, g, or t
tcagtacacacactcacgaccggtgctcgatttagtgtagtgtgaagggaaagggggaggaacgtgctcagttaggacccagagggaaccatggaagccccagctcagcttctcttcctcctgctactctggctcccagataccaccggggaaattgtgttgacacagtctccagccaccctgtctttgtctccgaggggaaagngcccaccctctcctgcacgggccagtcagagtgctggcagcaacttgccgtggtaaccaaacctaaaaacctggaccagacctcccgaaggcctccgtcacttacctatacgatcgcactcccaccgacggccacgtcggaccacctcccgacgccgtacggttcgaacggtcggacgtaggttcggggtccgtagggacctaggtaccttcgacttcctcacccatccagcacgcctagacgtacctaggtaattagtttcgacgttaacgttttacgttacgttgttccgtgtaccgtacgtaccgttaacgtaccttaaaccgggtcgttaaccccttaaaccgttacccggttaccgggaaccggtaaaccggggaaccttaaaccggtacggtacggtaaacgttaaccgtttaaaaccgggaccgtttagggttaccggtacctaccggtaacctaaccgttacgttaccggtttacgttacccgtttaccgttaccgtttccccgttaacccccgg

SEQ ID NO: 109618 - DNA, 762 bp, Homo sapiens
  misc_feature: GYAE6OF02F18S9.33.70.G04.1.454.CMB.1.raw
  modified_base (223)..(223): a, c, t, g, unknown or other
  misc_feature (223)..(223): n is a, c, g, or t
  modified_base (319)..(319): a, c, t, g, unknown or other
  misc_feature (319)..(319): n is a, c, g, or t
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
tcagtacacacactcacgaccggtgctcgatttagtgtagtgtgaagggaaggggaggtaacttgggctcgaggttaggacccacgagggaaccagtcggaacgccccagctcgagcttcgtcgttccctcctgctactcctgggcctcccagataccaccggggtaattcggttcgttggaccacagtctccagccaccctgtctttgtctccaggggtaanacgccaccctctcctgcgtacgggcctaggtcaggagtgactggcagcaactttgccgtggaccaacaaaacgtggccagacctccgaggctcctnatcatcgatacgacacgtcccaaccgcggccacgtcggacacgtcccagcctaacggttccaggttacgggcgtacgggtccgggtcgtagggtaacacggtaccttacggacttacgtaccgaaccgtntcggaacgacacgttcccaggtacncccttaaggaacttgttttaccgacgttaaggtttactacgttggttacacggttacgtacgggtctttaacggctttaaaccggttgtaacccgttaacgacccgtttccgggaaccggaacgttaaccccgttaacggggtaccgtaacgggttaacggtaacccgttaaaaccggggaccgtttacggggtaaacggttcccgtaacggtaacccgtaaacccggttacgtttaccgggttcccggttaaccggtttacctacccgttaccccgtttaaccccgg

SEQ ID NO: 109619 - DNA, 619 bp, Homo sapiens
  misc_feature: GYAE6OF02H70K4.33.70.G04.1.454.CMB.1.raw
  modified_base (199)..(199): a, c, t, g, unknown or other
  misc_feature (199)..(199): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaattgtgttgacacagtctccagccaccctgtctttgctccaggggaangccaccctctcctgcagggccagtcagagtgctggcagcaacttagcctaggtaccaacaaaacctggccagactccaggctctcatctatgatgcatccacgacgggccacgtggcactcccagccgaggttcagtggcaggtgggtctgggacagtacttcactctcacactcagcagcctaagacgtcctagaacgttattttgacttaagttttaacttacgttacggttcttacggccgtaggtacggtacgaccgtaacgtcggtaacccttaacgtacccgtttacgggacccgtaaaggggtaccaacggtacgtaggtaacgtaacgttaaaccgaacgttggtacggtccgtacgacccgtaccgtacgttcgttacgttccgttttactaccgttcccgttacccccgg

SEQ ID NO: 109620 - DNA, 729 bp, Homo sapiens
  misc_feature: GYAE6OF02JI5BV.33.70.G04.1.454.CMB.1.raw
  modified_base (199)..(199): a, c, t, g, unknown or other
  misc_feature (199)..(199): n is a, c, g, or t
  modified_base (438)..(438): a, c, t, g, unknown or other
  misc_feature (438)..(438): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccacggggaattgtgttgacacagtctccagccacctgttctttgctcgaggggaaancgccacctctcctgcagggccagtcagagtgctggcagctaacttgcctggaaccaaactaaaactcggaccagacctccaggcctcctcatctatgatcgacactaccaccgtagggcccaacgtcggaccaccgtcccagacccgtacggttccgacggtggtccgtaggttcggggtaccgttacggggacctacggtacccttccgtaaccgttaccgtaaccgaaacccgttanaccggtacgaaccgaccggtacccgtaacggtcggtaccgttaaggtaaacggtttcttttcgggacgttaaggttacgtttaacgtttaccggttcgttacgtacggtcccgtaaagggtttacccggttacgttacgttaaccttccggtttaaccggtacggttacccgggtaaccggtaaacggggtcccggtaaaggtaacggaaacttaaccgaacgtaacgtcggtagtacttacgacttaccctggtacttccgttaccgttacctcttaccgttccccgtac

SEQ ID NO: 109621 - DNA, 723 bp, Homo sapiens
  misc_feature: GYAE6OF02F6N4Z.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggaaanacgccaccctctcctgcagggccagtcagtagtgttaggcggtacctagcctggtaccaacagacgaccgtggccaggcctccaggtcctccttcttctatgatcgcactccaacgtacgggcctacgtcggacctacgtccccagacccgtagggttccagggttccggggcgggttacgggtccgttacggggaacacggtacctttccgaaccttcctaccacctattcacgactagtcccctaaggaccgtccgtagtaaacgttgtttttacgacgtttaagttttaactttacgttagttaccgagtacgtaggtaccgtaacgactaagtcggtttacggttacggtaccgggttaccggaccgtaaacggggtaacgtaaggggtacgtaaaacgtaccggaaaacggtacgttacggtacggtcgtacggtaacccgacctaacgttcctttacggttacccttaccttaccttccccggtttaccccgtaccgttacgttaccgttaagg

SEQ ID NO: 109622 - DNA, 589 bp, Homo sapiens
  misc_feature: GYAE6OF02IUP4H.33.70.G04.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaangccaccctctcctgcagggccagtcagngtgctggcagcaaacttagcctggtaaccaaacaaaaacctggaccagactcccagctctcatctatgatgcatccaccagggccactggacatcccagccaggttcagtgcagtgagtcgtggacagacttcactctacaccatcagcagcctagacgcctagaagtattttgctaagtttattacgtgtactcgactagcgtaaggctaaacgtcgggacccttaaactacccgttacggaacccgtaaagggaccaacggaaccgtagggtaacaacgtttaaaacggaacgtttcggtaggtaccttacggaccaacctacgttccgttacgttcctttacgaccttaccccgg

SEQ ID NO: 109623 - DNA, 638 bp, Homo sapiens
  misc_feature: GYAE6OF02GN3RE.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaagngccacctctcctgcagggccagtcagagtgctggcagcaacttagcctaggaaccaaacaaaacctgaccagactcccaggctcctcatctatgatgcatccaccagggcccacgtcggcactcccagcctaggttcaggtcggactaggtgggtacgtgggacagtacttcacgtttctacctaccataccagtaccagtacgtagggacgtccgtaggtaacgtagttttgacgtagttacgttattacgttgtactagccgtaagtacggttagttctagttccgttaccgtaccggttacggacccgtaagggaaccgtaagggtaacgtaaacgtaccgaaacggtacgtacgggtacgtaccgtacggtaaccaacccgtattaccgttacgttccgtttactaccgtttccccgttaccccggtaaccg

SEQ ID NO: 109624 - DNA, 580 bp, Homo sapiens
  misc_feature: GYAE6OF02F4YJC.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtctttgtctccaggggaaangccaccctctcctgcagggccagtcagagtgctggcagcaacttagcctggtaaccaaacaaaaacctggaccagactcccaggctcctcatctatgatgcactccaccgagggccacgtcggcactcccagccaggttcagtggcgaggtgggtctgggacagtacttcactctcaccatcagcacgcctagcgtcctagtaagttatttgacttagtttatacttgttctgctagcgtagactaacgttcggaccttaccgtacccgttcgggaccgtaaacgggaccaacggtacgtaggaacgtaacgttaaacgacgtggtacggctacgacctaccgtattccgttgttacttactacttcccgtaccccg

SEQ ID NO: 109625 - DNA, 720 bp, Homo sapiens
  misc_feature: GYAE6OF02FQ4BP.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaagagccaccctctcctgcagggccagtcagagtgctggcagcaacttagcctaggtaacccaaacaaaacctcggaccagactcccaggcctcctcatctatgatcgacactccaccgacgggcccacgtcggcactcccagcctaggttcgaggtcggacgaggttcggggtcgtaggggactaggtacttctattccgtaccaacctactacgacgacaagtacgtagggacgtccgtaaggtaaacgtttcgttttacggacgttaaggttacgtttaactttacggttacggttactaacggtaccttaacggggtttaaccggtttacttaccgtaccggtttacccgttacccgggttaaccggttttcccgggaaccggtaaacgggggtaaacccgtaaagggttaacgggtaaaacttaccgaaacggtaaccggttgggtaccggacgttaccgtaaccgtaaccgtattccgttcgttaccgttactaccttacccgttcccgtaacc

SEQ ID NO: 109626 - DNA, 666 bp, Homo sapiens
  misc_feature: GYAE6OF02IS4GE.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggcctcccagactaccgaccgggaattgtgtgacacagtctccagccacctgtctttgtcctccgaggggaanacgcctacctctcctgcgagggccaggtcagagtgctggacaagtcaacgttcgcctaggtaaccaaacaaaaaccgtcggaccgaagacctcccgaggctacctacatctaactagatcgctaactcccaaccgacggccaacgtcggacctacgcccgacgtccgtaagggttcacggtggcgtaacgtcgggtcgtacgggaacctaggtcctttacgccttcgtacgaccagtcgaacgcaacgacccgttaagacgtaccgtaagtaagtttacgttcgtacggtttacttttaacgttattagtccttgacgttaacgcgttagcttaacgtcgaaccttacaccgtcggtaaccgaggtaccgacgtacgtagaccgtaagttaacgacggtcggtaaggtccttaaaggcctaacttacgtacgttccggttacttactaccggttccctacccgg

SEQ ID NO: 109627 - DNA, 819 bp, Homo sapiens
  misc_feature: GYAE6OF02HXOM3.33.70.G04.1.454.CMB.1.raw
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccgggaaattgtgttgacacagtctccagccaccctgtctttgtctccgaggggaaanagcccacctctccngcagggccagtcagagtgcgtggcagcaacgttagcctaggaccaaacaaaacctggccagactcccaggctcctcactctatgatgcctactccaccgacggccacgtggacctactcccgacgacccgtaggttcaggtcggacgtacggttcggggtccgtacggggaactacggtaaaccgtttccgaacccttacgttaccgaaacccctagttaaccgaacgtacgtaacgtacccgttaacgggacgtaccccggttaagggaaacggtttaatttttcggacctttaacggttttttaacgtttaaaccgtttacgggtacctttcgggtaccgtacggttaccgggttaacgtaacccgtaaacggtttacccgggaaccccttttaaaacccggtacccccggttttaccgggaaccccgtaaaacggggtaaccctaaacccggtaacgggtacgggtaaacgttaaaccgtttaaacccgggtaaaccgttgggttaaccgggtaccgttaccgaacccgttaacccaccgtttaccgttccggttttaacctttaccccggttacggtttaccccctttaaccccccggg

SEQ ID NO: 109628 - DNA, 628 bp, Homo sapiens
  misc_feature: GYAE6OF02G7YJE.33.70.G04.1.454.CMB.1.raw
  modified_base (390)..(390): a, c, t, g, unknown or other
  misc_feature (390)..(390): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaccaacaaaacctggccagactcccaggcctcctcatctatgatgcatccaccgagggccacgtcggccactccccagcccgtaggttcagtggcgaggtgggtctgggacagtacttcactcctccacatcgancgacgccgtagcgccgtagtaagtattttgcttaagttttacttacgttgttcgtcgcgacgtcgtacgactaaccgttcgacccttaaccgtccgttacggacccgtaaacggggaacctacggtacgtacgggtaactaaacggttaaaccggacggttcgggtacggtaccgtcggtaaccctaccgttacgttccgttagtttaccctttacctaccgtttcccgttacccccg

SEQ ID NO: 109629 - DNA, 671 bp, Homo sapiens
  misc_feature: GYAE6OF02G4EL4.33.70.G04.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (290)..(290): a, c, t, g, unknown or other
  misc_feature (290)..(290): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggagaagttgtgttgacgcagtctccaggcaccctgtctttgtctccgaggggaaangccaccctctcctgcagggccaatcagagtgttagcagtaacttgtctggtaccaanatagacctgaccaggcctccaggcctcctnatctacgatcgacgtaccaacgcgggccacgtggcacgtcccagccgtaggttcaggtcggctaggttcgggtctcggggactaggtacctttcgacttcgtaccacccgtatccgaacgtaccctaaaccgttaacgtaacgtttacgtaaacgtttaattttttacgtaattttttaacttacttacgttacctaactactacgacggtcagtcgtacggtcctacgtctacggtttccggacgggtacggaaccggtagggtcgacgtccgttaacgaaacgggtaccttacgggtcggtaccgtacgaccgtaaccgtacttccgtttaccgttactttccgtacctttcccgttaccccggtcttaccgttaccgg

SEQ ID NO: 109630 - DNA, 584 bp, Homo sapiens
  misc_feature: GYAE6OF02GIKGT.33.70.G04.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagngccaccctntcctgcagggccagtcagagtgctgggcagcaacttagcctggtaaccaaacaaaaacctggaccagactcccaggctcctcatctatgatgcatccacagggccactgcatcccagccaggttcagtggcagtgggtctgggacagtacttcactctacaccatcagcagcctagagcctagatagtttgacgtagtttactacgttgtactgacaggtactacgactaacgtggtaccctaactaccgttcgggaccaagggacgacgacgttaggaagtaacttaaaccggacgttggtaccggtaccgttaggacccgtaacctacgtttacgttcggttcctttaaccgtacttccccgttaccccg

SEQ ID NO: 109631 - DNA, 616 bp, Homo sapiens
  misc_feature: GYAE6OF02GEMJ9.33.70.G04.1.454.CMB.1.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (388)..(388): a, c, t, g, unknown or other
  misc_feature (388)..(388): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagttctccagccaccctgtctttgtctccaggggaangccaccctctcctgcagggccagtcagagtgctggcagcaacttagcctggtaccagcagacacctggccaggcctcccgaggctccncactccagtggtcgcactccgaccgacgggaccctagtcggactacgtccccgaagaccaggtttcaggttcggctagggtcgggtacgtgggaaccngtactttcattcccgtacaccgatacgacgaccagacgtggacgccgtagaacgtatttcgactagttgttacttacgtgtacagtcgtaggttacgttacgttactacgtccgttcgtacggttccgaccggtaacgggaccgtaagggtacgtaacgtacgaaacggtaacgtaggttacggcgtaccgtacgtaccgtacgttcgttcgttcttacgacttcccg

SEQ ID NO: 109632 - DNA, 738 bp, Homo sapiens
  misc_feature: GYAE6OF02IQSUJ.33.70.G04.1.454.CMB.1.raw
  modified_base (201)..(201): a, c, t, g, unknown or other
  misc_feature (201)..(201): n is a, c, g, or t
tcagtacacacactcacgaccggtgctcgatttagtgtagtgtgaagggaaagggggaggaactgctcagttaggacccagagggaaccatggaagccccagctcagcttctcttcctcctgcctactctggctcccagataccaccggggaaattgtgttgacacagtctccagccaccctgtctttgtctcagggaagngccaccctctcctgcagggccagtcagagtgctggcagacctaacttacgccgtacggtaaccaaaacctaaaaaccgtcgggaccctaaggaaccctaccccgaacggtccctccctacacttcctagtagattgacctactcccgaaccgacggggaccctaacgtcggccactcccgacgccgtacggttcaggtcggcgaggttcggggtcgtagggtacacgtacttacgtacctcgtaccacactccgacgtcacgtaccgtagaacgccgtaggtaagtattttcggactttaagttttacttaccgttggttcctcggtactacggtacgttacgaccgtaacgtcggtacccttaacggtacccgttacggaaccgtaaacggtacccgaccggtaaacgttacgggttaaacggtaacgtttaaaaccggtaacgggttaacgggttcggtaccgttacgaacccgttacccttaggttacccttttccggttacttttaccccgtaccgtttaccccttaccccgg

SEQ ID NO: 109633 - DNA, 633 bp, Homo sapiens
  misc_feature: GYAE6OF02H60B1.33.70.G04.1.454.CMB.1.raw
  modified_base (344)..(344): a, c, t, g, unknown or other
  misc_feature (344)..(344): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (473)..(473): a, c, t, g, unknown or other
  misc_feature (473)..(473): n is a, c, g, or t
  modified_base (583)..(583): a, c, t, g, unknown or other
  misc_feature (583)..(583): n is a, c, g, or t
  modified_base (620)..(620): a, c, t, g, unknown or other
  misc_feature (620)..(620): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccgggaattgtgttgacacagtcctccacccaccctgtctttgtctccgaggggaaagagcccaccctctccctgcgaggccaatcagagtgttagacagttaacttatccgtaggtaccaacatacgacctgaaccaggcctacccaggcctcctcattcctacgattggccgtaccaacgacggccacgtcggacacnccccgagtcccgtaggttcagggtcggactagggttcgggtctagggaccagtcctcacgtctcgactncanccaaactagaacttagaagttactttttacttaatttttactactagttacaacctnttacgacgactacgtctcggtaccttctaccgtacggtttcgggaccggtaaccggggactaacgggtggaacgttcgtaacgaaaccgtagttcgacgtctacgtaccncgtactcgtccgtttactcgtaccttcctcccgactnttacgagttacgg

SEQ ID NO: 109634 - DNA, 653 bp, Homo sapiens
  misc_feature: GYAE6OF02G2H2M.33.70.G04.1.454.CMB.1.raw
  modified_base (165)..(165): a, c, t, g, unknown or other
  misc_feature (165)..(165): n is a, c, g, or t
  modified_base (204)..(204): a, c, t, g, unknown or other
  misc_feature (204)..(204): n is a, c, g, or t
  modified_base (388)..(388): a, c, t, g, unknown or other
  misc_feature (388)..(388): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacanagtctccagcccaccctgtctttgtctcgaggggaaagngccacctctcctgcagggccagtcagagtgctggcagcaacttgccttggtaaccaaacaaaaacctggaccagactcccgaggcctacctcatctactgaatgacactccaccgagggcccaacgtggcactcccagcctaggttcaggtggctaggtcgggtctgggaccagacttcattcnccaacatcacgactacgtacgtcggacgtccgtagtaacgttagttttgacgttagttacgttaattacgttgtaccgtaggtaccgtaggttaaccgggttatttcaacgttccgtaccggttaccggttaccggtacccggtaaagggtaaccgtaagggtaacgaaacttaaccgaacgttaacggtggtaacgggtaccttacggaaccctaacgtattacgttacgttacctttaccgtacgtttcccgtccccgtaccg

SEQ ID NO: 109635 - DNA, 745 bp, Homo sapiens
  misc_feature: GYAE6OF02IVS45.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctcgctccagactaccgaaccgggaattgtgttgacactagtctccagcccacctgttctttcgtctcgaagggaagcgaccaccctctccgtgcgacgggcctagtcaggagtcgcgtcggctacgacctaacttacggaccttaacggtaaccaaaaccgtaaaaaccgtaccggtaccgaacgtacctacccgacggtaccgtacctactactactatagtactacgactactaccgaccgacggaccgtacgtacgaccactaccgtacgtacgtacgttacgtacgtacgtacgtcggtcggtacgtacggacgtacgtacttactacggggggggggggggtactaccacctactacgacgacgacgtaccgtacgtacgacgtagtagttagttacgtacgttaagtttacgttacgttcgttacgtcgtacgtacgtacgtacgtaccgtacgtaccgtaaccgttaaccgtaccgttaaccggtaacggtaaccgggtaacgtaacgtaacgtacggtaacgtaacgtaacgtaacggtacggttacggtacgtacggtacctacgttacgttacgttaccgttactaccgttaccgttaccgtacccg

SEQ ID NO: 109636 - DNA, 896 bp, Homo sapiens
  misc_feature: GYAE6OF02IEHNT.33.70.G04.1.454.CMB.1.raw
  modified_base (206)..(206): a, c, t, g, unknown or other
  misc_feature (206)..(206): n is a, c, g, or t
  modified_base (255)..(255): a, c, t, g, unknown or other
  misc_feature (255)..(255): n is a, c, g, or t
  modified_base (886)..(886): a, c, t, g, unknown or other
  misc_feature (886)..(886): n is a, c, g, or t
  modified_base (893)..(893): a, c, t, g, unknown or other
  misc_feature (893)..(893): n is a, c, g, or t
  modified_base (895)..(895): a, c, t, g, unknown or other
  misc_feature (895)..(895): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccaggggaaagagccaccctctcctgcagggccagtcagagtgttagcgggtacctagccgtggtaccaacngagacctggccaggcctccaggctcctcttctatgatgcactccaacgngggcccatggccaactccccgaagccgtagggttacaggttcgggcggggttcggggtccgtagggggacctaggtacctttcgattttcccgtaccaaccgtactccgaacggcctaaaggtacggtacggggtaacgtcccgttaggtaaaaggtttactttttacggctttaaaggtttttttaaccttaacggtttcgttaaccgacggtaaccgtaagggttaacccggttaacggtaaccgttaaacccgggttttggggttttacccggttttaacgggggttaacccggggtttttcccggggaaaccccgggtaaaaaccggggggttaaacccgggtaaaacggggtttaaacggggtaaaaacctttaaacccgggaaaaaaccgggttaaaccggtttaggggtaaccgggttacggttaccggtacccgtaaacccgttaacgtttccgttacggtttacctttacccgttaaccgtttccccgttacccccgtaaccgtaacgtttccgttacgggtaaaaccgtttgggttacggtttcggtaaccggtttcgggaacggggtcccgggggttacggtcggggtaacccggtaaggggccggtactaacggtaagnttacggnang

SEQ ID NO: 109637 - DNA, 763 bp, Homo sapiens
  misc_feature: GYAE6OF02F1POD.33.70.G04.1.454.CMB.1.raw
tcagtacacacactcacgaccggtgctcgatttagtgtagtgtgaagggaaagggggaggaactgctcagttaggacccagagggaaccatggaagccccggctcagcttctcttcctcctgctactctggctcccagataccaccggggaaattgtgttgacacagtctccagccaccctgtctttgtctccaggggaaagagccaccctctcctgcagggccagtcgagagtgctggcagcaacttgcctggtaaccaacaaaaacctggcagacctccaggctcctcatctatgatgcactccaccgcgggaccacgtggccactcccacgccgtaggttcaaggtggactacgggttcgggttcgtcggggaactaacggtacctttaccgaccgttcctacctaaccctaacgtcccgaaacggtcctaaacggtaccccgttaaggtaccggtaccccgttaaggtaaaaccggtttagtttttacggaacgtttaacggtttttaaacgtttaaccgttacggttccggttaggtaaccgtacgggttaccgttaacgaccttaaaccggttcccgtaacccgttaaaaccgtccccggtttacgggaaccccggttaaaggggacccgttaacgggaacccgttaggggaaacgttaacggttaaaccgtaaccgttagggtacggtacgtaccggtacctaaccgtttagtccgtttacggttccttacgtcctttaccccgttccccgtaacc

SEQ ID NO: 109638 - DNA, 683 bp, Homo sapiens
  misc_feature: GYAE6OF02GICIL.33.70.G04.1.454.CMB.1.raw
  modified_base (204)..(204): a, c, t, g, unknown or other
  misc_feature (204)..(204): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtctttgtctccgaggggaaancgccaccctctcctgcagggccagtcagagtgctggcagctaacttagcctaggtaaccaaacaaaaccgtggaccagacctcccgaggcctcctcatctatgatgcactccaccgacgggcccacgtcggaccactccccgacgtaccgtacggttaccgaggtcggcgtaggtcggggtcgtaggggactacgtaccttcaccgtcctaccaacctatccgaacgccgacgtacccgtaaggacgtaccgttaaggtaacgtttattttcggacgtttaagttttacttaccgttcgttactcgacgtacgtcgttacgacctaacgtccgaacccgttaaccgtccgttaccggaccgaaacgggtaccaacggtacgtagggaacgttaacgttaaacggtacgtggtacggtaccgtacgtaaccgtaccgtacgttcgttacgtttaccctacgtaccgttcccgttaccccg

SEQ ID NO: 109639 - DNA, 867 bp, Homo sapiens
  misc_feature: GYAE6OF02H4LFQ.33.70.G04.1.454.CMB.1.raw
  modified_base (204)..(204): a, c, t, g, unknown or other
  misc_feature (204)..(204): n is a, c, g, or t
tcagtacacacactcacgaccggtgctcgatttagtgtagtgtgaagggaaaggggtaggaactgctcagttaggacccagagggaaccatggaagccccagctcagcttctcttcctcctgctactctggctcccagataccaccgggaaattgtgttgacacgagtctccagccacccgtgtcttgtctccgtaagggaaancgccaccctctacctgcacgggccagtcagagtgcgtggacagacctaacgttgccctaggtaacccaaaacgaaaaaaccgtcgaccacgtaacccgtacccgacggtcctacctacctaacttcttaagtcgtactacgacctaccgtaccgaaccggtaccggacccgtaaccggtccggtaaccctaacccggttaccccgaacggtacccgtaacggttaccgaacgggttcggacggttacgggttcggggttaccggtacgggtaaccgtacggttaacccgttaccgtaccgttaccctaaccgtaacccgtacgtaccgtaccggtacccgtaacggtacccgtaacggtaccgttaaccggtaaggtaaacgttttacgttttaccgtaaccgtttaacgttttacgtttacgttaccgtttcgttacggaccgtacgttaccggtaaccgtacccttaaccggttacggtaaccccgttaaccggttaccccgggttacggaacccggttaaccgggaaacccgtaaccggtacggtaagggttaaacgttacgttaaaccgggtacgtacgggttaaccggacccgttagtaacccgtaccgttacgttcgttacccgtttaccttaccgttaccccgttacccgtacccg

SEQ ID NO: 109640 - DNA, 750 bp, Homo sapiens
  misc_feature: GYAE6OF02HA82I.33.70.G04.1.454.CMB.1.raw
  modified_base (326)..(326): a, c, t, g, unknown or other
  misc_feature (326)..(326): n is a, c, g, or t
tcagtacacacactcacgaccggtgctcgatttagtgtagtgtgaaggggaaagggggaggaactgctcagttaggacccagagggaaccatggaagccccagctcagcttctcttcctcctgctactctggcctcccagactaccgaaccggggtaaattgtgttgaacacagtcctccagcccaccctgttcctttgtctaccgaaggggaaagcgcccaccctctcctgcgacgggccagtcaggagtgcgtggcagctaactcgcctaggtaaccaaacgtaaaacctggaccacgacctacccgaggcctcctctatctangatcacactccgaccgaggccacgtcgaccactacccgagtaccgtacgggttcaggtcggtacgtagggtcggggtcgtacgggactacgtaccttacgtacctctaccaacgtactccgacgtaccgtacggtaccgtaacggtaacgtaccgttaagggttaaacgtttagtttttccggaacgttttaacgtttttaacgttccgttaggtaccgaacgtacgtaaggtccggttaaacggccgttaaacggtttcgggttaccggttacgggtaccggttacccggggtaacgaacggggtaacgtaagggtaaccgtaaagtaaccggaaccgtaaggttcggtaacggtcctaggaccccttaccgtggtttaccttaccggttacctttaaccgtacccgttccgttaccccggac

SEQ ID NO: 109641 - DNA, 563 bp, Homo sapiens
  misc_feature: GYAE6OF02FI72Y.33.70.G04.1.454.CMB.1.raw
  modified_base (204)..(204): a, c, t, g, unknown or other
  misc_feature (204)..(204): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
  modified_base (447)..(447): a, c, t, g, unknown or other
  misc_feature (447)..(447): n is a, c, g, or t
  modified_base (492)..(492): a, c, t, g, unknown or other
  misc_feature (492)..(492): n is a, c, g, or t
tcagtacacacactcacgaccggtgctcgatttagtgtagtgtgaagggaaagggggaggaactgctcagtttaggacccagagggaaccatggaagccccagctcagcttctcttcctcctgctactctggctcccagataccaccggggaaattgtgttgacacagtctccagccaccctgtctttgtctccgaggggaaangccaccctctcctgcagggccagtcagagtgctggcagcaaacgttgcctggtaacccaaacgaaaaacctggaccagactcccaggctcctcatctatgatgcatccaccgacggccacgtggcactcccagccgtaggttcnggtgcnggtgggtctgggacagctcactctcaccancagcacgcctagcgtcaggtagttattgacttaagttacttgttgttctgtactggacgtacncaacgttcgaccttaaccctccgttacgccggtaacgactacggngtacggactagtaacgacgttaggtcgtctcgaccacttacgtctcggttactctacgttccccttacccg

SEQ ID NO: 109642 - DNA, 610 bp, Homo sapiens
  misc_feature: GYAE6OF02FWPCC.33.70.G04.1.454.CMB.1.raw
  modified_base (201)..(201): a, c, t, g, unknown or other
  misc_feature (201)..(201): n is a, c, g, or t
  modified_base (449)..(449): a, c, t, g, unknown or other
  misc_feature (449)..(449): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccaggggaaanagccacctctcctgcagggccagtcagagtgctggcagcaacttgcctggtaaccaacaaaaacctggccagactcccaggctcctcatctatgatgcatcccaccgagggcccacgtcggacactccccagcctaggttcaggtcgcaggtcgggtctggggacagtacttcgactctacaccatcagcacgcctagacgccgtagaacgtattttcgacttagttttaactcttgttactgtaccnggtcgtacgactaacgtcggaccttaaccgtccgttaccggaccgtaacgggacctacggaacgttacgggaattacgttaaaacggacgttaggtacggtacctggacctaaccggtacttccgtttaggttaccttacgttaccttcccgttaaccccg

SEQ ID NO: 109643 - DNA, 623 bp, Homo sapiens
  misc_feature: GYAE6OF02IWS8V.33.70.G04.1.454.CMB.1.raw
  modified_base (144)..(144): a, c, t, g, unknown or other
  misc_feature (144)..(144): n is a, c, g, or t
  modified_base (250)..(250): a, c, t, g, unknown or other
  misc_feature (250)..(250): n is a, c, g, or t
  modified_base (349)..(349): a, c, t, g, unknown or other
  misc_feature (349)..(349): n is a, c, g, or t
  modified_base (615)..(615): a, c, t, g, unknown or other
  misc_feature (615)..(615): n is a, c, g, or t
  modified_base (620)..(620): a, c, t, g, unknown or other
  misc_feature (620)..(620): n is a, c, g, or t
tcagtacacacactcacgaccggtgctcgatttagtgtagtgtgaagggaaagggggaggaactgctcagttaggacccagagggaaccatggaagcccagctcagcttctcttcctcctgctactctggctcccaggggaaangccaccctctcctgcagggccagtcagagtgttagcgggtacctagcctaggtaccaaaagacgacctggccaggctccaggctcctcttctatgatgcatccaancgggccatcgcactcccagccaggttcaggtggaccggtgggtctagggacagacttcgactcgtacacctatcagcaggcctagagcctagaaacgtntttcgacttagtttatctgtcagtcgagtacgtacactaagtgtacttggacgttacggacgtaacggacgtacggtaggtaaactagaaacgtagtgtaggtacctagacctacctacgttcgtacggttcttaccgtaccgtttaccttaccccggtctaacgttacgttaccggtaaggttcgttacggttacgtaacggttgtaaccggggtcgggttaacgcgggtaacggtaaccgggtccgaagttacgacggttgacngtagntcg

SEQ ID NO: 109644 - DNA, 582 bp, Homo sapiens
  misc_feature: GYAE6OF02IX96J.33.70.G04.1.454.CMB.1.raw
  modified_base (350)..(350): a, c, t, g, unknown or other
  misc_feature (350)..(350): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggaaagagccaccctctcctgcagggccagtcagagtgttagcagcaactacttagcctggtaccaacaaaaacctggccagactccccaggctcctcactctatcgattgcatccaccagggccactggcatcccagccaggttcacgtggcngtgggtctgggacagacttcgactctcaccatcagcagcctaagacgcctgaagtattttcgacttagtttacttacttgttctgcgtagcgtacgctaacgtgtaccctaacgtacccgttcggaccgaacgggacaccggtaacgtacgggagtaacgttaaaccgtaacgttggtacggcttacggacctaccgacgttcctcggttcctacgtacttcccttaccccg

SEQ ID NO: 109645 - DNA, 785 bp, Homo sapiens
  misc_feature: GYAE6OF02GPKEJ.33.70.G04.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (324)..(324): a, c, t, g, unknown or other
  misc_feature (324)..(324): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggcctcccagactaccaccggagaagttgtgtgacgcagtctccgaggcacccgtgtctttgactccgaggggaacncgccaccctntccngcgagggccaatcagagtgtancgtagtaacttgtcgtcggtaccaacagtagaccctgacccaggtcctacccgaggccttccctaccttacgtagtcgggtnaccgtaacttccccgaacccggagggacccctacgtacgggacctacgtaccccgagtacccgtagggttaccgacggttacggccgaagggtttcggggtacctagggggaacctaacggttaccctttaccgtaaccgttaccggtaacccttaacccgaaacgtttcccggaaacggtacccgttaaacggtacccgttaaacgggtaccggttacccggttaacggttaaacggtttacgtttttaacggaacgtttaaacggttttaaccgttaccgttacgttacggttacgtaccgtaggttaccgttacgaccgtaacgtccgtaaccttaacccgtaccgtaccggtaaccgaacgggacctacggtaccgtagggtaactacgttaacgtacgtggtaacgctacgactaccgtacgtcttacgtccgttaccgtacttccctaccgtacc

SEQ ID NO: 109646 - DNA, 664 bp, Homo sapiens
  misc_feature: GYAE6OF02HU3JA.33.70.G04.1.454.CMB.1.raw
  modified_base (202)..(202): a, c, t, g, unknown or other
  misc_feature (202)..(202): n is a, c, g, or t
  modified_base (554)..(554): a, c, t, g, unknown or other
  misc_feature (554)..(554): n is a, c, g, or t
  modified_base (637)..(637): a, c, t, g, unknown or other
  misc_feature (637)..(637): n is a, c, g, or t
tcagtacacacactcacgaccggtgctcgatttagtgtagtgtgaagggaaaggggaggaactgctcagttaggacccagagggaaccatggaagccccagctcagcttctcttcctcctgctactctggctcccagataccaccgggaaattgtgttgacacagtctccagccaccctgtctttagtctccgagggaaagngccaccctctcctgcagggccagtcagagtgctggcagctaacttgcctaggtaaccaaacgaaaaccgtggacccagacctcccgaggcctcctcacttctaatcgatcgctaacgtccgaaccgacggggtccctaacgtcggccctaacgttccccgaaggaccccgtaagggtttccaaggttcggaccgtaggttcgggtacgtcgggaactacggtacttaccacgtacctaccgaacctagtacgaacgccgtaacggtaccctaaggaccgtcccgttaaagtacgtttaacgtttgaacgttacgtttttacgtactcggttaccgtgaccgtagtacggtanaccgaacgtcgtaacctacgtacccgttaggaccaaggtaccacgtacgagtaactacgttaagacgtgacgctacgacctancgttacctgtcctactctcccttaccg

SEQ ID NO: 109647 - DNA, 768 bp, Homo sapiens
  misc_feature: GYAE6OF02GQRW9.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcgagggccagtcagagtgctggcagcaacttgcctggtaaccaaacaaaactggccagacctccaggcctcctcactctatgatcgacacgtccaccgaacgggtcccacgtcggccacgtacccacgacccgtacggttacgaaggttcggacgtacggtcggggttacgtcgggtaaccgtacggtacctttccgaaccgttccctacccgtaacccgtaacgtaccgtaaccggcgtaacggttactaacggtaccgtaccccggttaaggtaaaccgttaagttttacgtaccgtttaaagttttaacttaccgtttacgttccgttacggttccaaggtccgttaacgaccgttaacggtaccggtaacccttaacccgttaccccgtttaccgggacccgtaaaacgggacccgtaaccggtaaccgtaaggggtaacgttaacgttaaaaccggtaccggttagggttacggtacccgttggtaaccctaaccggtactttacggttaccgttacctttaccgttacctccccgtttacccccgg

SEQ ID NO: 109648 - DNA, 905 bp, Homo sapiens
  misc_feature: GYAE6OF02F2Z34.33.70.G04.1.454.CMB.1.raw
  modified_base (135)..(135): a, c, t, g, unknown or other
  misc_feature (135)..(135): n is a, c, g, or t
  modified_base (138)..(138): a, c, t, g, unknown or other
  misc_feature (138)..(138): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctacctgcgtccncanacaccggaacggtatgtgtacacacgtcgtcctacgaccaccctacgttcgtttcgttcgtcctacggggaaagggaagccgacccctacctcctcgcgacgggaccgacgtacgtacgaaggtagtcggtacggtcggacgaccaacttaacgtccgtaccggttaaccggtaaaaccaaaaaaacccgtaaaccggtccgaaccggaaccgttaccccgtaaccgggaccggttaccccctttacctaacttaaccttacgtttaggacgttaccgacctaaccttaccccgaaccccggaaccggggacccgtaaccgtacgggtccgaaccttaccccgaaccgaaggtaccggttacggttacggtagggacgagggtttacggggtccggtcgggtaaccggaactacgtttaccgtactttcgttacccaaccgacttacgtcggaccgaggtaactcgggtaacggtaccgtcgtaaaggttgttttacgtcgaacggtttaggttactttaacgttcgtactacggtaacgtcgtttaaacggttggtttacctaccggttccgttacccggtaccgggtttacggggtaccccaaaaggggttaaaccgaaacggttaaacgggtaaaagtaaaccccgtaaacggtaaacgttcggtaacggggtaccgttacggaacccgtaacccgttacgtttaccgtttacgggttacccttttacctaacgttttacccccggttcccgtaacccccgtag

SEQ ID NO: 109649 - DNA, 731 bp, Homo sapiens
  misc_feature: GYAE6OF02HI8FQ.33.70.G04.1.454.CMB.1.raw
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccgaggggaaanagccaccctctcctgccagggccagtcagngtgctaggcagaccaacttaggccttagggaaccaaaactaaaaaaaccgtgggaccaagaacctcccgaacggctcctcatctaatgatgacactaccaacgacgggcccaatcggactaactccccgaagtcccgtaaggttccgaaggttcgggtcggggtacggttacggttggggaacctaggtacctttacgacttccgtacaaccgattaccgacgacgacgtacctaggaccgtaccttaaggtaaacgtagtttttacggacctaagtttttaataccggttgttacaacgttccgaaggtaccggttaacagttaaccgtgggttccttacgggtaacgttcgggaaccgaacgggtacgtaaaacgggtagaaaacgtaccgtaaaaccggacgttgggtacggtacgttaccggaaccttaacccttacgttacgttacggtttaccttccttaaaccctttccccggttccctacccgttaaccgg

SEQ ID NO: 109650 - DNA, 632 bp, Homo sapiens
  misc_feature: GYAE6OF02F9707.33.70.G04.1.454.CMB.1.raw
  modified_base (204)..(204): a, c, t, g, unknown or other
  misc_feature (204)..(204): n is a, c, g, or t
tcagtacacacactcacgaccggtgctcgatttagtgtagtgtgaagggaaagggggaggaactgctcagttaggacccagagggaaccatggaaggccccagctcagcttctcttcctcctgctactctggctcccagactaccaccggggaaattgtgttgacacagtctccagccaccctgtctttgcctccaggggaaanagccaccctctcctgcagggccagtcagagtgctggcagcaacttgcctggtaaccaacaaaaacctggccagactcccaggctcctcatctatgatgcatccaccagggccactcggcatcccagccaggttcagtcgcagtcggtctgggaccagacttcactctacaccatacagtcagcctaagacgccctaggaaacgtattttgacctaaggttttacttaaccgtgttcctggactaggcgttaacgcctaaacgttcggacccttaaaccgtaccctttacggaccccgtaaaggggaacccaaccggtaacgttgggaacgtaacgtttaaaaccggaaccgttggtacgggtcccttaggaccctaacccgtagttccttagggtacccttttacgtaacttccccgtttaaccccgg

SEQ ID NO: 109651 - DNA, 654 bp, Homo sapiens
  misc_feature: GYAE6OF02JG9YS.33.70.G04.1.454.CMB.1.raw
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (445)..(445): a, c, t, g, unknown or other
  misc_feature (445)..(445): n is a, c, g, or t
tcagtacacacactcacgaccggtgctcgatttagtgtagtgtgaagggaaagggggaggaacgtgctcagttaggaccagagggaaccatggaagcccagctcagcttctcttctcctgctactctgcctcccagataccaccgggaattgtgttgacacagtctccagccaccctgttctttcgtactccgaggggaaacgcgcccaccctctccgtgcagggcccagtcagtagtgttaggccggttacctagcccttggtaacccaacgagtacggaccctggccccgtaaggcctacccgaggcctttccctcgttactacttagatcggctactacccgaaacgtggggaccccngtcggaccnccgtccacgccgtagtccaggtcggcgtaggtcggtaccgtaggactaggtccttcaacgtcctacgaaccctanccgagacgactcgaagtacgtctagtaacgttactttgtacttagtttacttacgttacgtctgacgtagttacgtagtacctacgtcgtaccgtaagtaacccgtccgacgtaaccggtcacgtagtacggaaagttacgtaacgacgttcgtaggtcgtacgacctaactcgttatcgttctaccgtacgtcccgttaccgcctaag

SEQ ID NO: 109652 - DNA, 714 bp, Homo sapiens
  misc_feature: GYAE6OF02HPVWE.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggagaaattgtgttgacacagtctccggccaccctgtctttgtctccgaagggaanagccacctctcctgcagggcagtcagagtgtagcggtactagcctggtaccaacagacgactggccaggctccgaggcctcctcttctatgactgcactacccaacgacggccacgtcgacctacctcccgacgggtcctacgggttctaacgggtcggggtccggggttcgggttacgacggggaacctaaggttaccttccgtaactttccgtaacccaacgacttcgaacgtcgtaacggtacggtacgggacggtacctaagggtaagtttacgttttcggacgttaggttacgtttaacgttacgttcgtacacggtacgtacggttaacggttagttactaccgtcgttaaccggtacggttccggaacggtaacgggaaccgtaaggttaacggaaacctaacgaaaccgtagttaggtacgtacgtacggactaacccgtgttaccgttacgttacctttacgtaccgttccccgttacccggtacttaccggtttcgtaacgg

SEQ ID NO: 109653 - DNA, 595 bp, Homo sapiens
  misc_feature: GYAE6OF02I8VL6.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaacttagcctggtaccaacaaaacctggccagactcccaggcctctcatctatgatgcatccaccgagggccactcggcactcccagccaggttcaggtggcaggtgggtcgtgggacagacttcactctcaccatcagcacgtcctagacgtccgtagaacgtattttgacttaagttttacttactgtctgctagcgtagcctaacgtcggacccttaacgtacccgttcgggaccctaaaggggacctacggtaacgtagggaacgtaacgttaaaacggtaccgttggtacggtacctaggaccaaccgtacttccgttagttaccctttacgtacttcccgttaccccg

SEQ ID NO: 109654 - DNA, 724 bp, Homo sapiens
  misc_feature: GYAE6OF02IKO3J.33.70.G04.1.454.CMB.1.raw
tcagtacacacactcacgaccggtgctcgatttagtgtagtgtgaagggaaggggaggaacgtgctcagttaggacccagagggaaccatggaagccccagctcagcttctcttcctcctgcttctctggctcccagactaccaccggagaaattgtagttgacgcagtctccaggccaccctgtctttagtcctccgagggacagagcccaccctctcctcggcagggccctagtcacgactggttacgacacgcggtacttcttagccttagggaaccaggtccaaacggtaaacccgtgggacccaaggcccttacccgaaggccctccgttaccgtacttacgtgggtctaccactccgaaccggcgggacctacgtcggcaacgtcccgaagacgtacgtcaggtcggcaaggttcgggtcagggtactaagtcgttacacgtcctacgacccgtagtaccgacgtaacgtcgtaggaccgtaccgtaagtaacgtagttttacgacgtacgttacttaacgttacgtacgtacgtacgaaccgttagtaacgtacggtacggggtaacgtacggttaccggaacgtaacgggtaccgtaacggggtaaagaaacgtaaccgtaaacggtaccgttagggtacggtacgttacgaccgtaaaccgtcgttaccgttacgttacgtaccgttacccgttaccgttacccggcttaaccgg

SEQ ID NO: 109655 - DNA, 911 bp, Homo sapiens
  misc_feature: GYAE6OF02H3G9E.33.70.G04.1.454.CMB.1.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggcctcccagactaccgaaccggggaattgtgttgacacagtctccagcctaccctgttctttgtcctcgaaggggaaancgcctaccctctcctgacgcgggccagtcgagagtcncgtggcaagacctaacttacggcctacggtaaccaaaacctaaaaccgtcggacccagtaacccgtcccgaacggtccttacccgtacctaattaccgtagtacggaacttacggtaccaaccttaccccgggaaaccgtacgggggacccctaaccggtcgggtacccaaccgttacccccggaaacggtcccgttaaacgggtttacggtaacgggttccggtaaccggttacggggtttaccgggggacccgtttagggggaaacccttaccgtttaccccggtttaaccctaaccgggtttacccctaacccgtaaccgtaaccttaaccgggaccttaccggtaaaccggtccggtttaaacggacccgggttaaaccgttaaggttaaacccgggttttactttttaaacggaccgttttaaacgttttttaccggttaacgttaccggttacgtttaccggacgttaacgggttaaccgttacgtaaccccgtaacggtaccgtaacccgtttaccgtaacccgtttaaccggggaaccgtaaaccgggtaacctaaccggtaaggtaacggaacggttaaccgttaacgtacggtgggttaacgaccctaaggtacctaccgtacttacggtctttactacccgtcgtccctacccg

SEQ ID NO: 109656 - DNA, 590 bp, Homo sapiens
  misc_feature: GYAE6OF02ISHBW.33.70.G04.1.454.CMB.1.raw
  modified_base (213)..(213): a, c, t, g, unknown or other
  misc_feature (213)..(213): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtctttgtctccaggggaaagagccaccctntcctgcagggccagtcagagtgctggcagcaacttagcctggtaaccaacaaaaacctggccagactcccaggctcctcatctatgatgcatccacagggccactggccatcccagccaggttcagtggcaggtgggtctgggacagacttcactctcaccatcagcagcctagacgcctagaagtattttgacttagtttatacttgtctgcagtcgtagcaacgtcggaccctaacgacccgttccgggaccgaaacgggccaaaccggtaacgtgggtaagtaacgtttaaaaccgaacgttcggtaggccttacggacccgtaaccctacgttaccgttacgttacctttacgtacctttcccgttacccccg

SEQ ID NO: 109657 - DNA, 527 bp, Homo sapiens
  misc_feature: GYAE6OF02FXTPE.33.70.G04.1.454.CMB.1.raw
  modified_base (199)..(199): a, c, t, g, unknown or other
  misc_feature (199)..(199): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (392)..(392): a, c, t, g, unknown or other
  misc_feature (392)..(392): n is a, c, g, or t
  modified_base (415)..(415): a, c, t, g, unknown or other
  misc_feature (415)..(415): n is a, c, g, or t
  modified_base (447)..(447): a, c, t, g, unknown or other
  misc_feature (447)..(447): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaattgtgttgacacagtctccagccaccctgtctttgctccaggggaanagccacctctcctgcagggccagtcagagtgctggcagcaacttagcctggtaaccaacaaaacctggaccagactccaggctcctcatctatgatgcactccaacgagggccagtcggacactcccagccaggttcgagtggcgggtggtcgtcgggacngtactcactcacacntcancagcctagacgcngacgtattctgacttagttactntgtcagtcagtctactacactcggccttcgtnacctaccgttcgaccgaggcacgtgttaggatacgtagactacgtgtacgcttcggcctaccgtatcgttacctcgtaac

SEQ ID NO: 109658 - DNA, 684 bp, Homo sapiens
  misc_feature: GYAE6OF02GH1L4.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaagagccaccctctcctgcagggccagtcagagtgctggcagcaacttagcctaggtaaccaaacaaaaaccgtggaccagactcccgaggcctacctcatctatcgatgctactcccaccgacgggtcccacgtcggaccactcccgagtcccgtaggttacgaggtcggacgtaggttgggtacgtagggacacgtactcacctctacaccatacgacgacagtaccttaggacgtccgtaagtaaagttacgttttcgactttaacgttttaacttacgttacgttccgttagcgtaacggtcgtaacgtaccgtaacgtcggtaaccccttaaccgtacccggtttaccggaccgaaacggggtaccaaccggtacgtaagggtaacgtaacgttaaacggacggttggtaaccggtctaccggaaccctaacctacgttccgttacgttacctaccgttaccgttcccttaacccccgg

SEQ ID NO: 109659 - DNA, 664 bp, Homo sapiens
  misc_feature: GYAE6OF02GQIMK.33.70.G04.1.454.CMB.1.raw
  modified_base (203)..(203): a, c, t, g, unknown or other
  misc_feature (203)..(203): n is a, c, g, or t
  modified_base (644)..(644): a, c, t, g, unknown or other
  misc_feature (644)..(644): n is a, c, g, or t
  modified_base (650)..(650): a, c, t, g, unknown or other
  misc_feature (650)..(650): n is a, c, g, or t
  modified_base (657)..(657): a, c, t, g, unknown or other
  misc_feature (657)..(657): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagactaccgaccggggaaattgtgttgacacagtctccagccaccctgtctttgtctcaggggaaangccaccctctcctgcagggccagtcagagtgctggcagcaacttgcctaggtaccaacagaacctggaccaggcctccgaggcctcctcacttccaagaactggacattaccaacgccgggaccacgtcggcactcccgaaggtccgtaggttcaggtcggacgtaggtgggtcgtagggactaggtaccttcgacttcctaccacctactccgaagacctacggtaccgaaggaccgccgttaggaacgggtacttcgtaggtacgttaacggtttttacttacgttcgtacgtaacggtctacggtccgttacgttaccgtaacggttccgtacccgttaccggtcgtaacccgtaccgttacccggaccgtaaacgggtcctacggtaggttcggaacgtaagttaacggaccgtaagtcggtacggtctccgtaccnccgttnttccgtnttacccg

SEQ ID NO: 109660 - DNA, 712 bp, Homo sapiens
  misc_feature: GYAE6OF02GPRO5.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaancgccaccctctcctgcagggccagtcagacgtgcgtggcagcaacttagcctaggtaccaaacaaaaaccgtcggaccacgacctaccgaggtcctcctcatctatgactgacactacccgaccgtacggccacgtcggccactcccgagccgtaggttcaggtcggcctaggtcgggtaccgtagggacctaagtccttacgaccgttctacctaccgataccgaacgtcgtaacggtcccgtaaggcgtacccgttaaggtaacgttcgtttacggtacttaaggtttttaactacgttcggttacttggtaccgtaggtacggtacgtacccgtaacggtccggtaacccgtaaacgtacccggtaccggaacccggtaaacgggtaacctaaccggtaagtacggaacgtaaacgtaaaccggttacgttggtaaccggtacctacggtaacctaccgtacgttccggtttaccgttaaccgttccttaccttcccgttaacccg

SEQ ID NO: 109661 - DNA, 795 bp, Homo sapiens
  misc_feature: GYAE6OF02H73Z8.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgttctttgtctccaggggaaanagccacctctcctgcagggccagtcagagtgcgtggcagcaacttgcctggtaccaaacaaaaacctggaccagacctcccaggcctcctcatctatgatcgctactcccgaaccgacgggccctaacgtcggacctaccgtaccccgaacggcccgtaacggtttccgaagggttcgggaccgtagggttcgggggttaccgttaggggggaaccctaacgggttaacccttttccggaacctttccgtaccaacctaactccgaacgaccgtacgtaccgttaacgacgtacccgttaggtaaacgttttattttcggacctttaaaggtttttacttttaccttagggtttaccctttagggaccgtaacgggttcccggttaacgtaaccgtaaccggtttacccggttaccccgttaaacccgttaaccccggtttccgggaaacccggtaaacggggtaacccaacggttaacggttagggtaaacgtaaccgtttaaaccggaacgtttcggtaacgggtcttaccgaccttacccgtaagtttcccgtttagttaccctttaccgttacttccccgttaccccg

SEQ ID NO: 109662 - DNA, 736 bp, Homo sapiens
  misc_feature: GYAE6OF02IGGXZ.33.70.G04.1.454.CMB.1.raw
  modified_base (209)..(209): a, c, t, g, unknown or other
  misc_feature (209)..(209): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaaattgtgttgacacagtctccagcccacccttgtctttgtcctccgaagggggaaanagcccaccctctcctgcgacgggccagtcagagtgctggacagcaacttcgcctaggtaaccaaacaaaaccgtggaccagacctccgacggtcctcctacacttctatgatcgacactccaccgacggccacgtcggcactcccacgccgtaggtcgaggtcggcgtacggtcgggtcgtacgggaactacggtacttacaccgttctaccaacccgtataccgacgaccacgtaccgtaagacgtaccgtaggtaacgttacgtttttagactttaaggttttaacttacggttcgttaacgacgtaccgtacgggtaacgttacgaccgttaacggttcggttaccgtttcgggtaacccggttaccgggaaccgggtaaaccggggtaaccgtaaagggttaacggaaacgttaaccggtaaacggtaacggttgggtaacggttaccgtaccggaacccgttaccgtacgttaccgtttacggtttacccgttacgtaccgtttacccccggttccgtaccc

SEQ ID NO: 109663 - DNA, 664 bp, Homo sapiens
  misc_feature: GYAE6OF02FY8PL.33.70.G04.1.454.CMB.1.raw
  modified_base (199)..(199): a, c, t, g, unknown or other
  misc_feature (199)..(199): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaattgtgttgacacagtctccagccaccctgtctttgctccaggggaangccacctctcctgcagggccagtcagagtgctggcagcaacttgcctggtaccaacaaaacctggccagactccaggctcctcatctatgatgctactcccaccgagggcccacgtcggccactccccgagcccgtagggtttccaggttcgggaccgtaggtcggggtactaggggaccaggtacctttcaaccgttcctaccgaaccctattccacgaccacggaccttaacggaccgtcccgttaggaaacgtttattttacggacgttaagttttaacttaccgttcggttccttgtaccgaggttaccgtaagacctacgttccggaacccttaccgtacccgtttcgggacccgtaaacgggacaaccggtacgtagggaagttacgttaaacggacttggtacggtactcggtacaacgttacttccgttacgttacttcctacgttcccttaccccg

SEQ ID NO: 109664 - DNA, 877 bp, Homo sapiens
  misc_feature: GYAE6OF02HXY3N.33.70.G04.1.454.CMB.1.raw
  modified_base (205)..(205): a, c, t, g, unknown or other
  misc_feature (205)..(205): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagactaccgaccggggaatttgtgttgacacagtctccagccaccctgtctttgtctccgaaggggaancgcccacctctcctgcacgggccagtcagagtgctggcacggactaacgttacgccgtacggtaaccaaaacgtaaaacgtcggaccaagacctacccgaggtcctccgtcagtaccttaatgacttcgacactacccgaccggacgggccctacgtcggactacctccccgaagacccgttacggttaccgacggtcggtacgtacgggttcgggtcggtacggggtaactaccggttaccgttaccgaaccgttccccgttaccgtaaacccgtacgttaacccgacggtacccgaacggtaccgtttaacgggaaccgtaccggttaagggttaaaaccgttttcgttttttaccgggaacttttaaacggtttttaccgttttaacgtaccggttttaccgtaacggttaccggtagggtttaacccgtaacggtaaccgtttaaacggttaccccgggttaaacccttaaacccggttaccccgggttaaccgggaaacccgggtaaacgggtaaccccgtaaacggttaacccgggtacgggtaaactttaaaccggttaaaaccggttcggtaacgggtttaaccgagttacccggtaaccgtaaccgttactttacccggttacgtttccctttaaccgtaccgtttacccccgttaaccccgg

SEQ ID NO: 109665 - DNA, 806 bp, Homo sapiens
  misc_feature: GYAE6OF02II80H.33.70.G04.1.454.CMB.1.raw
  modified_base (201)..(201): a, c, t, g, unknown or other
  misc_feature (201)..(201): n is a, c, g, or t
tcagtacacacactcacgaccggtgctcgatttagtgtagtgtgaagggaaagggggaggaactgctcagttaggacccagagggaaccatggaagccccggctcagcttctcttcctcctgctactctggctcccagataccaccggggaaattgtgttgacacagtctccagccacctgtctttgtctccgagggaagngccacctctcctgcgagggccagtcagagtgctagcagcaacttgccttaggtaccaacaaaccgtggaccagacctcccgagcctaccgtacacgtactagtagacttcgactactaccccgaccgacggggtacccacggttcggccaaccgttacccgaacggtacccgtacggtttaccgaggttacggaccgttagggttccgggttaccgtaggggaacctacggtaccgtttaccacgttacccttaccgaacccttacgacccgtacgaactaccggtacccgtttacggaccggtacccgttaaggtaaacggttttacgtttttaccgggtaacgtttaacggttttaacctttaacggtttcggtttaccgtttacggaccgttacgggttacgtacggtaccgtaaacgttccgggtaacccttaaccggtacccggttacgaacccggtaagggtacccgtacgttaacggtacggtaaacgtaacggttaaacccggtcggtttacggtcggtaccgttaccgaaccgtaccgttaacggtctttaccgggttacccttaccggttacccgtttccgtaccccgttaaccg

SEQ ID NO: 109666 - DNA, 746 bp, Homo sapiens
  misc_feature: GYAE6OF02G7QQ4.33.70.G04.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtctttgtctccaggggaaangccaccctctcctgcagggccagtcagagtgcgtggcaggcaaacgttagcctaggtaacccaaacaaaaacctggacccaagacctcccaggcctccncactacattgatgcaactcccaaccgacgggccaacgtggaccacgttacccgacgaccgtagggttccgaacggttcgggcctaaggttcggggttaccggtttaggggaccgaacggtaaccttccgaaccgtttaccctacctaaccctacgtacctaacggaccgaaacggtccctaacgacggtaccccgttaaaggtaaaggttaaccgtttttaggccgtttaaaggttttttaacgttaccgttggtttaccgtacggtacgtacgggtacgtacgaccgtaacgtcggtacccttaacgtacccgttaccggaccgtaaacggggtaacaccgtaaggttcgaacgttacgttaaaaaccgtagttcggtacggtaccgttcgaccgtaaccgtacttcgttacggttacctttacgtactttcccgttaacccg

SEQ ID NO: 109667 - DNA, 572 bp, Homo sapiens
  misc_feature: GYAE6OF02FPW39.33.70.G04.1.454.CMB.1.raw
  modified_base (203)..(203): a, c, t, g, unknown or other
  misc_feature (203)..(203): n is a, c, g, or t
  modified_base (318)..(318): a, c, t, g, unknown or other
  misc_feature (318)..(318): n is a, c, g, or t
  modified_base (344)..(344): a, c, t, g, unknown or other
  misc_feature (344)..(344): n is a, c, g, or t
  modified_base (368)..(368): a, c, t, g, unknown or other
  misc_feature (368)..(368): n is a, c, g, or t
  modified_base (373)..(374): a, c, t, g, unknown or other
  misc_feature (373)..(374): n is a, c, g, or t
  modified_base (399)..(399): a, c, t, g, unknown or other
  misc_feature (399)..(399): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaaagngccaccctctcctgcagggccagtcagagtgctggcagcaacttgcctggtaccaacaaaacctgaccagactcccagcctctcatctatgatgactatcccaccgaggccacgnggcactcccagccaggttcagtggcngtgggtctgggacagcttcactcncaccnncagccagcctagacgtctagaagtntttcgcttagtttactacgttgttacctgactacgtcgtaatctaaccgttcggaacccttaaccgacccgtttaccggacccgaaagggacccacggtacagggaactacgtaaacgacgttggacgtcgtacgtcactacgtcctagttccctagttacctccgttacccg

SEQ ID NO: 109668 - DNA, 568 bp, Homo sapiens
  misc_feature: GYAE6OF02IBFCF.33.70.G04.1.454.CMB.1.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
  modified_base (469)..(469): a, c, t, g, unknown or other
  misc_feature (469)..(469): n is a, c, g, or t
  modified_base (479)..(479): a, c, t, g, unknown or other
  misc_feature (479)..(479): n is a, c, g, or t
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
  modified_base (562)..(562): a, c, t, g, unknown or other
  misc_feature (562)..(562): n is a, c, g, or t
tcagtacacacactcacgaccggtgctcgatttagtgtagtgtgaaggggaaagggggaggaactgctcagttaggacccagagggaaccatggaagccccagctcagcttctcttcctctgctactctggctcccagataccaccggggaattgtgttgacacagtctccagcccaccctgttctttgtctccaaggggaaangccacctctcctgcagggccagtcagagtgctgcagctaacttagcctaggtaaccaaacaaaaccgtggaccagacctcccaggtcctcctacactactatgactnccactccgaaccgaggccaacgtggccacgtcccagcctaggttcaggtcgcagggtcggttcngggacncggtaccttcacttccncacatcganccagtaccgtaggaccgtccgtagggatttacgtttcgacgttaagttttactctggttctncgagtcgtancagtcgacttacaccgttcggactaaggcagacgtagagtactaacgcgtgtcgntcgacncgtatcagttacctctaccgtntacccg

SEQ ID NO: 109669 - DNA, 805 bp, Homo sapiens
  misc_feature: GYAE6OF02FFGQQ.33.70.G04.1.454.CMB.1.raw
  modified_base (300)..(300): a, c, t, g, unknown or other
  misc_feature (300)..(300): n is a, c, g, or t
tcagtacacacactcacgaccggtgctcgatttagtgtagtgtgaagggaagggggaggaactgctcagttaggacccagagggaaccatggaagccccagctcagcttctcttcctcctgctactctggctcccagataccaccggggaaattgtgttgacacagtctccagccacctgtctttgtctccaggggaaagcgccaccctctcctgcagggccagtcacgagtgctcggcagcaacttgcctggtaccaacaaaacgtggccagactcccaggctcctcactccatcggtnactactccaccgacgggaccacgtcggactacgtcccaagtactaacggttcacggtcggacgaggttcgggtccttcgggggaacctacggtaaccgtttaccgtaacgtttccgtaccgtaacccgtaagttacccgaacggtaccaacgggtaaaccgttcggggaaacgtcccgttagggtaaaacggtttacttttttcgggaaccgttaagggtttaacggttaaacgtttaaccggttacggttaccaacgggtttacgtaaccgggtttaaccgggtttacgttttaaccgacgttttcccggtaccgggttaacccgggtttaccggtaaacccgggtaaacggggttaaaccccgtaaagggttaacgggtaaaacgttacccggtaaaaaccggttcgttaagggtaccgggtaccttacggaaccctaaccgttaacgttacgttaccggtttactttaccgtaccgtttccccggttacccaccgtttaacg

SEQ ID NO: 109670 - DNA, 615 bp, Homo sapiens
  misc_feature: GYAE6OF02HWUUH.33.70.G04.1.454.CMB.1.raw
tcagtacacacactcacgaccggtgctcgatttagtgtagtgtgaagggaaagggggaggaactgctcagttaggacccagagggaaccatggaagccccggctcagcttctcttcctcctgctactctggctcccagataccaccggggaaattgtgttgacacagtctccagccaccctgtctttgtctccaggggaaagagccaccctctcctgcacgggccagtcagagtgcgtggcagactaacttacgcctaggtaaccaaaacaaaaacctggaccaagacctacccaggcctcctcactctatgatgcactccacgacgggccacgtcggccactcccgacgccgtaggttcaggtcggacgtaggttcgggtcgtagggtacaggtacctttcactcctaccacctatacacgccgacgacctagacgtcgtaagtaagttactttgtactttaagtttactttacgttgttctcgacgtacgtcgtaacgctaacgtcgacctaactaccgtccgacgaacggacacggacgaggaagtaacgtaacgagtggtcgtactacgactaccgtatcgttcgtccttacgtacttcccgtacctaccg

SEQ ID NO: 109671 - DNA, 676 bp, Homo sapiens
  misc_feature: GYAE6OF02GYZY0.33.70.G04.1.454.CMB.1.raw
  modified_base (204)..(204): a, c, t, g, unknown or other
  misc_feature (204)..(204): n is a, c, g, or t
  modified_base (526)..(526): a, c, t, g, unknown or other
  misc_feature (526)..(526): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaagngccaccctctcctgcagggccagtcagagtgcgtggcagcaacgttagccgtaggtaaccaaaccaaaaccgtggaccagacctcccgaggcctcctcactctatgtatgacactcccaaccgacgggacccacgtcggaccacctccccgacggtcccgtacggtttcacggtcgggaccgtagggtcgggtacgtaggggaccaaggtacccttcgtaccttcctaccaacccgtatccgacgcacgtccgttagacgtccgtagtaacgtttatttacgacttaggttttactacgttgttcgtgacgtaggtccgtanaccgtacgtacggtacccttaacgacccggttaccggaaccgtaacgggaccgtacgacggttaggaacgtaacgttaacggtacgtggtacggtacctacgacccacgttacgttcgttacgttccttactaccgtttcccgtaccccg

SEQ ID NO: 109672 - DNA, 807 bp, Homo sapiens
  misc_feature: GYAE6OF02HZLQ0.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctccagataccgaccggggaaattgtgttgacacagtctccagccaccctgtctttgctccgaggggaaagagcccaccctctcctgcgacgggccagtcagagtcgctggcagacaacttgccgtaggtaaccaaacgaaaaacctcggaccagacctcccgaggtcctcctcactctatgaatcgacactacccgaaccggacgggcccaacgtacggacctaaccgtacccgaacggaccgtaaggttaccgacgggtcgggtcggggttacgggtcgtacggggtaactaacggtaccttaccgtaactcctaacctaaccgtaactacgaacggacgtaaccgtaccgttaaggaaccggtaccctaaggtaacgtttaacgttttacgaacgtttaaaggtttaacttacgttacggtaaccgaacggtacgtaacggtaaccgttaacgaaccgttaaccgggttagggtttacccggttaacgggttaacccgggttacccggaaacccgggtaaaagggggaacccgttaaaaggggtaaacggtaaaacgtaaccgtaaaaccgtacggttaagggtaccggtacgttaccgaaccgtaaccgttacgttacccgttacggttacccttaccgtaaaccgtttccccgttacccgaccgttaacgg

SEQ ID NO: 109673 - DNA, 653 bp, Homo sapiens
  misc_feature: GYAE6OF02GQJ2U.33.70.G04.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (343)..(343): a, c, t, g, unknown or other
  misc_feature (343)..(343): n is a, c, g, or t
  modified_base (374)..(374): a, c, t, g, unknown or other
  misc_feature (374)..(374): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccacctgtctttgctccgagggaaacngccacctctcctgcaggccagtcagagtncgtgcagcaatcgctagtacaaacaaaccgtggacctagacctccgaggcctcctctatctatgatgctatccacgacgggcctcgtgtcacgtcccgagccgtaggttccgngtcggcgtggtcggtcgtaggctagtctacnctctccacgtatcgactcgactacgagacgtccgtaagtaacgttgtttcgtaacttagttttacttcggttcgttcgtacggtatacgtaacgtcgtaacgtaccggttaccggtaaccttaaccggtaccccgttcgggaaacccgtaacgggaaccgtaccggtaagtaccggtaaagttaaccgttaacggtaacgttagggttaaccgtcggtaaccgtaaccgtacgttacgtttacccgttgtttacccttaccttccgtttacccacccgg

SEQ ID NO: 109674 - DNA, 779 bp, Homo sapiens
  misc_feature: GYAE6OF02IGKWQ.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccgggaaattgtgttgacacagtctccggccaccctgtctttgtctccaggggaaagngcccaccctctccgtagcgaggccagtcagagtgctggcagcaacttagccgtaggtaaccaaacaaaacctggaccacgacctcccgaggcctacctacatctatcgatcgacactaccgaccacgggaccacgtacggactacctacccaacgccgtacggttccgaaggtcggtaccgagggttcgggtcgtaccggggaaccgtagggtacctttaccgaccgtttaccttaccaacccgtagttaccgaccgtacccgtaacgcccggttaaccggtacacccggtacgttaaacgttcgttttacgtaccgtttaaggttttaaccgtttacgttacggttcgtttaccggaacgttacggttacccgttaagtaccgtaaccggttacccggtaaccgtttaaaccccgtacccggttaacccgggtaacggaaaccgggtcccgtaaaccggaggttaaccgaaacgttaagtaaaccggttacgtacgggttagtacccggtagtaaccccgtacgtaagttcccgttacgttaccgttctacccgtttacccgttaccccttcccg

SEQ ID NO: 109675 - DNA, 892 bp, Homo sapiens
  misc_feature: GYAE6OF02G29CV.33.70.G04.1.454.CMB.1.raw
  modified_base (200)..(200): a, c, t, g, unknown or other
  misc_feature (200)..(200): n is a, c, g, or t
  modified_base (318)..(318): a, c, t, g, unknown or other
  misc_feature (318)..(318): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagataccaccggggaattgtgttgacacagtctccagccaccctgtctttgtctccgaggggaancgccaccctctcctgcagggccagtcagagtgctggcagcaacttgcctaggtaccagcagacaccgtggccaggtcctcccgaggtcctcccgtacacttacccaggttcgggtacncctaactccccgaaccgacggggccctaaccgtcggacctaactccccgaaggtaccgtacgggtttacaacggggtttcggaccgtaaggggttcggggttaccggagggggtaacccaacgggtttaacccttttcgaaaccgttttttcccgtaacccgaaaccccgtttaacgtttacccggaaacggtacccgtaaacggtaacccggttaaggggtaacccgggtaacccgttaaggggttaaaacggtttaacggtttttacggacccggtttaaacgtttacgggtttaaacgttttaaccggtttaggtaaccgtaagggttaacccggttaacgggttaaccggggtttaacgtttaccgtaacggtttaccccgttacccgggttaaccggtttacccgggtaaacccggtaaacgggtaaaacccggttaaggggttaaccggtaaacgttaaccggtaaaaccgggttaacggttaccgggttacggtaccgttaacggtaacccgtaaccggttaccgttccgtttaccggttacctttaccgttaccgtttacccccgg

SEQ ID NO: 109676 - DNA, 891 bp, Homo sapiens
  misc_feature: GYAE6OF02F0N0C.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccaggggaaagacgccacctcctcctgacgacgggccagtcgagtagttggttaggccgggtaacctacgtccgtacgggtaacccaaacgagacgtaccgtgggaccgacgggcctacccgacggtcctcccttcttactatggtacttcgcctaactaccgaaacggaccggggacccacggtcggacctaccgtaccccaggacccgttagggttccacggggttgggggtcccgggggttgggttacggtacggggaacctaacggtttacccgttccgtaccttaccgttacccaaaccttacgttaccgaacggtcctaaccgggtacccttaagggaccggtacccgttaagggtaaacttttcggttttaacggtaaccttaagttttttaacctaggttcgtacgaacggtataaccgggtacgtacgtaaccggtaacggttccgggtttacggtttaccggggtacggtttacccggaccggtaaacgggtaaccggaaagggttaaggtaaacgtaaccgtaaaaccggtacgttacgggtcggtacgtaccggtaaccgtaccgttaacgttccgtttacgtttacccgttacccgttacctttaccccgttccccgtaaccgttacttaacgttaacggtaacggtttcggtacggttaacggttacggtacgggtacgggtaccggggtacgtacggggtaaccggaacgggtacccgtaggtacgtcggacgtctagtctg

SEQ ID NO: 109677 - DNA, 672 bp, Homo sapiens
  misc_feature: GYAE6OF02I4QDU.33.70.G04.1.454.CMB.1.raw
  modified_base (201)..(201): a, c, t, g, unknown or other
  misc_feature (201)..(201): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccaggggaanagccacctctcctgcagggccagtcagagtgctggcagcaacttagcctaggtaaccaacaaaaaccgtggaccagacctcccaggcctcctcatctatgatgcactccaccgacgggaccacgtcggcactcccacgccgtaggttcaggtcggcgtaggtcgggtcgtaggggactaacggtacttcaacttcctaccaccctactacacgacctacgaccgttaacggacgtaccccgtaaggtaaacggtttagttttacggacgtttaaacggtttttactttaacgtttcgttacgtcgtacgtacggtaccgttacgaaccgtaacggtccggtaacccttaaaccgttaccccgttaccggaacccggtaaacgggacctacggtaacgtacggaactaagttaaaccgtacgtaggtcggactgccctacgtacttcgtcttacttcttacgtcccctaccg

SEQ ID NO: 109678 - DNA, 625 bp, Homo sapiens
  misc_feature: GYAE6OF02GNHE5.33.70.G04.1.454.CMB.1.raw
  modified_base (202)..(202): a, c, t, g, unknown or other
  misc_feature (202)..(202): n is a, c, g, or t
  modified_base (420)..(420): a, c, t, g, unknown or other
  misc_feature (420)..(420): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgctccaaggggaaanagccaccctctcctgcagggccagtcagagtgctggcagcaacttagcctggtaaccaaacaaaaaacctggaccaagacctcccaggcctcctcatctaacgatgccgtacccaaacgacgggcccaacgtgggacaacgtccccagcccgtaaggttcaggtggcaggtggggtctagggacagcttacactctcaaccatcagacaacctagacncctagaatagttttgactaagtttacttactgttctgacagtacgtagacctaacgtcggaccttaaccgaccgtttccggaccgaaaggggaccaacggtacgttagggaagtaaacttaaacgaacgttgtacggccgtagacctaacctaacgttccttaggttacctttcctaactttccctacccggtacctagttaccg

SEQ ID NO: 109679 - DNA, 751 bp, Homo sapiens
  misc_feature: GYAE6OF02J0YAK.33.70.G04.1.454.CMB.1.raw
  modified_base (214)..(214): a, c, t, g, unknown or other
  misc_feature (214)..(214): n is a, c, g, or t
  modified_base (480)..(480): a, c, t, g, unknown or other
  misc_feature (480)..(480): n is a, c, g, or t
tcagtacacacactcacgaccggtgctcgatttagtgtagtgtgaagggaaagggggagggaacgtgctcagttaggacccagagggaaccatggaagccccagctcagcttctcttcctcctgctactctggctcccagataccaccggggaaattggtgttgaacacgagttcctccagcccacccctgtctttcgcctccgaggggtaaancgcccacccgtctccgtgccgacgggccaggtcagacgtgctggcagccaacttgacctggtaaccaaactaaacctcggaccaagacctcccgaggtacctccctacgaacttccgtaagtcgaacttcgaccgtaacttccccgaaccgacgggtaccctaccgtggggaccctaacctaccccggaaggtacccgtacgggtttaccgaacggtcggtaccgtaacgggtcgggttaccggtacgggacggtacgtcgtaccnccgtacgtccacgtactcgaacggtcaccggtacctagaaccggtcgttaacggaagttcttttacggactttaaagggtttcctacgttcggttactacggtaccgtagtaccgtaatacccggttaacggtaccgtaccctaaacggttcccccggttaaacggaccgggtaacgtacccgtaaaggccggttagaacggttaactaccggtacgtacggtcaccggtgaccacgttcctaatccgttaccttctacgttacctacccg

SEQ ID NO: 109680 - DNA, 639 bp, Homo sapiens
  misc_feature: GYAE6OF02II43V.33.70.G04.1.454.CMB.1.raw
  modified_base (202)..(202): a, c, t, g, unknown or other
  misc_feature (202)..(202): n is a, c, g, or t
  modified_base (256)..(256): a, c, t, g, unknown or other
  misc_feature (256)..(256): n is a, c, g, or t
  modified_base (304)..(304): a, c, t, g, unknown or other
  misc_feature (304)..(304): n is a, c, g, or t
  modified_base (546)..(546): a, c, t, g, unknown or other
  misc_feature (546)..(546): n is a, c, g, or t
tcagtacacacactcacgaccggtgctcgatttagtgtagtgtgaagggaaagggggaggaactgctacgagttaggacccagagggaaccatggaagccccagctcagcttctcttcctcctgctactctggctcccagataccaccggagaaattgtgttgacacagtctccggccaccctgtctttgtctccagggaangccacctctcctgcagggccagtcagagtgttagcggtacagcctggtaccaangagacctggaccaggctccgaggcctcctcttacatgatgcatccaancgggccagtgcactcccgagcctaggttcaggtcggcgggttcggtctagggactagtacttccactttaccgacaccctatccgagtaccgagtacccgtaaggaccgtaccgtagtaacgttacgtttttcgactttaaggttttaacttacgttcgtacgagtcgaacgtcgtacgacgtaacgtggtacgttggtaccgttacggaccggaagggtaccgtaaggtaagtaaacgtanaaaccgtacttgggacgtaccttcgactaacccgtagttacgttcgttaccgtcgttacccgttccgttacccgacgttaccttagttaacgg

SEQ ID NO: 109681 - DNA, 599 bp, Homo sapiens
  misc_feature: GYAE6OF02HB10U.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgtctttgtctccgaggggaaancgccacctctcctgcagggccagtcagagtgcgtggcagcaacgttagcctaggtaaccaaacaaaaacctcggaccagacctccgaggcctcctcatctatgatgcactcccgaccgacggaccacgtcggacactccacgccgtaggttcaggtcggcgtaggtcggtcgtcgggacagtactctactctaccactatcacgcacgcgtagacgtctagtaagttatttgacttagtttactacgtgttctgcgagtcgacacgtaactcggtaacctaccgtccgttacggaccgacggacaacggtagagtaacgtacgtaaaccgtacgttggacgtacgtaccgacctaccgtacttcgttcgttaccttacgtaccgtcccttacccgg

SEQ ID NO: 109682 - DNA, 745 bp, Homo sapiens
  misc_feature: GYAE6OF02F921W.33.70.G04.1.454.CMB.1.raw
  modified_base (204)..(204): a, c, t, g, unknown or other
  misc_feature (204)..(204): n is a, c, g, or t
  modified_base (372)..(372): a, c, t, g, unknown or other
  misc_feature (372)..(372): n is a, c, g, or t
  modified_base (383)..(383): a, c, t, g, unknown or other
  misc_feature (383)..(383): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccgggaattgtgttgacacagtctccagcccaccctgtctttgtctccgaaggggaaanacgcccaccctctcctgcgagggccagtcagagtgcgtggcagctaattacgctacggtaaccaaacaaaaccgtcggaccagacctccgagtacctcctactatctatgatcgacactacccaccgacggacctacgcggacactcccagcctaggtcgagtcgacncggttggtcgngggaactagtaccttcgacttccaccgactaactcgacgtacgacgtcctaagtacgaccgtaaggtaacgttcgttttacgacgtttaagttttaccttacgtcggtttacctacggttacgacgttaccgtacggtaaccctaacgttccgggaaacccttttaacccggtacccggtttaacccgggaacccgtaacgggtaaaccgtaaaccggttacgggtaacggttaaacgtaaccgttaaaaccgggtacggtttaaccggggagttacccgtaaccggtaacccgttaaccgtaccgtttttacggttaacccggtttaccttaccgggttaccctttaccccggttaccccg

SEQ ID NO: 109683 - DNA, 841 bp, Homo sapiens
  misc_feature: GYAE6OF02FOIDZ.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccacctgttctttgtctccgaggggaangccacctctcctgcagggccagtcagagtgctggcagcaacttagcctaggtaaccaaacgtaaaaaccgtcggaccaggacctcccgaggcctcctacacttctaatcgatcgacactacccaccgacgggccacgtcggactaccgtccacgtccgtacggttacgacggtcggaccgtaggttcggggtccgtaggggaacctacggtaccgttacgtaccgttcctaaccgtaacctacgttaccgtacgaccgtacgtacctaagggtacctaccggtaaggtaacgtttacttttacggacgtttaaggttttacgttacgtttacggttacttacgggtaccgttaaacggtccggttaaacgtaccggttaaaccgtttcgggtaaacccccttttaaaccggtacccccggttttaaccgggaaacccggggtaaaccgggttaacccgtaaaccggtaccggtttaacgggtaaaccggttttaaaacccggttaaaaccggtaacggttttaccgggtaaccgggttaacccgttacccggtaaaccgtaacccgtttaaccgggtttcggtttaacccgtttaccggttacccgtttaaccccgttccccggtttaaaccccccggg

SEQ ID NO: 109684 - DNA, 738 bp, Homo sapiens
  misc_feature: GYAE6OF02G4HA6.33.70.G04.1.454.CMB.1.raw
  modified_base (204)..(204): a, c, t, g, unknown or other
  misc_feature (204)..(204): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctccagactaccgaccggggaattgtgttgacacagtctccagccaccctgttctttgctccgaaggggaaancgcccaccctctcctgcgacgggccagtcagagtgctggcagactaacgttcgccgtaggtaaccaaaactaaaaccgtcggaccaagacctcccgaacggccttcctacactccttatagattcgacctactcccgacgtaccgggccctacggtcggaccacgttcccgacgtccgtacgggttcaacggtcggacgtaacgggttcggggtacggtacggggaacctaacggtaccctttaccgacccgttaccgtacccgaaccttactaccggtaaccgaccgtaccggtaaccgtaaccggacggttaccgttacggtaaacgttttaccgtttaggacgtttaacgttttacgtaaccggttgttaccgtagtacgtacgtacgtacgacgtacgtacggtaccctacgtacccgtacggaccgacggtactacgtacgtaggtaacgtacgttaaacgacgtcgggttctacggtccaacgtaacctcgttaccgttctaaccggtttactaccttcccgtacccg

SEQ ID NO: 109685 - DNA, 836 bp, Homo sapiens
  misc_feature: GYAE6OF02IEBG6.33.70.G04.1.454.CMB.1.raw
tcagtacacacactcacgaccggtgctcgatttagtgtagtgtgaagggaaagggggaggaactgctcagttaggaccagagggaaccatggaagccccagctcagcttctcttcctcctgctactctggctccagataccgaccggggaattgtgttgacacagtctccagccaccctgtctttgtctccgaggggaagacgccaccctctcctgcagggccagtcagagtgcgtgcagcaacttagccgtgtaaccaacaaaaacctggaccagacctccgagctctacatactatatagtgactactacccgaaccgacgggaccacgtacggtccaactaccccgagacccgtagggtttaccgaggtacggcggtaacggttcggggtaccgtaggggtaaccgtagtaaccgttcctaacgtcctaccgacctacgtcgaggacccgtacgaccgttaagtaccgtacgtttaaaggaacgttttagttttacgaccgtttaagtttttaaacgtttacttcggttaccgttacgcgttaacgggtacgttacggtaaacccaacgggtttaacccgggtaacccgttaaaccccggtttaaccccggtttaccgggtaaacccccggggtaaacgggggttaaccccgaaacgggttaacccggtacgggttaaacggtaaaaccggttttaaaaacccggttaaaccgggttccgggtttaaaccgggaccgtttccccggtaacccgttaaacccgtcggtttttaacgttaaccccgtttttaccggtttacccggtttacccctttacccggtttaaccccccgg

SEQ ID NO: 109686 - DNA, 776 bp, Homo sapiens
  misc_feature: GYAE6OF02H9E0T.33.70.G04.1.454.CMB.1.raw
  modified_base (205)..(205): a, c, t, g, unknown or other
  misc_feature (205)..(205): n is a, c, g, or t
  modified_base (763)..(763): a, c, t, g, unknown or other
  misc_feature (763)..(763): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctgctcccagataccgaccggggaaattgtgttgacacagtctccagccaccctgtctttgtctccgaaggggaaagngcccacctctcctgcacgggccagtcagagtgtccgtggacacgacaaccgttagtcccgtagggtaaacccaaaactaaaaaacccgtcggacctaacgaccgttccccgaaggccctaccctacgtacttaaccgtattggaacttcgacctacgtaccccgaaccgcgggaccctacgtcggacctaccgtccccgaacgcccgttacgggttacgtacgggtggtacccgtaagggttcggggttaccggtaggggaacccgaagtttacccgttacgtaacccttcccgttaaccaaaccctaaccgtcgaacggtaccctaccggtaccgtaacggaaccggttccgttaaaggtaaccggtttattttcgtacgttaacgttttattacgtcgttacctgaccgtagtccgtaagccttaacggtccgtaacccgttaaccgtacccggttacgaaccggtaacgaacggtacgaacgtagggtactaaacgttaacggtacgtggtaccgacttaccgaccagttcgtcctcgtttacctacggttaccncccgtttaccccg

SEQ ID NO: 109687 - DNA, 699 bp, Homo sapiens
  misc_feature: GYAE6OF02IXK0N.33.70.G04.1.454.CMB.1.raw
  modified_base (552)..(552): a, c, t, g, unknown or other
  misc_feature (552)..(552): n is a, c, g, or t
tcagtacacacactcacgaccggtgctcgatttagtgtagtgtgaagggaaaggggggaggaactgctcagtttaggacccagaggggaaccatgggaagcccccagctcagcttctcttcctcctgctactctggctcccagactaccgaaccggggaattgtgttgacacagtctccacgcccaccctgttctttgcctccgagggaaagcgccaccctctcctgcagggcccagtacagagtgctagggcagacctaacttacgccgttacggaaccaaaaccgaaaaaccgtggaccaacgacctacccgacggccttacctctacttatactacgtatcgaccactacccgaaccggtaacggccctaacgtcggacctaactccccgacgtaccgacggttaccgaggttcggacgtgggtaggtacgacgggtacgtacggtaccgttactacctcctaccaccataccgaacggctacctccggtaacaccggtacgtaagtaatttacgtttacgtatttaacgtttattacgttcgttacgngtaccgtagtcgtaacgtactaaccggtccgtaaccttaaccgtaccggtacgtaccggaaaggtccaacggtatacgacgtaagtaactacgggtgtcgtacgacgttaccacgttctacgtcgtaccgttactacgtccgtaccc

SEQ ID NO: 109688 - DNA, 673 bp, Homo sapiens
  misc_feature: GYAE6OF02HW455.33.70.G04.1.454.CMB.1.raw
  modified_base (373)..(373): a, c, t, g, unknown or other
  misc_feature (373)..(373): n is a, c, g, or t
tcagtacacacactcacgaccggtgctcgatttagtgtagtgtgaagggaaagggggaggaactgctcagttaggacccagagggaaccatggaagccccagctcagcttctctttcctcctgctactctggctcccagataccaccggggaaattgtgttgacacagtctccagccaccctgttctttgtctccgaaggggaaatagccaccctctccgtgcacgggccagtcagagtgcgtggcagcaacgttacgccgtggtaaacccaacaaaaaccgtcggaccagaaccgtccgagcctcctcactctatgatgacactccaccgacgggcctaacgtcggctaactcccgaagtcccgtagtacgngtcggctaggtgggtcgtacgggactacgtacttcgacgtcctaccaactcgtcgagacctacgtacgttaacgcggtaccgttaagtaacgttcgttttacggtaacttaggtttttaacttacgtcgttacgtcgacgtacggtacctacgtaccgaacgttaccgtaaccgttaccgtaacccgttcggaaccgtaacgggtaccaacgtacgtaagacgtaaacgttaacgacggtagtacggactcggtacctaacgtcgtacgttcttaccgtacttacccgttccgtaacccg

SEQ ID NO: 109689 - DNA, 865 bp, Homo sapiens
  misc_feature: GYAE6OF02JR612.33.70.G04.1.454.CMB.1.raw
  modified_base (220)..(220): a, c, t, g, unknown or other
  misc_feature (220)..(220): n is a, c, g, or t
  modified_base (263)..(263): a, c, t, g, unknown or other
  misc_feature (263)..(263): n is a, c, g, or t
tcagtacacacactcacgaccggtgctcgatttagtgtagtgtgaagggaaagggggaggaactgctcagttaggacccagagggaaccatggaagccccagctcagcttctacttcctcctgctactcgtggctacccgagactaccgaccggggtaattggtcgttgaccacgtagtcctccagcccaccgtgttctttgtcctccgaagggggaaancgccctacccgtctccgtgaccgagggtcccaaggtccaaggnggtcgctcgggcacggtacctaaacgttcgccgtaaggtaacccaaaaccgtaaaaccgtccgggaccaacgtacccgtaccccgtaaggtcccctcccgtactacgttactacgtcgacgtcggacctaccgtacccgaccgtaacgggcccacgttacggcctaccgtaccacggttaccgtacggttaccgagggtaccgtacgacggttacggggtaccgtcgggtaacaccggttcttaacccgtcgtaccgtaacccgtaaccgtaacgttccgaacgccttaaccgggtacccttaaaggcccgttacgttacggtaaacgtttacgttttaccggtacgtttaacgttttaaccggtcgttcggtaaccgtttcgaccggtaacggttcggttaaccaccggtacggttaacgtaaccccgttaaccgttcccgttaaaccggggcgaaacccgggttacctacggtaaacgggttcggaaaccttaaccgggttaaactaccggggttacgaccggttacctacgtacccgtaaacgttgttaccccgggtttaagccccgttttacggtaacccctttcccggttaaccccg

SEQ ID NO: 109690 - DNA, 839 bp, Homo sapiens
  misc_feature: GYAE6OF02HPKCD.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtctttgtctccgaggggaaagacgcccaccctctcctgcgacgggccagtcagagtgcgtggacagacctaaacgttacgccgttacggtaacccaaaaaccgtaaaaaaccgtcgggacccaacggtaaccctaccccgtaacggtccctaccctactaacttctaacgtagtaactcgactactaccccaacccggaaccggggccctaccgtacggaccaaccgtaccccgaacgaccgttacgggttaccgtaaggtcggacgtacgggttaccggggtcggtacggggaactaacggttaacccgttaccgtaaccgttcctaccctaaccgtaacgttaccgaacgaccgtaacggtacccgtaacggaccggtaccgtaacgggtaaacgtttacgttttacggaacgtttaagtttttaacgtttaccgttgttaccgttggaccgtacggtacgtaacgtaccgtaaccggttacgtaacccgttaaacccgttacccggttaccggaacggtaaaccggtaccgtaaacggtaacgtaaggtaacgttaacgttaaaaccgtacggtaacggtccgggaactaccggaccctaaccgtacgttacccgttacgttaccgttaccgttaccgttcccttaaccccgg

SEQ ID NO: 109691 - DNA, 665 bp, Homo sapiens
  misc_feature: GYAE6OF02HX556.33.70.G04.1.454.CMB.1.raw
  modified_base (196)..(196): a, c, t, g, unknown or other
  misc_feature (196)..(196): n is a, c, g, or t
  modified_base (223)..(223): a, c, t, g, unknown or other
  misc_feature (223)..(223): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaattgtgttgacacagtctccagccacctgtctttgctcagggaangccacctctcctgcagggccagtcagngtgctgcagcaacttagcctagtaaccaaacaaaaccgtggaccagacctcccagtctcctcatctatcgactgaccataccaccgacgggccctacgtcggcctaacctccccgacgtcccgtaggttccaggtcggacgtaggtcggtacgtcggaacacgtacttcactctccgaacctagtcgaacgctacggctaagacgccttaggaacgttatttcgacttaagttttacttacgttgtcgtgtacgtagtacgtagtaccgtaacgtcgggtaaccccttacgtacccgttaccggaacccggtaaaagggtcccaaaccggtacggtaacggtaacttaaaccgttaaacggacgttacggtacgggttacctacgaaccacggttactacccggttagtttccccgttaccttacccgtccctttaacccgg

SEQ ID NO: 109692 - DNA, 717 bp, Homo sapiens
  misc_feature: GYAE6OF02G0IE0.33.70.G04.1.454.CMB.1.raw
  modified_base (211)..(211): a, c, t, g, unknown or other
  misc_feature (211)..(211): n is a, c, g, or t
tcagtacacacactcacgaccggtgctcgatttagtgtagtgtgaagggaaagggggaggaacgtgctcagttaggacccagaggaccatggaacgccccagctcagcttctcttcctcctgctactctggctcccagactaccgaccgggtaattgtgttgacactagtcctaccagcccacccttgtctttgcctccgaaggggaaacncgccctaccctctcctgcagggccagtcagatgcctggccagtaccaacgttacgccctttaggaaacccaaacgaaaaaacctcggaccacggacctacccgacggtcctaccgtacctactcctagcgtaatcgctactccaccgacgcctacgtcggacctacctcccgaacgtaccgtacggtcgtacggtcggactacggttcgggtacgtcggggaactacgtccgttccgaactttccgaacacctagtccaagggtccaaccgtccgtaagccgtaccgtaaggtagtttaccgttgaacgtttaacgtttagtttaccgtgttaccgttgacgtacggtcgtacgtaaccgacttacgggtaaccccttaacccgtaccgtttaaccggacccggaacggttaaccgacgtaacggtcgaacgttaaacgtaacgtacgcgttacggacttcggaaccttcgacgttccgtattaccgtactccggttccctacccg

SEQ ID NO: 109693 - DNA, 788 bp, Homo sapiens
  misc_feature: GYAE6OF02HXAYX.33.70.G04.1.454.CMB.1.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (311)..(311): a, c, t, g, unknown or other
  misc_feature (311)..(311): n is a, c, g, or t
tcagtacacacactcacgaccggtgctcgatttagtgtagtgtgaagggaaagggggagggaactgctcagttaggacccagagggaaccatggaagccccagctcagcttctcttcctcctgctactctggctcccagataccaccggggaaattgtgttgacacagtctccagccaccctgtctttgtctccgaaggggaaancgccaccttctcctgcagggccagtcagngtgctggcagaccaaacttgcctaggtaaccaaacaaaaaccgtggaccagacctcccgaggcctcctcatcttaangactcgactactacccaaccgtagggccctaacgtcggaccaacgttccccacgtcccgtagggttacgacggttcggacgtaaggttcggggttccgtacggggacctacggttaacctttccgaaccgttcgtaaccctaaccgtactaccgtaacgccgtacgtaacccgtaggtaccgtacccgtttaagggaaacgtttacggttttaacgaccgtttaaggtttttaaccgttacgtttacggttaccgttagtacgtaacggttacggtacgtaccgtaagttccggtaacccttaaccggtacccgtttaccggaccgggtaaacggtacccgtaaacgtacgggttaacggacgttaaacgtttaaaccggaaccggttgggtaccggtaaccgttaccggtaacccgtaccgttacgttaccgtttaccggttaccctttaacgtcccgtttacccgttaaccccgg

SEQ ID NO: 109694 - DNA, 741 bp, Homo sapiens
  misc_feature: GYAE6OF02HM0HV.33.70.G04.1.454.CMB.1.raw
  modified_base (123)..(123): a, c, t, g, unknown or other
  misc_feature (123)..(123): n is a, c, g, or t
  modified_base (372)..(372): a, c, t, g, unknown or other
  misc_feature (372)..(372): n is a, c, g, or t
  modified_base (464)..(464): a, c, t, g, unknown or other
  misc_feature (464)..(464): n is a, c, g, or t
  modified_base (702)..(702): a, c, t, g, unknown or other
  misc_feature (702)..(702): n is a, c, g, or t
  modified_base (733)..(733): a, c, t, g, unknown or other
  misc_feature (733)..(733): n is a, c, g, or t
tcagtacacacactcacgaccggtgctcgatttagtgtagtgtgaagggaaagggggaggaactgctcagttaggacccagagggaaccatgggaagccccagctcagcttctcttcctcctnctactctggctcccagataccgaccggggaaattggtgttgacacagtcctccagccctaccctgttcctttgtcctccgaaggggaaacgacgccctaccctctccctgccgacgggcctagtcagtagttcgttaggccgggtacctagcccgttcggtaacccaacgagacgtaccgtcggccacggccttcccgaggtccctccttcttacctatgatcgtacactaccaacgtcggacccctancggaccaccgtccgacgtcccgtaaggtttcgacggttcggggtacgggttcggttcggtacgggacctacggtaccttccgtaccttaccncccgtacctaagtacctacgaccgaaccggttcccgtaacggtacggttccgaaggtttaaacgtttacgttttcgacggtttaaacgttttacgttacgttacggttctacggtcgtaacgttcgtacctacgtaccgttaacgacccgttaaccgtaccgttaccccggtaagaaaccgtaccgtaagaccgttagaacgttaaacgtaacgtacgtggcggtactgacccttacncttcgtcttccttactaccgttccgttcccntaccgtag

SEQ ID NO: 109695 - DNA, 682 bp, Homo sapiens
  misc_feature: GYAE6OF02FSQHN.33.70.G04.1.454.CMB.1.raw
  modified_base (205)..(205): a, c, t, g, unknown or other
  misc_feature (205)..(205): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagcccaccctgtcttttgtctccgaggggaaangcccacccttctcctgcacgggccagtcagagtcgctggcagcaacttgcctaggtaaccaaacaaaaacctggaccacgtacctcccaggcctacctcacttctaagtgatcgactacacccaaccgacggggcccacgtcggacctaaccgtccccacggtccctagggtttccaggtcggcgtaggttcgggtcgtacgggacaggtaccgttacacctccgtcacctactccacgacacgaccgtaggactccgtagtaacgttagtttcgtacgttaacgttttacttacgttcgttctcgtacgtacgtcgtacgaccgtacgtccggtaacctaccgtacccgttacggaccgaacgggacgtaaccgtacgtacggtaagttaaccgttaaacggtacggttaggacggtcctacggtacctacgtacgttccgttcggttaccttccgttaccgttcccttaccccgg

SEQ ID NO: 109696 - DNA, 783 bp, Homo sapiens
  misc_feature: GYAE6OF02GO696.33.70.G04.1.454.CMB.1.raw
  modified_base (210)..(210): a, c, t, g, unknown or other
  misc_feature (210)..(210): n is a, c, g, or t
  modified_base (600)..(600): a, c, t, g, unknown or other
  misc_feature (600)..(600): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggcctccagactaccgaccggggaaattgtgttgacactagtctccgagcccacccttgtctttgtcctccgaaggggaanacgcccaccctctcctgccgagggcctagtcaggtagtgcctggacacgactaacgttcgcctacggtaaccaaaaccgtaaaaaccgtcggaacccaacgacctccccgaacggcccttcccgtcctaactcccgtaagtcgggttacgacctacgtaccccgaaccggacgggtaccctaacgtcggacctacctaccccgagtaccgtacggttaccaggtacggcgtaggtcgggtacgtaggggtactacggtaccgttcacctctaccgaactctacgacgtacctaacgttaacgtaacctttaggtaacgttttaatttttaccgttaattttttaaactacgtttacgtaaaccctaacttacgtaccggtaacgttaccncgggtcccgttaggtcccctttacggtacctttaccggggttaccgggacgggtacgggtaaaccgtaggggttcgaaacctccggtaaagaaccgtacgtcggtcgcgttacgtacccaacgttcgttaccgttcgttacccttacggtcctttaccccggttcccaccttagttacccggg

SEQ ID NO: 109697 - DNA, 725 bp, Homo sapiens
  misc_feature: GYAE6OF02I5UNC.33.70.G04.1.454.CMB.1.raw
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (235)..(235): a, c, t, g, unknown or other
  misc_feature (235)..(235): n is a, c, g, or t
  modified_base (247)..(247): a, c, t, g, unknown or other
  misc_feature (247)..(247): n is a, c, g, or t
  modified_base (369)..(369): a, c, t, g, unknown or other
  misc_feature (369)..(369): n is a, c, g, or t
  modified_base (464)..(464): a, c, t, g, unknown or other
  misc_feature (464)..(464): n is a, c, g, or t
tcagtacacacactcacgaccggtgctcgatttagtgtagtgtgaagggaaagggggaggaactgctcagttaggacccagagggaaccatggaagcccagctcagcttctcttcctcctgcttactcttggctcccagactaccgaaccgggtaaattgtgttagacacagtctccagcctacccttgtctttgcctccgagggaaancgcctacctctcgngcgagccagtcngagtgctagcanacaactgccgtgaaaccaataaacctcgaccacgaccgtccaaggtcctccgtataacgtactagtcggaactcacgttacctccaaccggacggtacctacgcgggtaccaccgttaaccncggttaccgtaaggtttccgaacggttcggtaaggtccgtaacggggttcgtagggaaccttacggtctttacccgacgtttcgtaacccttaanactccgacggactacgaccgttaagaccggttacgtaaggtaacgtttagttaccgttagttaaaccgtttagttactttacggtcgtttccggacgtaccgttaggtaccctaaggccgttaccgtaactaccgtaaccgttcgaacggttacgaaccgtagttaccggaagtaacctacgttaaacggacgtccggtaacttcgaacgttaccaacgttcgtccgtttacgtaacccgtttgaccgtttacccgtcccg

SEQ ID NO: 109698 - DNA, 732 bp, Homo sapiens
  misc_feature: GYAE6OF02F90OP.33.70.G04.1.454.CMB.1.raw
  modified_base (199)..(199): a, c, t, g, unknown or other
  misc_feature (199)..(199): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagactaccaccggggaaattgtgttgacacagtctcagccacctgtctttgctccgagggaancgccaccctctcctgcagggccagtcagagtgctgcagcaacttcgcctaggaacctaaacaaaacctcggaccgacgactcccgaggtacctcctacgactctatagaatcgactactcccgaacgacgggtccctaacggtcggacctacgacccgacgaccgtaggttccaaggttcggcgtaaggtcggggttcgagggaacgtaaggtaccttcgaaccttcgtacctaaccgtactacgacgtacacggtcctaaggtacctccgtaaggtaacgttacttttacgactttaaacgttttacgttaccgttagttacgttacgacgttacgaacgttacgaaccgttaccgttacggtaacccttaaccgttacccggttacgggaaccgtaacggggtaacctaacggtacgtagggtaaaccgttaagttaaaccgtaacggtggttaccgaaccggttacgacccgtaaacgttacccgttcgttacgttaccttaacccggtacttaccccgtttaaccccgg

SEQ ID NO: 109699 - DNA, 773 bp, Homo sapiens
  misc_feature: GYAE6OF02GJ96I.33.70.G04.1.454.CMB.1.raw
  modified_base (165)..(165): a, c, t, g, unknown or other
  misc_feature (165)..(165): n is a, c, g, or t
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagactaccgaccgggaattgtgttgacanagtctcacgccacctgttctttgtcctcgagggaaancgccaccctctcctgcgacggccagtcagagtgcgtggcagactaacttcgccgtaggaaacccaaaacgaaaaccgtcgaccgtaacacctaccgagtccttacctactacttacgtactacgtattaccgactaccgtacccgaccggaaccgggtccctaacggtccggtacctaaccgttaccccgaacggtacccgttaacgggtttacgaacggttccgggtcggttaaacgggttcgggttaccgggtaacgggtaccggttaacgttaccccgttaacgtaccgttaccgtaccaacccggtactaccgaccgtacgacgtaccgtacgtacgtcgtaagttaacttcgttacgttacttaacgttttacttacggttcgttacgtagtcgagttcgtaactccgtaacgtaccgtaaccgtacccgtaccgttaccggtaaccggaagaccgtaaccgttaaggcgttaaactaacggtaaccgtaacgtcggtacggtacgtacccgaacgttaccgtaagttccgttaacgttccgttacttacccgttacccgttcccg

SEQ ID NO: 109700 - DNA, 779 bp, Homo sapiens
  misc_feature: GYAE6OF02G2L9C.33.70.G04.1.454.CMB.1.raw
tcagtacacacactcacgaccggtgctcgatttagtgtagtgtgaagggaaagggggaggaactgctcagttaggacccagagggaaccatggaacgccccagctcagcttctcttcctcctgctactctggctcccagataccgaccggggtaattgtgttgactacgagtctccacgccctacccttgtctttcgtcctaccggaaggggaactcgaccctacccttcgtccgtagccgacgggccctaggtaccaaggtaggtcgcgtcggacagtacctaacgttcgaccttacggtaacccaaaacgtaaaaccgtcggaccgaacgtaccctacccggaggtaccctaccgtactactacttaacgtcgtacgtcgacctactacccggtaccggaccgggtaccctagtcggacctaaccgtcccgacgaccgtacggttacgaggtccggacgttcgggttcggtacggtacgggtaccgtacgtaccgttacaccgttacctacgtaacgtcgtacgaaccgtacgaccggtacctagaccgtcgttaaggtaacgtttacgtttcgtaacgtttacgtttaccgttcgttacggttactacgacgtacggttacgacgtaccgtaacgtccgttaacgtaacccgtccggttaccggaacgtacgggtaacctcgggacgtaagtacgttaaccgtaacggttacggtaggtacgtccgtaaccaacgtacctgttccttaacgttacgtccttaccggtccctaccgg

SEQ ID NO: 109701 - DNA, 721 bp, Homo sapiens
  misc_feature: GYAE6OF02I9ODB.33.70.G04.1.454.CMB.1.raw
  modified_base (205)..(205): a, c, t, g, unknown or other
  misc_feature (205)..(205): n is a, c, g, or t
  modified_base (473)..(473): a, c, t, g, unknown or other
  misc_feature (473)..(473): n is a, c, g, or t
tcagtacacacactcacgaccggtgctcgatttagtgtagtgtgaagggaaagggggaggaactgctcagttaggaccagagggaaccatggaagccccagctcagcttctcttcctcctgctactctggctcccagataccaccgggggaaattggtgttgacacagtctccagccaccctgtctttgtctccgaaggggaaanacgcccaccctctcctgcacgggaccaagtcaaggacgttgttagacaaggtaaccttagtctacggtaaccaaacgtataacgacctaggaaccgaggaccctacccgaacgggtccttacctactacgttacctaacgaatcggtacctaccgaacggaccgggtccaacgtcggacaacctcccgagaccgtaggttaccgaaggtggactagggtgggtttaccggtaggggaaccaagtaccttcgaccctactccaaacctnacacgacctaaccgtaagtaaccttagtaaaggttacttttacttagttttacttaacttagtactaactaactacgacggtctacgtcgtcgtccttcctaccttacggttaccgggacgggtacgggaaacgtaaggtaggacgtaacgaacgaaacgtaacgtcggtagtaccgtacgtacctacgtacgttctacgttacccgttacgtaccgttacccgttaccgtaccttacgtacgtacgg

SEQ ID NO: 109702 - DNA, 769 bp, Homo sapiens
  misc_feature: GYAE6OF02ISWQB.33.70.G04.1.454.CMB.1.raw
  modified_base (167)..(167): a, c, t, g, unknown or other
  misc_feature (167)..(167): n is a, c, g, or t
  modified_base (208)..(208): a, c, t, g, unknown or other
  misc_feature (208)..(208): n is a, c, g, or t
tcagtacacacactcacgaccggtgctcgatttagtgtagtgtgaagggaaagggggaggaactgctcagttaggaccagagggaaccatggaagccccagctcagcttctcttcctcctgctactctggctcccagactaccgaaccggggaaattgtgttgacanagtctccagcccaccctgttctttgtctccgaagggaaagngccaccctctcctgcagggccagtcgagagtgcgtggacacgactaacgttacgtaccgtacggtaaaccaaaacctaaaaaccgtcggaccgaaccgtaccctaccccgacggtcccttaccctactaaccgttacttaagtacggactcgtacctacctaccccggaaccggtaccgggaccctacggtcggaacctaccgttaccccgacggtaccgtacgggttacgtacggtcgaccgtggttcgggtacggtacgggaccaacgtaccgttcgtaccttacgtaccaacctaatcgaacggtacacggtaacctaggaaccgtcgtaaacggttaagtttacttttacgactttaacggttttacttacgttcgttactggtaccgaggtaccgtacgacgttacgtaccgttaaccttaaccgtacccggttacggaacccggtaaggtaacccgaggttacgaaggtaacgttaacgtaaaccggtacgttggaccggtactaccgcgtaacgtttcgtacgttccgttacttaccgttacctccccgttacc

SEQ ID NO: 109703 - DNA, 800 bp, Homo sapiens
  misc_feature: GYAE6OF02IG46E.33.70.G04.1.454.CMB.1.raw
tcagtacacacactcacgaccggtgctcgatttagtgtagtgtgaagggaaagggggaggactgctcagttaggacccagagggaaccatggaagccccagctcagcttctcttcctcctgctactctggctccagataccgaccgggaattgtgttgacactagtctccagcccacctgttctttgctaccgaaggggaagcgaccaccctctcctgcgacgggccagtcaggtagtcgcgtggcagacctaacttcggacctaggaaacccaaaaccgaaaaaccgtcggtaccacggaccctacccgacgggtacctcccgtactacttctaagttgacgtacgacctaacctacccgaaccgaacgggaccctacgtacggctaccgtacccgaccgtcgtacgggttacgacgggtacgacgtacgggttcggttacggtacgggaactacgtaccgttacctaacgtctaaccgacctaactacgaaccgacgaaccgttacgtaggaaccgtaccgttaaaggttaacgtttacgttttaagaccgttttacgtttaaccttacgttaccggttactcgtaaccgttaggaaccggttcgaaaccgtcggttaaccggtaaccctaacccggtaccgttaaccgggaaccgtaaaccggtaacggaaccgtaacggtaacgttaacgaaccgtttaaacggtacggtcggttaccgtcccgtaacgtaaccccgtaagttaaccttcggtttaaccttacccttaccgtttaacccgtcccggttaaccccgg

SEQ ID NO: 109704 - DNA, 704 bp, Homo sapiens
  misc_feature: GYAE6OF02IORWH.33.70.G04.1.454.CMB.1.raw
  modified_base (202)..(202): a, c, t, g, unknown or other
  misc_feature (202)..(202): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccagccaccctgttctttgctccaggggtaanagccaccctctcctgcagggccagtcagagtgctggcagcaacttgcctaggtaccaacaaaacctggaccagacctccaggcctcctcatactatagatgactactccaaccgacgggcccacgtcggaccactcccacgcctaggttcagtcggctaggtcgggtcgttgggactacggtacttcactcgtaccaccgtatccgaggtcctaagtacctaacggacgtaccctaggaaacgttacgtttttacgacgtttaagttttaacgttaaccgtttcggttaacgttcgaccgtacggtaccgttacggtaaacctaacggttaacggtacccttaaaccgttacccgtttccgggaacccgtaaacgggttaaccgaacccggttaagtacgggttaagttaaccgttaaaacgtacggttggtaaccggtcgttacgacccgtaacctacgttacgttccggttccttaccggttacttacccgttaccccgg

SEQ ID NO: 109705 - DNA, 738 bp, Homo sapiens
  misc_feature: GYAE6OF02JLIL0.33.70.G04.1.454.CMB.1.raw
  modified_base (208)..(208): a, c, t, g, unknown or other
  misc_feature (208)..(208): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagactaccgaccggggaaattgtgttgacacagtcctccagccaccctgttctttgtctaccgaggggaaancgcccaccctctcctgcgacgggccagtcaggcgtgcgtggcacgactaacttagccgtaggtaacccaaaactaaaaccgtcggaccaacgtaacccgtccccgaaggtcctaccctacgtacttacctagtgtacgttgacctacgtacccgaccggacgggtacccacgttaccggacctaccgtcccgaacgtccggtacggtttaccgacggttcggccgttacgggtcgggtacgtacgggtaacaacggtaccctttaccgacttcctaccgacctatccgaacgccgtaccgaccgttaacgccggtacctaaggtaacttacgttcgtacgttacgttttacgtacgttggtaccctggtaacgtcgtacggtactaccgtacgtaccggtaccttaaccgtcccggttaacgaaccgtaacgaaccgtacgagtaacggtataccgttaacgcggttacgacggtcctacgaccttaaccgtcgttccgtaccgtttccacggttacttcccccgtacgg

SEQ ID NO: 109706 - DNA, 802 bp, Homo sapiens
  misc_feature: GYAE6OF02HUHVJ.33.70.G04.1.454.CMB.1.raw
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaattgtgttgacacagtctccagcccaccctgttctttgtcctccgaaggggtaaagagcccaccctctcctgcgaggccagtcagagtgtacgcggtactgcctagtaccacagacgacgnggccaggcctaccgagcctcctctctangatcgactactaccaaacgcgggaccacgtggactacctaccccgagacctaggttcgacgggtcggtacggggtgggtcgtagggaactacgtacgttacctactactaccgaactactaccgacggacgtaaccggtaccgtacggaaccgtccgttaagggtaaacgttttacgtttttaggaaccgttttaacgttttaaacgttttacggtacgtttaacggaccggtaacggttaacggttaacgtaccggttaacgttaaaccggttgggttttaacccgttacgggggtaaccggtttacccggggaaccggtaaaacgggggtaaccgttaaaacgggggttaacgtaaaaccggtaaaccgtaaaaacgggttaggtacggttacggggtacctaaccgaacccgttaaccgtacttccggtttacttttacccgtaaccgtttaccgttacccccgttaccccggaacttttaccggtactttaacgggg

SEQ ID NO: 109707 - DNA, 773 bp, Homo sapiens
  misc_feature: GYAE6OF02FLUPG.33.70.G04.1.454.CMB.1.raw
  modified_base (621)..(621): a, c, t, g, unknown or other
  misc_feature (621)..(621): n is a, c, g, or t
tcagtacacacactcacgaccggtgctcgatttagtgtagtgtgaagggaaaggggggaggaactgctcagttaggacccagagggaaccatggaagccccagctcagcttctcttcctcctgctactctggctacccagactaccgaccggggtaaattgtgttgacacgagtctaccagccctaccctgtctttgtcctccaggtaagaaagcgccctaccctctcagtcgcgacgggccacgtacagtagtacttagcctattcttacgtcggacctaggtaccaactaaggaccgacctaggcccacggtccctacccgaggtccttaccctatacctcgtatacggatcgacctacgtaccccgaaccggcgggtaacctaccggtcggtacctaaccgtccccgtacggtaacccgtagggtttaccagggtaccggtaacgggtaggggtttccgggtaaccggttaacggggaccttaaccgggtttacccttaccgtaccgttacccgtaacctacccgtaactaccggtaccgaccgtacgtaaccggtaacgtacggtacccggtaagtaacggtttagtttaccgtacgtttaacgtttattaccgttntaccgtacgacgtacgtactacggtactacggtaccgtaccttaaccgttacgtaccggaacgtaaccggacgtacgacgttaggaacgttaaacggtaactacggttacgtgtaccgtacgtaccgtaccgtgtaccttacgtacttaccg

SEQ ID NO: 109708 - DNA, 811 bp, Homo sapiens
  misc_feature: GYAE6OF02G7DYO.33.70.G04.1.454.CMB.1.raw
  modified_base (204)..(204): a, c, t, g, unknown or other
  misc_feature (204)..(204): n is a, c, g, or t
  modified_base (616)..(616): a, c, t, g, unknown or other
  misc_feature (616)..(616): n is a, c, g, or t
  modified_base (809)..(809): a, c, t, g, unknown or other
  misc_feature (809)..(809): n is a, c, g, or t
tcagtacacacactcacgaccggtgctcgatttagtgtagtgtgaagggaaagggggaggaactgctcagttaggacccagagggaaccatggaagccccggctcagcttctcttcctctgctactctgctccagataccgacggggaaattgtgttcgacacacgtctccacgcctacctgttctttgtctaccgaggggaancgccacctctcctgcgacgggcctacgtcgagtacgtcgtccgttcggactacgaactaaaccgttagtacccgttaggtaaacccctaaaacgtaaaaacccggttcgaaccgtacgtaaccctcccggaaggtcccctccgaactactaccgtagtggtactacgacctacgtaccccgaacggaccgggccctagtcggacctaccgtcccgaacggtccgtaggttaaccgaggtaccgcggtacggttcggaccggttacggggaactacggttaacctttccgaacgtttccgaaccgtttacccaacgttaacgcaaccgtacgtaaccgtacggtaaccgtccgaacgtttaagtcgtttaccgtaagttagtttcgttaacgtcgttaatccgagtacggttnaaccgtaccgtaacggttacccgaccgtttaaccggccgtttaccggaaaccggtaacgggtaaccaacgggttaaacggtaaccgtaaaggttaaaacccgtacgggttaacgtcggttaccggaaccggttcaaacccggtatttaccgtcgttaccgtttcgtttaccctcccgtttacccggttacccncg

SEQ ID NO: 109709 - DNA, 826 bp, Homo sapiens
  misc_feature: GYAE6OF02HFOBA.33.70.G04.1.454.CMB.1.raw
tcagtacacacactcacgaccggtgctcgatttagtgtagtgtgaagggaaagggggaggaactgctcagttaggacccagagggaaccatggaagccccagctcagcttctcttcctcctgctactctggcctcccagataccaccggggaaattgtgttgacacagtctccagccaccctgtctttgtctccgaggggaaagacgccaccctctcctgcaggccagtcagagtgcgtcggcagctaacttcgccgtacggtaaccaaacctaaaaacccgtggacccaagacccgtacccgacggtacctccctacacttacctaagtgaacgttcgaccaaccgttaccccaacccggtaacgggacccctacggtacggacctaacgtaccccgaacggtaccgtaacgggttacctacggggtcggtacgtaacgggtcggggttacggtacggggtaacgacggttaaccgtttccgtaaccgtcccttaaccgaaacccctacttaccgaacgggcctaccggacccgttaggaccggtacctaagggtaactttagttttacggaactttaacgttttacgttaaccgttcggttaacgttacggacgtaagggttacccttaggtaaccggtaaccgttccggtaaacccttaacccggtcccgttaaaccggacccggaaacggggtaaaccgtaccggtaaacggtcggtaaacggttaaacgttaaaccgggtacgttcgtacgggtcctaacgtaccgtaacgtttacgttccgtttaccggttaccttaccgttaccggttcccttacccgg

SEQ ID NO: 109710 - DNA, 836 bp, Homo sapiens
  misc_feature: GYAE6OF02HTKT8.33.70.G04.1.454.CMB.1.raw
  modified_base (277)..(277): a, c, t, g, unknown or other
  misc_feature (277)..(277): n is a, c, g, or t
tcagtacacacactcacgaccggtgctcgatttagtgtagtgtgaagggaaagggggaggaactgctcagttaggacccagagggaaccatggaacgccccagctcagcttctcttcctctgctactctcggctcccagactaccgaccgggaatttggtgttcgacacgagtcctaccgacgccctacccgttgtttccttttgtccgtaccgggaaggggaaacaccggcccctaacccgttccttacctcggcgaaccgggccctagtcaaggngttcgacgtggccagacctaaacgttcgtccgtacgtaaccaagacgcggaaccgtggacctcggccctaccggtacgtccgttccgtttctacctggtagtctccgactacgtacccgtaaacggccgtaccgaacgtggtacccacgttaccgaacgtcgtaacggggttcgcgttcggggtcgggtttacggacggtcgggtaactaccggtttaccctctaacccggtttcacccgaaaccgttaacgtccgtaaacgtccgtaacccgtacgttaccggaccggttacttaaacggtacggtttatttacgacgtttacggttaacgttcttcggttaacgtcgtacgttaacgcgtaactaccgtaacggttaccgtaccgttaacccgggttaccgtccgggaaacgttaaccgacggtaacgtacgggtaagtaaccgtttaaccgtaacggaccggtttacgggtaccgtaacctaacggttacccgaacccgttttaacggttccgtttccgttaacccggtttccttacccggtttaccccgtcccgg

SEQ ID NO: 109711 - DNA, 807 bp, Homo sapiens
  misc_feature: GYAE6OF02F7EBN.33.70.G04.1.454.CMB.1.raw
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaaattgtgttgacacagtcctccagcccaccctgtctttgtcctccgaggggaaanacgcccaccctctcctgcgacggccagtcagngtgctggcagctaacttacgccgtacggtaaccaaaacctaaaaaccgtcggaccaacgtacctcccgaggcccttaccttaccgataccttatcgaagttcgacctacctacccgaaccggtacgggccctacgtcggacctacctaccccgcgtaacccggtacggttaccgacgtcgggtaccgtaggggttcgggtacggtcggggaaccctaagggtaaccctttcctaacccgttcgtaacccgtaaccgacgttaccgaccggaactacccgggaccgtttaaacggaccgttacccgttagggtaaaacgttttagttttcggaacgtttaaccgtttttaacttaacggtttcgttaccttacgggtaccttagggaccggttaaacttaccgaccggttaaccggtaacctaaccccggtttacccgtacggacccgggtaaacgtaccgtaacggtaccgttaggaacgttaaacgtaaaccgtacggtacggtacgtaccggacgtacccgtacctacttccgttcgttacctacgttaccgtcccgttaccccgg

SEQ ID NO: 109712 - DNA, 560 bp, Homo sapiens
  misc_feature: GYAE6OF02JCP4B.33.70.G04.1.454.CMB.1.raw
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
tcagtacacacactcacgaccggtgctcgatttagtgtagtgtgaagggaaagggggaggaactgctcagttaggacccagagggaaccatggaagccccggctcagcttctcttcctcctgctactctggctcccagataccaccggggaaattgtgttgacacagtctccagccaccctgtctttgtctccaggggaaagagccacctctcctgcagggccagtcagagtgctggcagcaacttagcctggtaaccaacaaaaacctggaccagaacctcccaggctcctcatctatgatgcactaccaccgtacggccacgtcggacactcccagccaggttccagtgcagtggtcgtgggacagtacttcacgtcncactntacagtcagtcctagcgtctagaatgtttagcttagtttactacttgtctgctagcgtagctaacgtcggtacctaactaccgttacggacctaacgggacgacgacgttagacgttaattaacgaactggtcgactcgaccactacgtctgttccttcgtacttccgtcctacg

SEQ ID NO: 109713 - DNA, 586 bp, Homo sapiens
  misc_feature: GYAE6OF02JSX4B.33.70.G04.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (371)..(371): a, c, t, g, unknown or other
  misc_feature (371)..(371): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacacagtctccggccaccctgtctttgtctccgaggggaaangccaccctctcctgcagggccagtcagagtgttagcgggtacctagcctggtaccaacngagacctggccaggcctccaggctcctctctatgatgcatccaacgacgggccacgtcggcactcccagccaggttcaggtggcggtggtctgggacagtactcactcncacatcagcacgcctagatccgtagaatatttgacttagtttatacttgtactgactgtacgtagacgtacgttggtccgttaggtacggttccggaccggaacgggtaccgtaaggtacggaaacgtaccgaaacgtacgtagtacgcgttacgacgtaccgtagttcttacgttcttacgtacgttcctcccgtacctacgttcgtagtacgg

SEQ ID NO: 109714 - DNA, 695 bp, Homo sapiens
  misc_feature: GYAE6OF02HFIX2.33.70.G04.1.454.CMB.1.raw
  modified_base (165)..(165): a, c, t, g, unknown or other
  misc_feature (165)..(165): n is a, c, g, or t
  modified_base (678)..(678): a, c, t, g, unknown or other
  misc_feature (678)..(678): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaattgtgttgacanagtctccagccaccctgtctttgtctccgaggggaaagacgcctacctcctcctgcagggccagtcagagtgctggcagcaacttagcctaggtaaccaaaacaaaaaccgtggaccaacgacctcccgaggctcctacatctatgtatgactactaccaccggacgggtccacgtcggctacacccagaccgtacggttcaaggtcggactagggttcgggtaccgtaggggaactaacgggtacttaccaaccttacctacccaacccgtagtacccgaacgtacccggtaacacccgtaaggaccgttccgttaaggtaaacggtttatttacggaccgtttaagtttttaacgtacgttgttaccgttgactaggtacgtacgactaacgtcgtaaccctaaccgtacccgttcgggaaccgaagggtaccctacggacgtaagggaacgttaagtaaaccgtgggtaactcggaccagtacccacttacggtcttctaccgtttaccncgtttaccctaacccgg

SEQ ID NO: 109715 - DNA, 681 bp, Homo sapiens
  misc_feature: GYAE6OF02HKXK6.33.70.G04.1.454.CMB.1.raw
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
  modified_base (403)..(403): a, c, t, g, unknown or other
  misc_feature (403)..(403): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccaccggggaaatttgtgttgacacagtctccagccaccctgtctttgctccaggggaaangccacctctcctgcagggccagtcagagtgctggcagctaacttagcctggtaaccaaacgaaaaacctggaccagacctcccaggtctcctcntctatgattgacactccgaaccgacgggccacgtggaccacgtcccagtacccgtaggttcgaggtcggcgtaggtgggtcgtgggacagtacttcactctacactntacgagtcagccgtaagcgacctaggaacttagtttgacttagttttaacttacgttcgttacgttcgacgtaggacgttaacgccgttaaacgtcggtaacccgttaaaccgtcccgtttaccgggaacccgtaacgggtaaccgaaccggtacgtaagggaaacggttaacgttaaaaccggttaccggttacggtcgggtaccgttaccggacccgtaaccgttacgtttacccgttggttaccctttacccgttacgttccccgtttaccccgg

SEQ ID NO: 109716 - DNA, 705 bp, Homo sapiens
  misc_feature: GYAE6OF02FI8AU.33.70.G04.1.454.CMB.1.raw
  modified_base (174)..(174): a, c, t, g, unknown or other
  misc_feature (174)..(174): n is a, c, g, or t
  modified_base (205)..(205): a, c, t, g, unknown or other
  misc_feature (205)..(205): n is a, c, g, or t
  modified_base (683)..(683): a, c, t, g, unknown or other
  misc_feature (683)..(683): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagactaccgaccggggaattgtgttgacacagtctccngcccacctgttctttgtctccgaggggaaancgccctaccctctcctgcgagggccagtcaggagtgcgtggcacgactaacgttcgaccgtacggtaaccaaaaaccgtaaaaccgtcggaccctaaggtaccctaccccgaggcccttacccgtactattaccttaagtcgtacgtacgtactaccgtaccccgaccggtacggtccacgtcggaccaccgtacccgaagtccggtaaggtccgaggtcggaccggtaggttcgggtcgtaggacgtaacgtcttcaccgtcgtaccaacctacgcgtacgccgtacgtacctaagaccgttcgtaaagttattacgtttcgactttaattacgtacgttcgtcgtacgacggtagtccgtaactcgttaccgtaacgaccttacgtcccggtaacggtacgaacggtacaccggtagacgtaattaaccgtaacgtcggtcggtcgtctacgtactaccgttacgtcgttaccttnttaccctaccgttcccgtaccc

SEQ ID NO: 109717 - DNA, 703 bp, Homo sapiens
  misc_feature: GYAE6OF02FW4LS.33.70.G04.1.454.CMB.1.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (295)..(295): a, c, t, g, unknown or other
  misc_feature (295)..(295): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggctcccagataccgaccggggaaattgtgttgacacagtctccagccaccctgtctttgctccaaggggaacngccacctctcctgcagggccagtcagngtgctggcagcaacttgcctagtaaccaacaaaacctggaccaggctcccaggaccttcctcctntactggtcacacgtcccaccgacggtccacgtcggcactcccagactaggttcaggtcgtcaggtcggtcgtgggacacgtacttcacttcgtacgacctataccgaagacgtaccgtaggtacgaccgttagtaacgttacttttacggacttacggttaccttaacgtttaaccgtcgttaccgtacggtacgtaacggttaccttaaccggttacggggtaacgtacccgggtttacgggaccccggtaaacggggtaccgtaaacggggttacggaaaaccttaccggtaaaaaccgtacggtacgttacggacgttcggaaccctccgtaacgttccgttacgtacctttacgtaccgtttacccgttacccgtacctacgttccgtaaggttacggttacgg

SEQ ID NO: 109718 - DNA, 893 bp, Homo sapiens
  misc_feature: GYAE6OF02G0717.33.70.G04.1.454.CMB.1.raw
  modified_base (212)..(212): a, c, t, g, unknown or other
  misc_feature (212)..(212): n is a, c, g, or t
tcagtacacacactcacgaccggtgctcgatttagtgtagtgtgaagggaaagggggaggaactgctcagttaggacccagagggaaccatggaagccccagctcagcttctcttcctcctgcctactctggctcccagataccgaccggggaattggtgttgacgactagtcctcagccctaccctgttctttgtcctccgagggggaaanacgccctaccctctctcgcgacgggcctagtccagacgtgtcgaggcagcaacgtcgtccgtacggtaaccaaaacgtaaaacgtcggaccagtaccctcccgtaaggccttacctcgaacttactagtggatcgacaccgtccaaccggtaccgggaccttaccggtacggacctaccgtacccgaccggtaccgttacgggttaccccgtagggtccgggtacgtaacgggtttccggggtaacggtcggggtaaaccgtaccggttaccgtacccgtaacccgttcccgtacccgtaaccttaaccgtaccgtaaccgtaccgtaacccggttaccgtaacccggtaccggtacccgtttaaacgggttaaaccgttttacggttttacgtaaccggttttaaccggttttaacctttaccgttcgggttacccggttaacgtacggttaccggtaccggtaccggttaaccgacccgtttccggttaaaccccttaacggtttcccccggtaaccgggtaacccgtaacccgggtaaccaaacggttaccgggtaaccgtaaagggtttacccgttaaacggtcggttaccgggttaccgtaccggttacggtaaccccgtccttacgggtttccgaccgttttaccgtcccgtttaccttccccggttaaccccgg

SEQ ID NO: 109719 - DNA, 737 bp, Homo sapiens
  misc_feature: GYAE6OF02HWFY5.33.70.G04.1.454.CMB.1.raw
  modified_base (107)..(107): a, c, t, g, unknown or other
  misc_feature (107)..(107): n is a, c, g, or t
  modified_base (124)..(124): a, c, t, g, unknown or other
  misc_feature (124)..(124): n is a, c, g, or t
  modified_base (159)..(159): a, c, t, g, unknown or other
  misc_feature (159)..(159): n is a, c, g, or t
  modified_base (170)..(170): a, c, t, g, unknown or other
  misc_feature (170)..(170): n is a, c, g, or t
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
  modified_base (488)..(488): a, c, t, g, unknown or other
  misc_feature (488)..(488): n is a, c, g, or t
  modified_base (535)..(535): a, c, t, g, unknown or other
  misc_feature (535)..(535): n is a, c, g, or t
  modified_base (660)..(660): a, c, t, g, unknown or other
  misc_feature (660)..(660): n is a, c, g, or t
  modified_base (673)..(673): a, c, t, g, unknown or other
  misc_feature (673)..(673): n is a, c, g, or t
  modified_base (692)..(692): a, c, t, g, unknown or other
  misc_feature (692)..(692): n is a, c, g, or t
  modified_base (719)..(719): a, c, t, g, unknown or other
  misc_feature (719)..(719): n is a, c, g, or t
tcagtacacacactcacgaccggtgctcgatttagtgtagtgtgaagggaaagggggaggaactgctcagttaggacccagagggaaccataggaacgccccagctnagcttctcttcctcctnctactctgctccagacaccgaacgggaattgtgtnacacgtcgtcnccagcctacctgttctttgcctccggaagggtaagactcccaccctctccgtacgacgacgggtaccagttaccaagggacgttcggcgttaggccaagtaccttaaaacggttcgccgttaaacggtaaaacccaaaacgtaaaaccgtcgaccgaaacaccgtaccccgaggtcctacctacnctaactagtgttaacncgtactacccgtaccgacccgggtatcccgagtcggaccaccgtaaccgtcgaccgttcgaagcgttacgcggttaaggtcgtacggtggacagtaccttacgcaaccttcaaacgntaaccgacgtccgacggtaacctaaggaccgttagtataacggtttnttaaccgtagtttacccttagtaccttagttcccgtacgagtacggtacaaggtacccacggttaacacccttaaaccgggtcctaaaccggacggttaacgaacggtacgtttaagggaaaccnggtttaaaacccncgggtttaaaccggttacncgttaaccacgttacctcgtgttaccncgtacctttctcctaacc

SEQ ID NO: 109720 - DNA, 864 bp, Homo sapiens
  misc_feature: GYAE6OF02G2P6Q.33.70.G04.1.454.CMB.1.raw
  modified_base (121)..(121): a, c, t, g, unknown or other
  misc_feature (121)..(121): n is a, c, g, or t
tcagtacacacactcacgaccggtgctcgatttagtgtagtgtgaagggaaagggggaggaactgctcagttaggacccagagggaaccatggaagccccagctcagcttctcttcctctnctactctggctcccagactaccgaccggggaaattgtgttgacactagtcctccacgcccaccctgttctttcgtctacccggaaggggtaaaacgcgaccctaccccgtctccgtgaccgacggggtacccacggtaccaaggtacggtcggtaccgtgggtaccgacggtaccttaaccgttacggtcccgtacgggtaaacccaaaaaccgaaaaacccgtcggaaccaacgtacccgtacccgaggtccctacctcgactccgtaacgtgacgttaccgacctacctaaccccgaccggtacggaccctaacggtcgacctaaccgtccccgaacggtcccgtacgggttcacgggtaggtacccggttaggttacggggtccggtaacggtacgtaaccggtacctttaccgaccgtttacccgaccgtaaccctagtaccggacggttaacccgtaccggtacccggttaacggtaaccggttacccgggttaacgttaaagggtttctttaaccgggttacgtttaactttcggtttacgtacggttctcgggttaacgcgtttaaccggtaactccggttaacccgtaccgttaaacccgtccggttaacgtacccgggaaaccgtccgggaaacctaggttaacccggtaaggtaaccttaacgttaacgtggttccggacttcgtaaccgcctacgtcctttacgtctaccgtacccggttctccctaaccgg

SEQ ID NO: 109721 - DNA, 762 bp, Homo sapiens
  misc_feature: GYAE6OF02FKDV6.33.70.G04.1.454.CMB.1.raw
  modified_base (167)..(167): a, c, t, g, unknown or other
  misc_feature (167)..(167): n is a, c, g, or t
tcagtacacacactcacgaccggtgctcgatttagtgtagtgtgaagggaaagggggaggaactgctcagttaggacccagagggaaccatggaacgccccagctcagcttctcttcctcctgctactctcggctcccagactaccaccgggaaattgtgtgacacngtctcagccaccctgtcttcgtcctcgagggaagacgccctacctctcctgtcgaggccagtcagtagtgcgtggcacgacaacgttacggccctacgggtaaaccctaaaccgtaaaaacccgtcgggtacccaacgtacccttaccccgaacggtccccttaccccgtataaccgttacgttacgttacggtacttcgacctaccgtaccccgaacccggtaccggggaccctaacggtcggacctaccccgaccgacggtaccgtacggttcgaagggtcgtacggacgggttcgggttacgacgggtaacgttacgttacccttcgtaccgttcctaaccgtacgtaacgtacgatacggacgtaaccggtcggacgtaccgtaaggtaagtttacttccgggatttacgttacgtagtttaccgtacgtagtgtaacgttacggttacgttcctacgttaccgtccggttaccgtcggttacccgaacggtaaaccgtaacggtaacggtaacgtaaccgtaacgtacgattacgggactacggtcaccctagtactcgttctaccgtactaccgttacccgtcctaacg

SEQ ID NO: 109722 - DNA, 651 bp, Homo sapiens
  misc_feature: GYAE6OF02HZGUU.33.70.G04.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
tcagtacacacactcacgaccggtgctcgatttagtgtagtgtgaagggaaaggggaggaactgctcagttaggaccagagggaaccatggaagccccagctcagcttctcttcctcctgctactctggctccagataccgaccgggaattgtgttgacacagtctccagccaccctgtctttgctccgagggaacngcctacctctcctgcagggccagtcagatcgngtgcagccaattgccgtggtaacccaaacgaaaacctcggacacgacctaccgacggcctccgtctacgtctatagacgtcgcactacccgaccgacgggcctacgtcggacaccgtccgacgtccgtacgtacgtacggtcggtacgaggtcggtgtacgggcgtaaaaaacgtcttaccgtactccgtacctacctacgtacgacgtacgacgtccgtaacgtacgtcgttacggtagttacgtttacgtacttacgtttacttacgtgttacgtcgacgtcgtacgtactacgtacgaccgtaaccgtaccgtaccgtacgtaccgaacgtccgacgacgtagtaacgtaacgtaacgttaccgtggtaccgtcgtacgtactacgtacttcgtacttccgtacttacgtccgtacccg

SEQ ID NO: 109723 - DNA, 923 bp, Homo sapiens
  misc_feature: GYAE6OF02IJPJE.33.70.G04.1.454.CMB.1.raw
  modified_base (204)..(204): a, c, t, g, unknown or other
  misc_feature (204)..(204): n is a, c, g, or t
tcagtacacacactcacgaccggtgctcgatttagtgtagtgtgaagggaaagggggaggaactgctcagttaggacccagagggaaccatggaagccccagctcagcttctcttcctcctgctactctggcctcccagataccgaccggggaaattgtgttgacacagtctccagccacctgtctttgtctccgaggggaaanagccaccctctcctgcagggccagtcagagtgctggcagacctaacgttagccgttacggtaaccaaaactaaaaaacccgtcggaccaacgaccgttcccgacggtacctcctacgattctaatgatcgactactacccgaaccgtacgggccctaaccgtaggacctaaccgtacccgaaccgggtacccgtaacggttcgaacggtacggggtaccgtaagggttccgggggttaccggttacgggggtaaactaaaccgggtaacccttttaccggaaaaccttttccccgtaacctaacccctaaaacggttaccaaacccggtaccgaaaccgggtaccccgttaaaccgggtaaacccgttaccccgggttaaagggtaaaacggttttaaacgtttttttaccggggaacctttaaacgggtttttttaaactttttaaccggttccgggtttaccgttacggtaaccgttaacgggtacccgggttaacgaaacctaaaccgttacgggtaaccccttaaaacccgtaaccccgtttaccgggaaacccgtaaaacggggtaacccgtaaacggaaaccgggttagggtaaacggttaaacgttaaaaaccgggtaaacgtttcgggaaccggtacgttaaccgtaccgtaaaccgtacgtttaccgttaccggttaccttttaacctacccgttaccggttaacccccg

SEQ ID NO: 109724 - DNA, 774 bp, Homo sapiens
  misc_feature: GYAE6OF02H7RSF.33.70.G04.1.454.CMB.1.raw
  modified_base (227)..(227): a, c, t, g, unknown or other
  misc_feature (227)..(227): n is a, c, g, or t
  modified_base (465)..(465): a, c, t, g, unknown or other
  misc_feature (465)..(465): n is a, c, g, or t
tcagtacacacactcacgaccggtgctcgatttagtgtagtgtgaagggaaagggggaggaactgctcagttaggaccaggggagggaaccatggaacgcccagctcagcttctcttcctctgctactctggctccagactacgaccgggaattgtgttgacacagtctcagccacctgtcttgtctccgagggaagagccacctctcctgcacgggccaggtcagngttgcgtgcagcctaactgcctaggtaaccaacgaaaacctcggaccacggacctacccgaggtcctcctactacgtacgtactcatgacctaacctccgaaccgacgggaccctacggtacggactacctcccgtaacggccgttcgggttacgaacgggttccggtacggtagggttcgggggtacgtacgggtaccgtacgtaaccgtttccgtaacgttcctacgtaacccgtntaccgaacgtactacggtacccttaacggacgttaccgtacgtaacgtttacgttttagacggtttaagttttacgtttaccgtttcgtaacttcggtccggtaacggtacggtaacctaccgtaaccgttaccggtacccttaaccggttcccgggttaaccggaaccggtaaccggggtacctacgggtaacggtccggtaaagttaaccgttaacggtaacggttggtaccggttcggtaaccgacccgttaacggtacttttaccggtttcgttaccctttcgtaccccggttccccttacccgg

SEQ ID NO: 109725 - DNA, 723 bp, Homo sapiens
  misc_feature: GYAE6OF02JXPGL.33.70.G04.1.454.CMB.1.raw
  modified_base (395)..(395): a, c, t, g, unknown or other
  misc_feature (395)..(395): n is a, c, g, or t
  modified_base (493)..(493): a, c, t, g, unknown or other
  misc_feature (493)..(493): n is a, c, g, or t
  modified_base (508)..(508): a, c, t, g, unknown or other
  misc_feature (508)..(508): n is a, c, g, or t
  modified_base (569)..(569): a, c, t, g, unknown or other
  misc_feature (569)..(569): n is a, c, g, or t
  modified_base (581)..(581): a, c, t, g, unknown or other
  misc_feature (581)..(581): n is a, c, g, or t
  modified_base (587)..(587): a, c, t, g, unknown or other
  misc_feature (587)..(587): n is a, c, g, or t
  modified_base (606)..(606): a, c, t, g, unknown or other
  misc_feature (606)..(606): n is a, c, g, or t
  modified_base (638)..(638): a, c, t, g, unknown or other
  misc_feature (638)..(638): n is a, c, g, or t
  modified_base (648)..(648): a, c, t, g, unknown or other
  misc_feature (648)..(648): n is a, c, g, or t
  modified_base (685)..(685): a, c, t, g, unknown or other
  misc_feature (685)..(685): n is a, c, g, or t
  modified_base (691)..(691): a, c, t, g, unknown or other
  misc_feature (691)..(691): n is a, c, g, or t
  modified_base (699)..(699): a, c, t, g, unknown or other
  misc_feature (699)..(699): n is a, c, g, or t
tcagtacacacactcacgaccggtgctcgatttagtgtagtgtgaagggaaagggggaggaactgctcagttaggacccagagggaaccatggaagccccagctcagtcttcctctttccctccttgaccttactcgtcggtcctacccgagactaaccgaaccggggtaatttggttcgttagacacgaacgtcctaccgacgccctacccgttgtttcctttcgtacctccggtaaagggggaaactaccgccctaaccctcttccgtcgaccggacggcgtacgtacaggacgtgtcgcggtacacgaccgttaacttacgctaacgtaaccaaaaccgtaaaccgtcggacctaacgaccgaccgtacggtcctcctactacgtacgtcgntacacgtctaacctcccggaaccgacgaccctggtacaccccgttccgaccgacgtccggtctaacggagttcgggactcgggtcggttacggacggnttaacgtcctacgtntcccgactaacgtcgtcacgtaagtccgactcgagtacctaggtacgttcttgtaacgttntttaccgtgttntaacgngttaacggctagacgaacncgttacgaaccttaccggcctaaggctaacgngtacggttanacggacgttaaccttggaccgtggtcggactacccgntaaccncggtttancgttacctaccacgttccctaacg

SEQ ID NO: 109726 - DNA, 881 bp, Homo sapiens
  misc_feature: GYAE6OF02FIZFA.33.70.G04.1.454.CMB.1.raw
  modified_base (203)..(203): a, c, t, g, unknown or other
  misc_feature (203)..(203): n is a, c, g, or t
tcagtacacacactcacgaccggtgctcgatttagtgtagtgtgaagggaaagggggaggaactgctcagttaggacccagagggaaccatggaagccccagctcagcttctcttcctctgctactctggctcccagataccaccggggaaattgtagttgacacagtctccagccacctgtctttgtctccgaggggtaaanacgccacccgtctcctgccgagggccagtcgagagtgctggcagacaacgttagcccgtaggtaacccaaacaaaaaccgtcggaccacgtacctcccgaaggtcctcctactatcttagtgattcgactactacccgaaccgtacgggcccaacgtcggaccaaccttcccgaacggtaccccgtaggtttaccgacggttacgggaccggttaggttacggggtccgttagggaaccgtaacggtacctttacgaaccgtaccttacccaaccgttaacgttaccgaacggtccgaacggttacccgtaaggtaacccgttaccccggtaaggttaaaaccggtttaggttttaccggaaacgtttaaagggtttttaaccttaacccgtttacggtttacctacggtaccggttaaaccgtaccggttaacgaacccgttaacgttaaccggtaacccgttaaacccggttaacccgtttcgggaaacccgtaaaccggggtaacccgtaaccggtaaccggttaaggttaaaccggtaaggttttaaaaccccggtaaggttacgggttacccggttaaacccgtaccggttaaaccccgtacccgtttaacggttcccgtttacggttttacccccgttaactttacccccgtttacccggtttaacccccgg

SEQ ID NO: 109727 - DNA, 771 bp, Homo sapiens
  misc_feature: GYAE6OF02IWONQ.33.70.G04.1.454.CMB.1.raw
tcagtacacacactcacgaccggtgctcgatttagtgtagtgtgaagggaaagggggaggaactgctcagttaggacccagagggaaccatggaacgccccagctcagcttctcttcctcctgctactctgcctccagactaccaccgggaaattggtgttagacacagtctccagcccaccctgtctttgtcctcgaagggaaagacgccaccctctccgagccacgggccacgtcagagtgcgtggacgagacctaaacttagcccgtaggtaacccaaaaccaaaaccgtggaccacgtacctaccccgaggtccttacctactactctaatggtactgactactaccaccggacggacccacggtcgactacctacccgacgaccgtaggttacgaggttcgggaccgtaggtcggggtacgttacgggtaaccgtaacgtacccgtttacaacgttaccctaacccgtaactaactaccggtaccggaaccgtacggtaaccctaggaaccgtcccggtaaaggtaaagtttacttttacgggaactttaacgttttaacgtttaccggttacgttaccgttacggtacgttacggtacccgttaagaccgtaaccgttacggtaacccaacgttaccccgggttaccggaaccgtacgggtaaccaccggttaagtacgggaacttaacgtaaaccgtagttaccggacggtcgtaccacgtacggtactaccgtttacgtacctttactccgttacccgtcccg

SEQ ID NO: 109728 - DNA, 742 bp, Homo sapiens
  misc_feature: GYAE6OF02HPDUP.33.70.G04.1.454.CMB.1.raw
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
tcagtacacacactcacgaccggtgctcgatttagtgtagtgtgaagggaaagggggaggactgctcagttaggacccagagggaaccatggaagccccagctcagcttctctcctctgctactcgtggctccagactaccgaccgggtaattgtgttcgacacagtctcacgccacctgtctttgctccgagagaaacgcgccaccctctacatcgacagggaccagtcgagtacgtattaacgctaacttcgttcgttacggccttcggtaaccaactaacggtaaaacccgttggaccccgaacggtacccgtacccgaacggtccttacctacgacttaccgaagtacctagtactacttacgaaccgacggccaaccgtggacaccgtaccgngaccgtaggtctaggtggacnggttacgggccttagggacaacgttcctcgtaccgtactaccgaactacgtcacgtaccacgtacccgtaagtactacccggtaagtaacgtttaaggttttcgactttaaacggttttacttaacgtacctttcgtacgttaccgacggtaactttacggatacccgttaacggtaccttaacccgtccggttaaccgaacggaacgggtaaccctacggtaaacggtgtaacccgtttaaggtaaacccggtagttacggacggttaacgaccgtttacccaacgttacgttccgtactttaccgttacttaacccgtccc

SEQ ID NO: 109729 - DNA, 625 bp, Homo sapiens
  misc_feature: GYAE6OF01BK5ST.19.48.E04.1.454.CMB.1.raw
tcagtactctcgtgcacgaccggtgctcgatttagagagcgtcacagagagaaggggagagaggagccttagccctggactccaaggcctttccacttggtgatcagcactgagcacagacgactcaccatggaattggggctgagctgggttttcctcgttggtattttagaaggtgtccagtgtgaggtgcacctgggtggagtcgtggggggaggcttggtccagccgtggggggtccctgagactctcctgtacaggctctgggttctcctttagtagttattggatgaactgggcccgccaggcgtccgggggaaggggccggaggtggggtggccaaacgataatgacaagagtaggaactgaagaaaaactagtgggggactcgtgtaggaacgggccgtattccacctatcctccaagagaaccaaccgtaagaacttacttcgtttctagacaaatgaacagcctagacgacgaccggaggaccacgggctggtagtattagttggtggacggaagggcaggtcgggtcgtggggacgaggttcgggaccggttcggacgggggacccgaaacgggggaccctaccgggtacccacccggttccgtcccgtaccgg

SEQ ID NO: 109730 - DNA, 744 bp, Homo sapiens
  misc_feature: GYAE6OF01A4PP1.19.48.E04.1.454.CMB.1.raw
tcagtactctcgtgcacgaccggtgctcgatttagagagcgtcacagagagaaggggagagaggagccttagcccctggactccaaggcctttccacttggtgatcagcactgagcacagacgactcaccatggaattggggctgagctgggttttcctcgttggtattttagaagtgtccagtgtgaggtgcaccgtggtggagtcgtgggggagcttggtccagccgtggggggtccctgacgactctcctgtacaggtctcgtggttctcctttagtagttatggatgaacgtcgggcccgccgaggccggtaccggggggaacgggggccggtaggtcggggtcggacccaaacgaagtaagtcggacaaaggtagtagggaacttaggaaacgtaaaaaaccgtaggttacgggggacttcgtagggtacggaaacggggtccgtaatttacccgaacctaactacctacccgaaggaacggaaccgtaaaacccgttaaaggtaacccttttaagttacggttttaccaacggtacctaaaaagtaccgaaactacggtacccgttagaacggtaccggaccggaacggaccgtacgggcttagtagttatttaagttggtacgacgggtaagggcgtaaggtcggccggtagggacgtacggtagggtacggttccggtacggggacccgaaacggggacccgtacgggttacccaacccggttccgtccgtacccg

SEQ ID NO: 109731 - DNA, 980 bp, Homo sapiens
  misc_feature: GYAE6OF01CNGM4.19.48.E04.1.454.CMB.1.raw
tcagtactctcgtgcacgaccggtgctcgatttagagagcgtcacagagagaaggggagagaggagccttagccctggactccaaggtcctttccacttggtgatcagcactgagcacagacgactcaccatggaattggggctgagcgttggttttcctcgttggtattttagaaggtgtccagtgtgaggtgcacgtggtggagtcggtgggggacgtcgttcggtccgacggtccgggtcggggggtccctaggacgtaccttccttccgtaggtaccgtaggtccttcgtcggggtttccttaccgttttaggttagtttaagttgggtaatcggtaaccgtcggggccccgcggaagggcccggttaccgggggggaacggggccggagggttacgggggttcgacccgaaagtataaagtcggaacgaaaggtacgtagggtaaacctagggaaaacgtaaaaaacgttgggtacggggaacttcggtagggtaacgggaaccggggtccgtaacgtttaccgaaccgttacgtaccgtacccggaaaggaaccggtaaacccgtaaaacccggttaaaaggttaaccccttttaacggtttacgttttaaccgtaacgggtaaaccttaaaaacggttaggaaaacccgttaaccggaccccggttaaaggaaacgggtaacccgggaacccgggttaacgggaaccccggtaacgggttaccgttaacggggtttaaggttttaaacgttttaagggtttaccgggttaagggtaaacccgggggtaacggggtaacggtacggggttttaaccgggccgggtttaacgggggaaaccgtacggggttacggggttaacccgggtttccgggaaacccggggggggtaacccggaaaaacccgggggttccccggtaaacccgggttaccccggtaaaccccgggttcccgttaaccccgggtaaccccggg

SEQ ID NO: 109732 - DNA, 542 bp, Homo sapiens
  misc_feature: GYAE6OF02G1XRG.19.48.E04.1.454.CMB.1.raw
tcagtactctcgtgcacgaccggtgctcgatttagagagcgtcacagagagaaggggagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgcaggctccgggggaaggggccggagtgggtggccaacataatgcaagatggaactgaagaaaaactagtggggactctgtgaatggccgattcacatctcagagaacaaccgtaagaacttactgtttactgacaaatgaacagcctgagagccgagacacggctgtatattatgtgcgaaggcagtgcgtgggacagtgggacgtcgtgggaccaagggcccacgggtccaccgtctacccg

SEQ ID NO: 109733 - DNA, 562 bp, Homo sapiens
  misc_feature: GYAE6OF02G09TA.19.48.E04.1.454.CMB.1.raw
  modified_base (466)..(466): a, c, t, g, unknown or other
  misc_feature (466)..(466): n is a, c, g, or t
  modified_base (477)..(477): a, c, t, g, unknown or other
  misc_feature (477)..(477): n is a, c, g, or t
tcagtactctcgtgcacgaccggtgctcgatttagagagcgtcacagagagaaggggagagaggagccttagccctggactccaaggcctttccacttggtgatcagcactgagcacagacgactcaccatggaattggggctgagcgtggtttcgtcgtaggtactttagaagtagtcagtgtgaggtgcacctggtggagtctgggggaggcttggtccagcctggggggtccctgagactctcctgtacaggctctgggttctcctttagtagttattggatgaactgggcccgccaggctccgggggaaggggcccggaggtgggtggccaacagtaatgcaagatggaactgagaaaaactgtggggactcgtgtagaagggcgattcacatctccagagacaacgtaagaacttactgttctgcaaatgaacagcctagagacgcgaggacacggctgtntattattgtgngaagggctagtggcgtgggactgtcgggacgtcggtcggggaccgaacggggaccgtacggtccgaaccggttcctaccgtaccg

SEQ ID NO: 109734 - DNA, 587 bp, Homo sapiens
  misc_feature: GYAE6OF02HZB26.19.48.E04.1.454.CMB.1.raw
tcagtactctcgtgcacgaccggtgctcgatttagagagcgtcacagagagaaggggagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttgggtccagccgtggggggtccctgagactctcctgtacaggctctgggttctcctttagtagttattggatgaactgggcccgcaggcgtccgggggaaggggccggaggtgggtggccaacataatgacaagataggaactagaagaaaaactagtaggggactcgtggtagaagggccgattccaccatctaccagacgaacaaccgtaagaacttactagtttctgacaatcgaacgagacctgagagaccgaggaccgacggctaggtgtattagttgtagacggaaaggcgagtggacgtgggacagtggacgtcgtacggggaccgaagggacccgacgggttaccaccggttcctccctacg

SEQ ID NO: 109735 - DNA, 779 bp, Homo sapiens
  misc_feature: GYAE6OF02JA01P.19.48.E04.1.454.CMB.1.raw
tcagtactctcgtgcacgaccggtgctcgatttagagagcgtcacagagagaaggggagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtggggggtccctgagactctcctgtacaggctcgtgggttctcctttagtagttattggatgaacgtgggcccgcaggccgtaccgggggaaggggccggaggtgggtcggacccaaacgaataaagtgacgaaaggtagtacggaaactaggaaagaaaaaaccgttagtacggggggaactccgtagggttagggaaacggggaccgtaacgtttaccaaccctaagttaccctacccgaaggaacggaaacccgtaaaacccggttaaaaggtaaacctttacgtttacggttttactacggtaactaaaaaggttacgaaaaccgtacggtccccgttaaggaacggaaccgggacccggaaacgggaaccggaaccgggtcgtttaacggttacgtttaacgttttaagttcgggttaaggacgggaaaacggggtcgtaagggtcggccgttaggggaacctaggttagggtaccggttcgggacggggtaacccgaaacgggggtaccctaacgggttcccgacccgtaccgtcccgtaaccgg

SEQ ID NO: 109736 - DNA, 830 bp, Homo sapiens
  misc_feature: GYAE6OF02JQ23S.19.48.E04.1.454.CMB.1.raw
  modified_base (241)..(241): a, c, t, g, unknown or other
  misc_feature (241)..(241): n is a, c, g, or t
  modified_base (418)..(418): a, c, t, g, unknown or other
  misc_feature (418)..(418): n is a, c, g, or t
tcagtactctcgtgcacgaccggtgctcgatttagagagcgtcacagagagaaggggagagaggagccttagccctggactccaaggcctttccacttggtgatacagcactgacgtacagacgaactcaccaattgggaatttggggctgaggtctgggttttccgtacgttggtagtttagtagtgtcagtgtgtaggtgactacgtggtgagtcggtggggtaggtcgttcgtaccgngggtcccgtcggggtccgtacgtacgtacctcgttaccgtacggtaccgtacggtcggttccgttccggtttacgttacgttttaagttaggttagttggtaacgtacggtccggtccggaccggacggtccggtacgggggtacggggtccggtacgggtcggtacggtaaacgtnaactaacgtagagtaggtaacgtacgtaacgtaaacgtccgtaaccggttaacgttacgggtacggtccgtacggtacgtaacggtaccggtacttactaccgtacgtacgtacgtaacgtaacgtaacgtaaccgttaacgaaacgttaacgttacgttacgtaacgtaaccgtaaacggttaacgtaacgtacggaaccggtaacggtacggtaacggtacggtaacggtacggttacggttacgtttaggttaaggttaggtaggtacggtaacgggtacggttaacgtaggtaacggtacgggtacggtaccggttaacggtaccggtaccgggtcgggtaactaggggtacccgtaccgggttaccgtaaccggtacccgtacccgtaccgtaccggtcccgtaccg

SEQ ID NO: 109737 - DNA, 699 bp, Homo sapiens
  misc_feature: GYAE6OF01BWG52.35.2.A02.1.454.CMB.1.raw
tcagtacagatcgtcacgaccggtgctcgatttagactcatctactagggaaaggggcgaggagtcaccgtccccaaccgtacggacactagcattgggacatgagggtccctgctcagctcctaggggctcctgctggcttcgtggctcccaggtggtccctaagtgtgacttaagtcgaaactgacccagtctccttccacctgtctggcatcggtgtaggtagaaacgcgtccaccggactcacttcgccggaccagtcagagtacttagtaattggttggccttggtatctagcagtaaaccagggaaacgcccctaaacgtccctgatctttaacggcgtcgtactttagagtagtgggtcccatcaaggttcagcggcagtagatctagggactagtactcaactctcaccgaagtccaccagtccctacgacacgtccctaggacttacgtacttttacggacctaacccgttatttaccgttacgtacccctaaacgtaaggttacgttgggtacgtaacgtttcccggtacgtaaccgttttccgggaccccgttagggggaacccctaaaacgggttcggtaattacgttaaccgtaaaaccggtaaccgttagggtacgggtccgtacggtacccgtaacccgtacgttacccgttagggtttccgtttccggacgtttacccccggg

SEQ ID NO: 109738 - DNA, 650 bp, Homo sapiens
  misc_feature: GYAE6OF01BYN0G.35.2.A02.1.454.CMB.1.raw
  modified_base (201)..(201): a, c, t, g, unknown or other
  misc_feature (201)..(201): n is a, c, g, or t
tcagtacagatcgtcacgaccggtgctcgatttagactcatctacagggggcttcagctgtgggtagagaagacaggactcaggacaatctccagcatggccagcttccctctcctcctcaccctcctcactcactgtgcagggtcctgggcccagcctgtgctgactcagccaccctcagcgtcgtcggggacccccggnagacgggtcaccatctcttgttctggaagcacgctccaacatacggaagtaatactagtaaactcggtaccagcagcctacccgaaggaacccggaccccccaaactcctacacttactaataaataataactcgaacgccggacccctagaacggtacctccctaggacccgtatttccgtcgtcgggtacccttaccgtaacgttccgtacggaccaaacccgcccgggtcccctaccccgtacgaccctacttccgtaccgtcgggacctccgaacgggtcctacggaccggacgtacggtcttagtactttaacttacgtgctacgctacaattaacacgaagccagacagcctacttcgtcggttcggttccgggacgggacggtacacggtcgtaccggtacccgtcgtacggtaccaacggcccgaaggtcccgtaccccgg

SEQ ID NO: 109739 - DNA, 548 bp, Homo sapiens
  misc_feature: GYAE6OF01ATHW9.35.2.A02.1.454.CMB.1.raw
  modified_base (210)..(210): a, c, t, g, unknown or other
  misc_feature (210)..(210): n is a, c, g, or t
  modified_base (428)..(428): a, c, t, g, unknown or other
  misc_feature (428)..(428): n is a, c, g, or t
tcagtacagatcgtcacgaccggtgctcgatttagactcatctacaggggggggaagctcagcttcagctgtgggtagagaagacaggactcaggacaatctccagcatggtcagcttccctctcctcctcaccctcctcactcactgtgcagggtcctgggcccagcctgtgctgactcagccaccctcagcgtctgggaccccccggnagaggtcaccatctcttgttctggaagcagctccaacatcggaagtaatactgtaaactggtaccagcagcctcccgaggaaccgcccccaaactcctcatctaataataataatcagccggccctgacggactcccctgaacccgtattcctctcggcctccaagtctggaccacctcacgccctccctggccatcaagtcggctccgagtctgagntgagctgattattactgtcgcagctagtcggacagtcgactacgtccgtcggtccgttggttcggttttggggtcgttccgggacggtacgggaaccaggtccgtcggtcccgttccccg

SEQ ID NO: 109740 - DNA, 811 bp, Homo sapiens
  misc_feature: GYAE6OF01EV4W3.35.2.A02.1.454.CMB.1.raw
  modified_base (57)..(57): a, c, t, g, unknown or other
  misc_feature (57)..(57): n is a, c, g, or t
  modified_base (233)..(233): a, c, t, g, unknown or other
  misc_feature (233)..(233): n is a, c, g, or t
  modified_base (675)..(675): a, c, t, g, unknown or other
  misc_feature (675)..(675): n is a, c, g, or t
  modified_base (773)..(773): a, c, t, g, unknown or other
  misc_feature (773)..(773): n is a, c, g, or t
tcagtacagatcgtcacgaccggtgctcgatttagactcatctacaggggggggaanctcagcttcagctgtgggtagagaagacaggactcaggacaatctccagcatcggccagtccttccctctcctcctcaccctcctcactcacgtgtcgcgacgggttccgtcgggcccagtcctgtcgctcgactcgacgccctaccctgacgtcggtccggaccggggaccccgngagggtacgtccactcttcgttcgttcgtcgtaggaactccgttacgtaaccaactacggtaacggaacgtactaacgttacgttaacgttaaaccggtccggtaacccgtacctaaccgttaccggaaacccggtaaccccgtacccctaaaccgttccttacgttaactttaacgtacggtactaaacttacgtacggaccgggtaccccgttcccgttaaccgggtacccgggttcccgtaaccggttaaccgttctttaccgttccggtacggtccttaacggtacgtttcgaccggtaccctaccgtcgacccgttcccgtaccgtacgacctacgttaaccgtacggttccgtaccttacgtacgtcggaggtacgtcgtagtcgttacgtattacgtttaactcggtcgagtcctaaggtcgacggttacacgtnttacccgtattccgtacggttccgtttacgggtttcggtttcgggtttcgggtaccggggtaccgggtacgggtaacccgtacgtcccgggtttaccncccgggttacccctttcggcccgtaaccgtaccccggg

SEQ ID NO: 109741 - DNA, 757 bp, Homo sapiens
  misc_feature: GYAE6OF01CNEUJ.35.2.A02.1.454.CMB.1.raw
  modified_base (219)..(219): a, c, t, g, unknown or other
  misc_feature (219)..(219): n is a, c, g, or t
  modified_base (608)..(608): a, c, t, g, unknown or other
  misc_feature (608)..(608): n is a, c, g, or t
tcagtacagatcgtcacgaccggtgctcgatttagactcatctacgaggggggggaagctcagcttcagctgtgggtagagaagacaggactcaggacaatctccagcatggccagcttccctctcctcctcaccctcctcactcactgtgcacgggtcctgggcccagcctgtgctgactcacgcccaccctcgagcgtcgtaccggggacccccggnaggacgggtccacctattcttcttgttcgtggacgcgtctaccgtaacaacgtacggtaacggaactactaacttacgttaaacgtacggtacccgtaaccctaaccgtaaccgtaccggaaacccggtaacccccgaaccccttaaccgtcctaacgttaacgtacgtaggttaataacttaccgaccggacggtccccgtaccggtacgggtcccggtaccgtacgtaccttacttcgtcgtcgtacctacgtacgtacgcgtaccctcgtccctccgtccgttcccgacgtaccttacgtaacgtcggtacccgtacctacgggttagtaaccggaggtaccgtaggtccggtagttaccgtttaatttaacgttaccggttcggngtaccggacgtaacggtaccgttgaacgttccaacgtacgttacgtcgtaccggtttcggttcgggtttacgggttcggggtttccggaacgggttacgggaccggtacgtaacgtcttacccgggcgttaccctccgaacggtacccg

SEQ ID NO: 109742 - DNA, 602 bp, Homo sapiens
  misc_feature: GYAE6OF02H0TNN.35.2.A02.1.454.CMB.1.raw
  modified_base (212)..(212): a, c, t, g, unknown or other
  misc_feature (212)..(212): n is a, c, g, or t
tcagtacagatcgtcacgaccggtgctcgatttagactcatctacagggggggggaagctcagcttcagctgtgggtagagaagacaggactcaggacaatctccagcatggccagcttccctctcctcctcaccctcctcactcactgtgcagggtcctgggcccagcctgtgctgactcagccaccctcagcgtctcgggacccccgggnagagggtcaccatctcttgttctggaagcagttccaacatcggaagcaatactagtaaactggtacccgcctaacttccaggaaccgacccccaaactcctcatttacagtgataatcacgcggccctcgacggggtccctgaccgattctctggctccaagtctggcacctcacgccctcccgtggccatcaagtcggctcagtctgaggatggacggtctgtatttattactggtgcagctagtcggactagtgacctacgttccgtcggtcccgtttgggtttccggttttgggggttacggtttccgggggaccgggtaacggggaacccgtaacgggtccgttaccgggtacccccggttcccgttccccggtacgtaacccggg

SEQ ID NO: 109743 - DNA, 746 bp, Homo sapiens
  misc_feature: GYAE6OF02GU5NN.35.2.A02.1.454.CMB.1.raw
  modified_base (212)..(212): a, c, t, g, unknown or other
  misc_feature (212)..(212): n is a, c, g, or t
tcagtacagatcgtcacgaccggtgctcgatttagactcatctactagggaaagggggcgaggagtcagtcccaaccaggacaccagcatggacctatgtagggtccctgctcagctcctgggctcctgctgctctgctctcgaggtgccagtagttcgtgacatcctagatcgacccagtctccagtcctcctgtctgcatcgtggtgganacagagtccgacctatcacttcgccgagtctagtccacggtactaacgtttaactccttaaacttttaaacgttggtataccaaactacgtaaagtccgaggtaaccgtaaaccgtaccccttaaaacgtccctacgtacgttaccggtacgtacgtcgacgtacgtacccgtaagtttacggaaacgtacgggtaccctaagtacggtaagtaacgttacgtaacggttaggaaacgtgtacgtcggtacggggtacgtaaggtttacttttacctaaccgttaacccgtaacgttcgaacggtaccaaacgttacccgtacggtacctaacgttccgttaaggtaaacgttataaacgttagaacctaaactaattacctaaacgtcgtaaaccgtaaacgtaacgttacgttagtaacttaccgtacttacggacccttaagtaccgttaaccgtttaacgttccgggtaacccggtaacgggtaaccgttaaggttccgggaataccgtaacgtacgttacgtaacccgg

SEQ ID NO: 109744 - DNA, 696 bp, Homo sapiens
  misc_feature: GYAE6OF02IHHNA.35.2.A02.1.454.CMB.1.raw
  modified_base (192)..(192): a, c, t, g, unknown or other
  misc_feature (192)..(192): n is a, c, g, or t
  modified_base (211)..(211): a, c, t, g, unknown or other
  misc_feature (211)..(211): n is a, c, g, or t
  modified_base (252)..(252): a, c, t, g, unknown or other
  misc_feature (252)..(252): n is a, c, g, or t
  modified_base (359)..(359): a, c, t, g, unknown or other
  misc_feature (359)..(359): n is a, c, g, or t
tcagtacagatcgtcacgaccggtgctcgatttagactcatctacagggggggggaagctcagcttcagctgtgggtagagaaggacagggactcaggacaatctccagcatggccagcttccctctcctcctcaccctctcactcactgtgcagggtcctgggcccagcctgtgctgactcagccaccctnagcgtctcgggaccccggnaggagggtcaccatcctcttgttctaggaagcagttccaanatcggaagcaagtacctgtaaaactggtaccgccaacttccgaaggtaaccggccccccaaaacttccgtacactttacagtcgataatcagcgcctgacgggtccngaccgtattctctcggcctacgaagtctggctacctcacgtccctcccgtggccacgtacaaagtcggggccttccgaagtcctggaacgggtacgtaggtaacgggtcctaggttaactttactttaacgtgggttacgtacgtaagccgtaagtgggtacaacgttcgaaccgttaacgttcccgttagtacccggttttcgggttttaccggtttttcgggggtttacggtttaccgggggtacccgggtaacgggggtaaccccgtaacggggttcccgttaaccgggtaacccccggtttaccccggtttacccggtaccgtaaccccgggg

SEQ ID NO: 109745 - DNA, 641 bp, Homo sapiens
  misc_feature: GYAE6OF02FYETV.35.2.A02.1.454.CMB.1.raw
  modified_base (215)..(215): a, c, t, g, unknown or other
  misc_feature (215)..(215): n is a, c, g, or t
  modified_base (258)..(258): a, c, t, g, unknown or other
  misc_feature (258)..(258): n is a, c, g, or t
  modified_base (288)..(288): a, c, t, g, unknown or other
  misc_feature (288)..(288): n is a, c, g, or t
tcagtacagatcgtcacgaccggtgctcgatttagactcatctacagggggggggaagctcagcttcagctgtgggtagagaagacaggactcaggacaatctccagcatggccagcttccctctcctcctcaccctcctcactcactgtgcagggtcctgggcccagcctgtgctgactcagcccaccctcagccgtctcggggacccccgggnaggacgggtccaccatctcttgttctggaagccagttccaaanatcggaagcaatactagtaaactggtaccnctaacttccgaaggaaccggacccccaaactcctactactttacagtgaataatcaagccgcctacgacggggtccctgaccgtattcctctggcctccaaggtctcggcctacctcacgtccctcccgtggcccattccaagtcgggccttcccgagttcctaggacgtatggacggcttagatttaacttctggtcgacaaggtcaacgtggacctagtaccgactacgttcctcgtaccgttgggttaccgttttcggggtcggtttaccggggaccgggtaacgggtaacccaacgggttacccgtaccgggttacccccgttcccggttacccggtcgtaaccccggg

SEQ ID NO: 109746 - DNA, 693 bp, Homo sapiens
  misc_feature: GYAE6OF02ICFAP.35.2.A02.1.454.CMB.1.raw
  modified_base (201)..(201): a, c, t, g, unknown or other
  misc_feature (201)..(201): n is a, c, g, or t
tcagtacagatcgtcacgaccggtgctcgatttagactcatctacagggggcttcagctgtgggtagagaagacaggactcaggacaatctccagcatggccagcttccctctcctcctcaccctcctcactcactgtgcagggtcctgggcccagcctgtgctgactcagcccaccctcagcgtcgtcgggacccccggnaggacgggtcaccatcttcttgttctggaagcagcctaccaacatacggaataactactagtaaacgtcggtaccagcacgcctacccgaacgggaacccgacccccaaacttccctactacttacttaataaataactaactacgacggtccgtaccctagaacgggtacctccctacgaccgttactttccgtcgtacggcctacgtaacggtcgtcggtcccgccttaccgaccgtccccgttaccgtcggaccctagttccggtacgggtcgggtcctacccggtagtacgtagggaacggtacggtcggtacggtactagttacttacgtcgtacgtgtacgcgtagtacgtaggtcggatcgtaacgtacgtcgtaggtagggttggggttaggtttacggttcggggaccgggtaacggtaacccgacggtacgttaccggacccggttacgtaccgggttccacccggtacccggtaacccggg

SEQ ID NO: 109747 - DNA, 849 bp, Homo sapiens
  misc_feature: GYAE6OF02GN4NR.35.2.A02.1.454.CMB.1.raw
  modified_base (227)..(227): a, c, t, g, unknown or other
  misc_feature (227)..(227): n is a, c, g, or t
tcagtacagatcgtcacgaccggtgctcgatttagactcatctacagggggggggaagctcagcttcagctgtgggtagagaagacaggactcaggacaatctccagcagtggccagcttccctctctccctcaccctcctcactcacgtgtgcacgggtcctcgggcccacgcctggtcgctagacctcagcccaccttgagcgtccgtacggggaccccccgggnaaggtacgggtccacctactccgtttcgttgttccgtgggaaccgtaccgtcgttaacccgttaacgaacttaacgggaacgtaacggaacttaaactaaccggttaaacgtaaccggtacccgggttacctaaacccgttaaccctaccgggaaacccggttaaccccgaaccccgttaacctccttacgtaacttacgagtactaacttaacgaccgcggtacccctaccgtacgggttccggtaaccgtccggtaacctttcgtaaccgtccgttaacggtccccgttaacggacgttccggtcgtaaacccgttccccggacgttacccgaacccgttccggtaccgttaaccgaccgtttacggaaccgggtttccggtaacccgtaccgttaggtccgttaacgggaggttacggaacggttaccggtagttacgttaacgtaacggttttcgaagttccggaacgtcggtacgtaccggtacgttaacgcgtaccgaacctcggttcccgttaccggttacgtttcggggtttacctgggttaacccgggcgggtaaccggttaaccgaccggtcgttacccggttcccgtaccgtaccgttacccgtaaccggg

SEQ ID NO: 109748 - DNA, 232 bp, Homo sapiens
  misc_feature: GYAE6OF01CCG57.13.82.H05.1.454.CMB.1.raw
  modified_base (231)..(232): a, c, t, g, unknown or other
  misc_feature (231)..(232): n is a, c, g, or t
tcagtcacgtactacacgaccggtgctcgatttagtcgagctctctcgcggggcccaggcagaagatgaatctgattattactgtgttctttatatgggtagtgccatttctgctgtgttcggaggaggcacccgactgaccgtcctcggtcagcccaaggctgccccatcggtcactctgttcccaccctcctctagtacgtgactgagcgggctggcaaggcgcatagnn

SEQ ID NO: 109749 - DNA, 232 bp, Homo sapiens
  misc_feature: GYAE6OF02G3DCD.13.82.H05.1.454.CMB.1.raw
  modified_base (231)..(232): a, c, t, g, unknown or other
  misc_feature (231)..(232): n is a, c, g, or t
tcagtcacgtactacacgaccggtgctcgatttagtcgagctctctcgcggggcccaggcagaagatgaatctgattattactgtgttctttatatgggtagtgccatttctgctgtgttcggaggaggcacccggctgaccgtcctcggtcagcccaaggctgccccatcggtcactctgttcccaccctcctctagtacgtgactgagcgggctggcaaggcgcatagnn

SEQ ID NO: 109750 - DNA, 231 bp, Homo sapiens
  misc_feature: GYAE6OF02F5GDE.13.82.H05.1.454.CMB.1.raw
  modified_base (230)..(231): a, c, t, g, unknown or other
  misc_feature (230)..(231): n is a, c, g, or t
tcagtcacgtactacacgaccggtgctcgatttagtcgagctctctcgcggggcccaggcagaagatgaatctgattattactgtgttctttatatgggtagtgccatttctgctgtgttcggaggaggcacccggctgaccgtcctcggtcagcccaaggctgccccatcggtcactctgttcccacctcctctagtacgtgactgagcgggctggcaaggcgcatagnn

SEQ ID NO: 109751 - DNA, 233 bp, Homo sapiens
  misc_feature: GYAE6OF02H2BQG.13.82.H05.1.454.CMB.1.raw
  modified_base (233)..(233): a, c, t, g, unknown or other
  misc_feature (233)..(233): n is a, c, g, or t
tcagtcacgtactacacgaccggtgctcgatttagtcgagctctctcgcgggggcccaggcagaagatgaatctgattattactgtgttctttataatgggtagtgccatttctgctgtgttcggaggaggcacccggctgaccgtcctcggtcagcccaaggctgccccatcggtcactctgttcccaccctcctctagtacgtgactgagcgggctggcaaggcgcatagn

SEQ ID NO: 109752 - DNA, 592 bp, Homo sapiens
  misc_feature: GYAE6OF01BZZEQ.10.7.A07.1.454.CMB.1.raw
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagcggtgttcgctaggcgtcttaagaggtgtcagtgtcagggcagttggtgagtctggggagcgtggtccagcctgggngtccctgagctctcctgtgcagtcctntggattcatcttgagttgctggtgcgttcacgtgggtccncgagcncgagcgaggtctggtacgtgggtagagagtatagtacgagtagtagtagtaggtaagtacgtagtacgtacgtacgtacgacgtacgtacgagtaggtacggtacgtacttactactacgtacgtacgtacgtacgtaactaacgtaaccgaacgaacgacgtacgtacgtactactaacgtaacgtaacgaacgacgtaccgtacgtacgtacgtacggacggtaccggtcggtcgtacgttacgtacgtacgtacgtacggtaacggtacggtaggttaggttagttggttagg

SEQ ID NO: 109753 - DNA, 507 bp, Homo sapiens
  misc_feature: GYAE6OF01BXSB0.10.7.A07.1.454.CMB.1.raw
  modified_base (473)..(473): a, c, t, g, unknown or other
  misc_feature (473)..(473): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggggcagttggtggagtcgtgggggaggcgtggtccagcctgggagtccctgagactctcctgtgcagcctctggattcatcttcagttgctgtggcgttcacgtgggtccgccaggctccgaggcaaggggctggactgggtgcagtaatatcagatgatggaagtactgtatactacgcagactcagtgaagggccgattcactatctccagacgacaataccaagaacacagtgtctctaccaatgaacagctcgcgacgtgacggacgcggtgtctattcngtagacgtaaggtaggtagtgggtatcggtttag

SEQ ID NO: 109754 - DNA, 537 bp, Homo sapiens
  misc_feature: GYAE6OF01BIL4W.10.7.A07.1.454.CMB.1.raw
  modified_base (452)..(452): a, c, t, g, unknown or other
  misc_feature (452)..(452): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggggcagttggtggagtcgtgggggaggcgtggtccagccgtgggaggtccctgagactctcctgtgcagcctctggattcattcttcagttgctgtggcgttcacgtggtccgccaggctccaggcaaggggctggactgggtgcagtaatatcagataggatggaagtactgtatactacgcaagctcagtagaagggcgtatcacttatcctaccagagactaataccaagaacacagtcgtctctaccaaagtcaacacncctcgcgacctgacggaccgcgggtacgtcttacgttcgtagtcggacgtaaaggagggttaagttagggaagttacggtttagg

SEQ ID NO: 109755 - DNA, 523 bp, Homo sapiens
  misc_feature: GYAE6OF01AZ871.10.7.A07.1.454.CMB.1.raw
  modified_base (300)..(300): a, c, t, g, unknown or other
  misc_feature (300)..(300): n is a, c, g, or t
tcagcatagtagtgcacgaccggtgctcgatttagcacgtgtcgcagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggggcagttggtggagtctgggggaggcgtggtccagcctgggaggtccctgagactctcctgtgcagcctctggattcatcttcagttgctgtggcgttcactgggtccnccaggctccaggcaaggggctggactggggtgcagtaatatcagatgatggaagtactgtatactacgcagactcaggtgaagggccgattccactatctccagagacaattccaagaacacagtcgtctactaccaaatacgaactagccctagccgacgtgacggacggcgggtcgtctattacgtgtgacgtaaaggagggtagttgggagttgtttagg

SEQ ID NO: 109756 - DNA, 567 bp, Homo sapiens
  misc_feature: GYAE6OF01BPTJB.10.7.A07.1.454.CMB.1.raw
  modified_base (310)..(310): a, c, t, g, unknown or other
  misc_feature (310)..(310): n is a, c, g, or t
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
  modified_base (509)..(509): a, c, t, g, unknown or other
  misc_feature (509)..(509): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggggcaggttggtggagtcgtgggggagcgtggtccagcctgggagtccctgacgactctcctgtgcagcctcgtggattcattcttcagttgctggtggtcgtttcacgtcgggtcccnccgaggcctaccgaggccgaaggggcctgggacgtggggtgcaaggtaatagtcgagatggagtggaagtactagtaatactacgcagactacgagtagaacgggctattcactatctaccaagagactaacttacgaanaacanagtctactactaccaaatagaacngtaccngaccgtacgtagacggacgcggtntactacttacgtggtagaacgtaaaggtacggttagttagggtaagttcggtttaagg

SEQ ID NO: 109757 - DNA, 642 bp, Homo sapiens
  misc_feature: GYAE6OF01CKWPD.10.7.A07.1.454.CMB.1.raw
  modified_base (178)..(178): a, c, t, g, unknown or other
  misc_feature (178)..(178): n is a, c, g, or t
  modified_base (323)..(323): a, c, t, g, unknown or other
  misc_feature (323)..(323): n is a, c, g, or t
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
  modified_base (395)..(395): a, c, t, g, unknown or other
  misc_feature (395)..(395): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagtcttgggttttcctcgttgcttcttttaaagnggtgtccagtgtcgaggggcaggttggtggagtcggtggggggagtcggtggtccaggccgtggggacgtccctggagcctctccgtgtcgcacgcctctggattcattcttcgagttgctggtggtcgttcgacgtcgggtccnccgaggcctccgaggcgaagggctggacgtgggngcagtaactncagatganggatactgtactacgacganagactcgaggtaggaacgggtcctaattcgaacttataccgtacgaagtaacgaactaaacgttaacccaaagtaaaccaagtaacgttaccgtaccttaacctacccgtaaaaagtacgaaacccacgtacccgtacgaacccggtaccgtaaggaccgggtaacggtccggggttacgttaccttagttacgtgtacggaacggtaaggtaacgggttaggttagggaaaggttcgttttaaggg

SEQ ID NO: 109758 - DNA, 758 bp, Homo sapiens
  misc_feature: GYAE6OF01C79G1.10.7.A07.1.454.CMB.1.raw
  modified_base (323)..(323): a, c, t, g, unknown or other
  misc_feature (323)..(323): n is a, c, g, or t
  modified_base (364)..(364): a, c, t, g, unknown or other
  misc_feature (364)..(364): n is a, c, g, or t
tcagcatagtagtgcacgaccggtgctcgatttagcacgtgtcgcaggggagctctgggagaggagcccagcactagaagtcggcggtgttccattcggtgatcagcactgaacacagaggactcaccatggagtttgggctgagcttgggttttcctcgttgcttcttttaagaggtgtccagtgtcgaggggctaggttgggtggagtcggtgggggaggcgtggtccaggccgtgggacggtcccctgacgtctcctcctgtcgcagccctgtggtacttcatcttcagttgctgtcggtcgttcgacgttcgggtcccnccgaggtcctccggaggccgaaggggctcgggacgtggggngactagtaatagtacgaggtagttacggaagtagggtaaagttacgttagtaacttaaccgtacggtacaacggtaccgtacggtaaggtacgggaaccgggtaccgttaacttacccgtacttaaccttaccgtaccgaaacgtaaccggaacttaaaccgttaacccgaaacggtaaacctacgtaacggttacttacccgtaaccctaacgtaaaacgtaccgaaaccgtaccgtacccgtaccggaacccggtaccgtacgggaaaccgggtaccgtacggggtttaccgttaacgtttaacggtttaccggttacgggtaaccggtaacgggtaaaacgggttacggggttaaggtttaaggggttaaccgtttcgggttttaaagggg

SEQ ID NO: 109759 - DNA, 681 bp, Homo sapiens
  misc_feature: GYAE6OF01E4PII.10.7.A07.1.454.CMB.1.raw
  modified_base (303)..(303): a, c, t, g, unknown or other
  misc_feature (303)..(303): n is a, c, g, or t
tcagcatagtagtgcacgaccggtgctcgatttagcacgtgtcgcagggggagctctgggagaggagcccagcactagaagtcggcggtgtttccattcggtgatcagcactgaacacagaggactcaccatggagtttgggctgagctgggttttcctcgttgcttcttttaagaggtgtccagtgtcaggggcaggttggtggagtcgtgggggaggcgtggtccagccgtggggagtccctgagctctcctgtgcagcctctggattcatcttcagttgctgtgcgttcacgtcggtccnccgaggcctccgaggcgaaggggctgggacgtggggtgcgagttaaactatcaggatggaagtaggaagttactaggtaactaaccgtacgcaagacctacgaggtacgggaacgggtaccgtactttacctaacttactacctaccgaagacgtaaacctaaacttacccgaaagtaaccaacgtacgttcgtaccgttaacctaacctaaagtacgtaaacctacggtacccgttacggacccggtaacccgtacgggaaccgggtaccggtccggggtttacgttacgttaacgtttaccggtagggttacggtaacgggtaaaacgggttaggggttaaaggtttgggggttaaactttgggtttttaaacggg

SEQ ID NO: 109760 - DNA, 726 bp, Homo sapiens
  misc_feature: GYAE6OF01CJY78.10.7.A07.1.454.CMB.1.raw
  modified_base (179)..(179): a, c, t, g, unknown or other
  misc_feature (179)..(179): n is a, c, g, or t
  modified_base (232)..(232): a, c, t, g, unknown or other
  misc_feature (232)..(232): n is a, c, g, or t
  modified_base (253)..(253): a, c, t, g, unknown or other
  misc_feature (253)..(253): n is a, c, g, or t
  modified_base (628)..(628): a, c, t, g, unknown or other
  misc_feature (628)..(628): n is a, c, g, or t
  modified_base (715)..(715): a, c, t, g, unknown or other
  misc_feature (715)..(715): n is a, c, g, or t
tcagcatagtagtgcacgaccggtgctcgatttagcacgtgtcgcagggggagctctggggagaggagcccagcactagaagtcggcggtgtttccattcggtgatcagcactgaacacagaggactcaccatggagtttgggctgagcggtggtttcgtcgtagctctttaagaggtntcagtgtcagggctagttggtggagtggtggggagcgtggtccagccgtgggngtccctgagtctctccgttgngcacgcctgtggtacttctattcttcgaggttcgtccgttggtcggtaccgtttaccgacgttcggggtcccctaaccggacggtcccttaccggtagggaccggaaacgggggtctaggggtacggttcgggggtagaccgtaaaggtaattagtaaccgtagaagtgtaggtaacgggtaattaaccgttagtaacgttaacgttaacggctaaggtacccgtaagtaaggtaacgggacgggtaccttaatacccgtaactttaacgaccttaaccggtaagaacggtaactaaaccgttaccgaaacggtaaacctaagtaacggttacgttaccttaacgtaacctaaagttcggaaacctacgtaccgngacccgacgtaccgggaggtaccggtacgggtacttaccgtaggtttacgaggttcgaaaacggtagtacgggtttataacgggttnttaaggtttcg

SEQ ID NO: 109761 - DNA, 704 bp, Homo sapiens
  misc_feature: GYAE6OF01BXI6X.10.7.A07.1.454.CMB.1.raw
  modified_base (197)..(197): a, c, t, g, unknown or other
  misc_feature (197)..(197): n is a, c, g, or t
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
tcagcatagtagtgcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtattaggagctccttagccttggtaccaacagaaatagtggccaggcctcccgaggctcctnatctatgaaacntaccaagtacgggcccactcgccatcccctgcctaggttcaggtggctaggtggtcgtggggacctagtcttcaccttctcatcatcgaggccggtacctaggacgccgtagaacgtcttacgtgtaccgttacgttttaacctacgttacgtaccgtacggtccctaacccggtaccggtaccggttccggtaccccccttaacccccgtaaaccccgttacccggttttacccgggggacccggggtaaccggggtaacccgaacgggggttacggaaacgggtaaccgtaaaccgaaaaaccgggtaccgttacgggtacggggttaccctacgggaccctaacccgtacgttacccgtttcggttaccctttccgtaacccgtttccccgttacccccgg

SEQ ID NO: 109762 - DNA, 796 bp, Homo sapiens
  misc_feature: GYAE6OF01BRYZF.10.7.A07.1.454.CMB.1.raw
tcagcatagtagtgcacgaccggtgctcgatttagcacgtgtcgcagggggagctctgggagaggagcccagcactagaagtcggcggtgtttccattcggtgatcagcactgaacacagaggactcaccatggagtttgggctgagtcttgggttttcctcgttgcttcgttttaagaggtgtccaggtgtcgaggggctaggttggtggagttcggtggggggaggcgtggtccaggccgtggggacggtccctgacgactctccgtgtgcacgcctcgtggattcattccttcagtttgccgttggtcgggtccgtttcgaccggttggggttccccgccgtagggccttcccggagggccggaagggggtccttaggggtaccgttgggggtggactaaggttaaatagtacgaagatgagtaggtaacgttactagtaataaccgtacgactaacgactcgaggtacggaacgggtccgttaattcccgtaacttactaccgtacccgtaagtaaccgtaaccgttaaacttacccgaaaacgtaaaccgtacgtaacgttcgttaaccctaacccgttaaacccgtaaaaagttaccgaaaaccgtaccggtacccgttaccggtacccggtaaaccggtacgggtaaaccggggtacccgggttacgggggtttaccgtttaaccgttaacggttttaccgtacgggttaacgggaaccgggttaaaaagggggtagggttttaaacgggtttaaggggttaaacgtttttacggtttttaaacggggg

SEQ ID NO: 109763 - DNA, 662 bp, Homo sapiens
  misc_feature: GYAE6OF01AZPW3.10.7.A07.1.454.CMB.1.raw
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagcgttgggttttcctcgttgcttcttttaagaggtgtccagtgtcgaggggctaggttggtggagtcgtgggggagcgtggtccagccgtggggacgtccctgacgtactctccgtgtgcagtccctgtggtacttcattccttacgagttgcttggtcggtccgttcacggttcgggtccgccgaggcccttacgagggccgaaggggtcctagggtaccgtggggtaggacctaaggttaactcgtacgaagagtaggagtagggtaacgttacgtagtaactacgtacgactacgtaccgtacgaggtacggacggacgtacttaccaacttcgtaccgtaccaggtaacgaactaacttaaccgaacaacgtacgtagtctacctaccactaaacgacgaacctacgtccgtacgtaccgacgtggaccggtacggcgggttacttacgttacgttcgtggtaaccggtaggtaaacgggtagggttaagttagggtacgtttcggtttaggg

SEQ ID NO: 109764 - DNA, 764 bp, Homo sapiens
  misc_feature: GYAE6OF01DNES7.10.7.A07.1.454.CMB.1.raw
tcagcatagtagtgcacgaccggtgctcgatttagcacgtgtcgcaggggagctctgggagaggagcccagcactagaagtcggcggtgtttccattcggtgatcagcactgaacacagagactcaccatggagtttgggctgagtcgttgggttttcctcgttgtcttcttttaagaggtgtccagtgtcgagggtctaggttgggtggaggtcggtgggggaggtcggtggtcccaggtccgtaggggacggtcccctaggacgaccttcgtccgtggtcgcgtacgtccctcgtaggtattcctaactttccttacgtacggttcgtcgttggttcggtcgtttaccgtaccggttcggggtcccgccgacggcccgtaccggagggacggaacggggtcgtacgggtacggttggggcgtacgtaaagttatagtacgtaagtagtagtaagttaaggtaacgttaacgtagttaacctaccgtaacgtacgaacgtaccgtacggtaaggtacgggaacgggtaccgtaacgtttaccgtaacgttaactacctaccgtaacgtaacgtaacctaacgtaaccaaacgtaacctaacgtacgttacgttaccctaccgtaaaccgtaaagtaacgaactaccgtaccgtaccggaccgtaccgtagggtaaccggtcggtacgggttactagttacggttacgtacggtaaggaacggtaaaggttaaggttaggttaacggttagtttggtttacggg

SEQ ID NO: 109765 - DNA, 639 bp, Homo sapiens
  misc_feature: GYAE6OF01BAP76.10.7.A07.1.454.CMB.1.raw
  modified_base (172)..(172): a, c, t, g, unknown or other
  misc_feature (172)..(172): n is a, c, g, or t
  modified_base (176)..(176): a, c, t, g, unknown or other
  misc_feature (176)..(176): n is a, c, g, or t
  modified_base (535)..(535): a, c, t, g, unknown or other
  misc_feature (535)..(535): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagcgtgggtttcctcgtgctctttaagnggtntccagtgtcaggggcaggttggtgggagtcgtggggggagcggtcggtccaggccgtggggacggtcccctggagcctcgtcctggtgccagcctctggattcattcttcagttgcgttggtcgggccgtttcgacgttcggggtcccgcctaggggtctcccgaagggcgaacggggggcttacggggtaacgtgggggttcggaccgtaaggtaaattaacgtacgtaaaggacgttgaaagttgggtaaacgttactagggtaactactaccggacaggtactcgaagtaggaacggtcgacttacgtactactcgttaccagtacgaactaacgttaccaacgaaactacacgtntaactccgtacaaactgaaacacgacctgacacgtgggacgtacgcgggtagtcttagtctcgtaggacgtaaagtacgggttagtacggtaagttgttaacgg

SEQ ID NO: 109766 - DNA, 695 bp, Homo sapiens
  misc_feature: GYAE6OF01BYT0R.10.7.A07.1.454.CMB.1.raw
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagcttgggttttcctcgttgcttcttttaagaggtgtccaggtgtcgaggggctaggttggtggagtcgtgggggaggcgtggtccagccgtggacggtccctgagctctccgtgtcgcacgcctctggacttcattcttcgagttgcgtggtcggtcgttcacggtcgggtcccgccgacgggcctaccgagggccgaagggggtcctgggacgttggggtcgcgtaaggttaatacgttacaggactaggagtaggaacgttacgtagtaactacctacggctaagtactacggtaggtacgggaacgggtaccggtaatttcccgaaccttattacccgtaccgtaaggaacgtaaccaacgttaccgaaagaacctacgtagtacgtacccttaaccgtaacctaaagttccgaaaccgtacgtaccgtacgtacccgtaccggttacgggacggtaccgggacgggtttacgtacgttacgttaccgtaggttacgggtaacgtaagggttacgggttaaggttcgggtaagtttcggttttaggg

SEQ ID NO: 109767 - DNA, 789 bp, Homo sapiens
  misc_feature: GYAE6OF01ERYI4.10.7.A07.1.454.CMB.1.raw
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
tcagcatagtagtgcacgaccggtgctcgatttagcacgtgtcgcagggggagctctgggagaggagcccagcactagaagtcggcggtgtttccattcggtgatcagcactgaacacagaggactcaccatggtagtttgggctgagtcgttgggtttttcctcgtttagtcttctttttaaaggaggttcgtccaggttcgtcgagggggctaggttggtggagtcggtgggggagtcgtggtccagccgtgggacgtcctgagctctcctgncacgtcctcgtggacttcattccttnaggtttgaccgttggtacggtccgtttaccgacggttcggggtcccgaccgtacgggcctacccggagggcgtaagggggtcttgggaccgttgggggtcgacgttaaggttaaattactacggaagttacgtagggtaaacgttaggggtaaactttacgttagtaaaccgttacgttaaccggacgtaacgttaccgtacgtaagggttacggaacggggtccttaagttacctaacgtcttaccgtacgaacgaacgtaccgtaaacgttaccgaaagtaaccgtaacgtacggttacgttacccgtaacctaacccgtaaagttaaccgaaacctacggtaccgtacgtaccggtaccgttacgggtaaccgggaccgggttacggttacggttacgtttacgtttacggtacgggttacgggaaaccggtaaaggggttacggttttaagggtaacgggtttaacgttagggtttttaacggg

SEQ ID NO: 109768 - DNA, 774 bp, Homo sapiens
  misc_feature: GYAE6OF01BYNJA.10.7.A07.1.454.CMB.1.raw
tcagcatagtagtgcacgaccggtgctcgatttagcacgtgtcgcaggggagctctgggagaggagcccagcactagaagtcggcggtgtttccattcggtgatcagcactgaacacagaggactcacatggagtttgggctgagcgttgggttttccctcgttgcttcgttttaaggaggtcgtccagtgtcgaggggctaggttggtggagtcggtgggggagcgtggtccagccggtgggacgtccctgagctctcctgtcgcagccttcgtaggtacttccattcctttcgagtttcgcgttggtcgggtcgtttccgacggtccggggttcccgccgtaacggccttacccggagggtacggaacgggggtctacggggtacgtggggtacgggactaaggtaatacgtacgaggaacgtgaggtaacggaacgttacgtgttaactacgtacgacgtagtaccgtacgaggtacggaacgggtcctacgttacaacttactaccgtaccgagtacgtaaactaccgttaacccaaacggtaaacctacgtaaacgtttcggtacccttaacccgtaaaccgttaaacgttacggtaaacccgtaacccgttacccggtaccggaacccggtacccggtaaggtaacccgggacccggggttcggggtaccgtttatttaccggtttacggtaggttaccgggaaaccgggtaaaagggttacgggtttaaagggttaggggttaaaccttttggggtttttaaacggg

SEQ ID NO: 109769 - DNA, 498 bp, Homo sapiens
  misc_feature: GYAE6OF02GZ5EG.10.7.A07.1.454.CMB.1.raw
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggggcagttggtggagtctgggggaggcgtggtccagcctgggaggtccctgagactctcctgtgcagcctctggattcatcttcagttgctgtggcgttcactgggtccgccaggctccaggcaaggggctggactgggtgcagtaatatcagatgatggaagtactgtatactacgcagactcagtgaagggccgattcactatctccagagacaattccaagaacacagtgtctctaccaaatgaacagcctgcgacctgaggacgcgggtgtctatactgtgacgaaggagggtatgggatgttag

SEQ ID NO: 109770 - DNA, 675 bp, Homo sapiens
  misc_feature: GYAE6OF02H077C.10.7.A07.1.454.CMB.1.raw
  modified_base (359)..(359): a, c, t, g, unknown or other
  misc_feature (359)..(359): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagcttgggttttcctcgttgcttctttttaagaggtgtccagttgtcgaggggcaggttggtggagtcgtgggggaggcgtggtccagccgtgggacgtccctgagctctcctgtgcagcctctggattcatcttcagttgctgtggcgttcacgttgggtccgccgagggcctccgagggccgaagggggctgggacgtggggtggcagtaatntcagatgagtggaatctgtatactacgcaagtactcagtaggaagggtccagttaccaacttacgtcctaccgaagacgtaaacctaacgttacccaaaagtaaccaactacgttacgttaccttaccttaaccctaaaagttacgaaaccgtaacgcccgttacggacccggtaacccgtacggtacggggaaccggtccggggttaacgttacccgtttaagtttaacccggttaggtacggtaacgggtaaaacggggttaagggggtttaacggttttaacggggtaacgtttacgggttttttaaacgggg

SEQ ID NO: 109771 - DNA, 503 bp, Homo sapiens
  misc_feature: GYAE6OF02GBM5U.10.7.A07.1.454.CMB.1.raw
  modified_base (304)..(304): a, c, t, g, unknown or other
  misc_feature (304)..(304): n is a, c, g, or t
  modified_base (403)..(403): a, c, t, g, unknown or other
  misc_feature (403)..(403): n is a, c, g, or t
  modified_base (435)..(435): a, c, t, g, unknown or other
  misc_feature (435)..(435): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcgaggggcagttggtggagtcgtgggggaggcgtggtccagccgtgggacgtccctgagactctcctgtgtagcgtctggattcacattcagtagttatagcatgaactgggtccncaggctccgagggaagggctggagtgggttcatatatgatagaaatgtggaaccatatactatgcagactctgtgaggggccattcaccatctccaganacaatgcagattcactgtatgtagaatgaacngtctgagagcgagacacgctcgtctattacgtgtgacgacgacgacccgaaagtcggtactacgtaac

SEQ ID NO: 109772 - DNA, 783 bp, Homo sapiens
  misc_feature: GYAE6OF02G1DXY.10.7.A07.1.454.CMB.1.raw
  modified_base (264)..(264): a, c, t, g, unknown or other
  misc_feature (264)..(264): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggggcagttggtggagtcgtgggggaggcgtggtccagccgtgggacggtccctgagactcgtctgtgcagccctntggattcactcttcagttgcgttgtagggtccgtttcacgttcggggtcccgcccgagggccttccgaacgggcgtaaacggggggccttggggaacccgttggggggtcggtaccggaaaggttaaacgttacgttaccggtaaaggtagttgggaactaggggtaaaaggttaaccgtttggggttaaacttaaccggtaacccggtcgaaacggttaacccgtaccgtaaagggtacgggtaaaggggtacccccgtaagtttacccgtaaaccttaacgtaccttacccgaacggtaacgtaacgtaaaccgtttaacccgaaaacggtaaaccaacgtaacggttacgttacctaccgttaccctaaaagttacgaaactacggtaccctaggaccgtacccgtaggtaccggaccgggtaccgggttgttaccgttaactttaacggtcggttacggaacggtaaacgggtaaggggtttaacgtaaggggttaacgttacgggttttaaggg

SEQ ID NO: 109773 - DNA, 539 bp, Homo sapiens
  misc_feature: GYAE6OF02H23NP.10.7.A07.1.454.CMB.1.raw
  modified_base (345)..(345): a, c, t, g, unknown or other
  misc_feature (345)..(345): n is a, c, g, or t
  modified_base (457)..(457): a, c, t, g, unknown or other
  misc_feature (457)..(457): n is a, c, g, or t
  modified_base (487)..(487): a, c, t, g, unknown or other
  misc_feature (487)..(487): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggggcagttggtggagtcgtgggggagcgtggtccagcctgggaggtccctgagactctcctgtgcagcctgtggattcatcttcagttgcttgtggcgttcactggggtcccgccaggctccgaggcgaaggggctgggactggggtgcagtaatntcagatgataggaatctgtatactacgcagactgagtgaagggccattcactactctaccagacgactaattccaaagaacacgagtcgtactactacctaaagtcgaaccngcctgaccgaccgtggacggacgtcgggtntacgttattcgtggtagacggtaaggtaggttagttagggattcggtttaag

SEQ ID NO: 109774 - DNA, 633 bp, Homo sapiens
  misc_feature: GYAE6OF02ICNIO.10.7.A07.1.454.CMB.1.raw
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (579)..(579): a, c, t, g, unknown or other
  misc_feature (579)..(579): n is a, c, g, or t
tcagcatagtagtgcacgaccggtgctcgatttagcacgtgtcgcagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggggcagttgggtggagtcggtggggggaggtcgtggtccaggtccgtgggacggttccctggacgtactccgtcctggtcgccagcccttacgtgggtattcctattccttcgtaagtttgcttggtcgggtcgtttccgaaccgttgggggttcccccgccgtagggtccctccgagggccgtaaagggggcctagggacgttgggggtcggactaggtaaatcgtcaagntagngtagaagtctagtatacgtagacagactacgagtacggaacggggtctaatactactactcctaccgaagtacgaactaacttacgaaacgtaacaacaggtcttctacctacaatacgaaccacgctcgcgactggacggcgtacgggtntccgttaatccgtagtcgtaacgaaggtaggttagtaggtacgttcgtttaagg

SEQ ID NO: 109775 - DNA, 612 bp, Homo sapiens
  misc_feature: GYAE6OF02JS7LE.10.7.A07.1.454.CMB.1.raw
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagcttggtttcctcgttgcttcttttaagaggtgtccagtgtcgaggggcagttggtggagtcgtgggggaggcgtggtccagccgtgggacgtccctgagtctctccgtgtgcagtcctctggacttcattcttcagttgcttggtggcgttaccgacgttcgggtcccgccgtaggtcctccgagggccgaaggggtctgggaccgtggggacgacagtaatacgtcgagatagagaggtaacgtacgtagtactactacgactagtacctagagtaggaacggctattacgaactcgtactaccgagtacaactaactaccaaacgacaactagttcgtactaacctacctaaagtacgaaccacgtccgttagaccgaccgtgacggtacgtacggtctacttagttacgtacggtaggtaaccggtaaggtaacggttgttaacgggtagttacggttttagg

SEQ ID NO: 109776 - DNA, 556 bp, Homo sapiens
  misc_feature: GYAE6OF02H44TF.10.7.A07.1.454.CMB.1.raw
  modified_base (174)..(174): a, c, t, g, unknown or other
  misc_feature (174)..(174): n is a, c, g, or t
  modified_base (259)..(259): a, c, t, g, unknown or other
  misc_feature (259)..(259): n is a, c, g, or t
  modified_base (341)..(341): a, c, t, g, unknown or other
  misc_feature (341)..(341): n is a, c, g, or t
  modified_base (501)..(501): a, c, t, g, unknown or other
  misc_feature (501)..(501): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagctgggttttcctcgttgctcttttaagnggtgtccagtgtcaggggcagttggtggagtcgtgggggagcgtggtccagcctgggagtcctgagactctcctgtcgcagcctntggattcatcttcagttgctgtggcgttcacgtgggtccgccaggctccaggcaaggggctggacgtggggtagcagtaatntacagatgatggaatactgtaatacgtacgcaagtactcgaagtggaacggccgtaattcactatcctaccgagaacgtacctaaattccgaaagaacactaagtcgtactactacaaatagaacacgacctcgaccgacgtagacggaccgtacgggtntacttacgttacgttagagtacggaaaggtacggttagtaaggtactagtttagg

SEQ ID NO: 109777 - DNA, 677 bp, Homo sapiens
  misc_feature: GYAE6OF02FY513.10.7.A07.1.454.CMB.1.raw
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
  modified_base (366)..(366): a, c, t, g, unknown or other
  misc_feature (366)..(366): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagcttgggtttcctcgttgcttcttttaagagtgtccagtgtcgaggggcagttggtggagtcgtgggggagcgtggtccagccgtgggacgtccctgacgctctccgtgtcgccagcctcgtggtattcgattcttcgagtttgcttggtggcgttacacggttcgggtccnccgaggtccnccgaggcgaaggggctggtacgtggggtgcaggtaactntacgagtactggaagtaggtaaacgttagtagttaacgtacgtacgacgaagactacgtaaggtagggtaaacgggtacccgtagttactaccgtaacttaccgtaccgaagtacgaaccgtaacgttaaccgaaagtaaaccgacgtacgttaccgttacctacgtaaccgaaacttacgtaaacctaccgtacctacggtaaccgtaccgtacggtacgggacgggtaccgggttacgtacttaacgttaccggtggtaacggtacgtaagggtagggttaacggtacgggttacttacggtttaacgg

SEQ ID NO: 109778 - DNA, 697 bp, Homo sapiens
  misc_feature: GYAE6OF02I9Y6Q.10.7.A07.1.454.CMB.1.raw
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
tcagcatagtagtgcacgaccggtgctcgatttagcacgtgtcgcagggggagctctgggagaggagcccagcactagaagtcggcggtgtttccattcggtgatcagcactgaacacagaggactcaccatggagtttgggctgagcttgggttttcctcgttgccttatttaaggaggtgtccagttgtcgagggtctggttggtggagttcggtagggggcgcgtggtaccagtccgtgggacggtccngaagcctctctgtcntgtcctagtgctactntctagtgtngtgtcgtctcgcgtcggtccacgngtcncggaggacgtagggtctagggtcgtggacgacgtaagtaactcgtataggagtaggtaacgtaaggtaacgttacgtaagttaacgaacgtacgacgtacgttacgtaacgtaacggtacggtaaccggtacgttaacttaacgtaacgttactaccgtaacgaacgtaaacgtaaccttaaactaaaccgaaacgtaacgtaacgtaacgtaccgttaaccttacctaaaccgtaacgtaaacgtaaccgtaccgtaccgtacgtaccggtaacgtacgggacggtaccggttacggtacgttaagttacgttaacggtcggtaacggtaacggtaaaggttagggttaacggtaacggttacggttacgtttagg

SEQ ID NO: 109779 - DNA, 952 bp, Homo sapiens
  misc_feature: GYAE6OF02IIG3Z.10.7.A07.1.454.CMB.1.raw
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagtcttgggttttcctgttgcttactttttaaggaggtgtccagttgtcgagggggtcaggtttgggtgggaggttcggtaggggggaggtcggttgggtccacggtccgtgggggacggtccctaggaacgtacctccttccgtggtcgcctaacggcccttgtggtaacttccaattcctttgtacgtttgcttggtggtccgtttccacggttcggggtcccctccgaggttccctccggagggtccgaaagggggtccgttagggaccggttggggggtcgaccgtaaggttaaaactacgtaccgaaagtacggtaagggaactttacgggggaaaacgtttaacgtacgtttaaaaacgttaacccgttaaacccggccgtaaacggtacccttaaccgggtaaacgggttaaaccgggtaaaccgggggaccccgtttaactttaacccgaaactttacggttacccctaacccggtaaaaggtaaaccgtaaaccgttaaaacctttaacccccggaaaaagtaaaaccccgtaacggtttaaaacggttccgtaaacccttaccccgttttaacccgaaaaaaacgttttccggaaaaccgtaaacccgggtacccttaaaccgggaacccggttaaccggttacggggaaccgggtacccgggtttaccgggggtttaacgttaaacccgttttaaacgtttaacccggggttagttaaaccggacgggggttaaaaacggtaccgggggttttaagggttaacgggttttaacggttaaccggtttttttaaggggg

SEQ ID NO: 109780 - DNA, 539 bp, Homo sapiens
  misc_feature: GYAE6OF02G0QXT.10.7.A07.1.454.CMB.1.raw
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggggcagttggtggagtctgggggaggcgtggtccagcctgggaggtccctgagactctcctgtgcagcctctggattcatcttcagttgctgtggcgttcacgtgggtccgccaggctccaggcaaggggctgggactggggtgcgagtaatatcagatgatggaagttactgtatacgtacgcagtactcgagtaggaagggccgtattcactactctaccagagactaattaccaagaacacagtcgtcctctactaaactagaacacgtcctgccgtaccgtgacggacgcgggtctacttatacgtgtagacggtaaggtacggttagtagggtattggtttacgg

SEQ ID NO: 109781 - DNA, 729 bp, Homo sapiens
  misc_feature: GYAE6OF02I3RXX.10.7.A07.1.454.CMB.1.raw
  modified_base (174)..(174): a, c, t, g, unknown or other
  misc_feature (174)..(174): n is a, c, g, or t
  modified_base (285)..(285): a, c, t, g, unknown or other
  misc_feature (285)..(285): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactcaccatggtagtttgggctgaggtcttgggttttcctcggttgtccttntttttaaaggaggtcgtcctagttgtacgaggggctaggttggtcggagttcggtgggggaggtcgtggccagtccgtgggtacgtcccgtgagtacctctcctgtcgcgngcctctggtattctatcttcagttgtctgtacggtcttacgacgtcggtacctccgagccctaggacgtcggaagggtctagggtcgtagggtcggactaaggtaatacgtacgtaaggtacttaggtaacgttacggggtaaaacgtttacggttacgttaaacgttaccgtaaccgacgttaacgtacccgttaacggtaacgggtaacggtaacggggtacccgttaacgtttaccgaacgtttaacttaccgtaccgtaagtaaacggtaacttaacgtaccgaaataaccgagttaggttaccttactaccgtaaaccaaggttacctaacgtaccgtacgtacgtaccgtaccgtacggacggtaacgtcgggtacttcttaaggttccgtagttacggtaagtacgggttaaggacgggttagtaggtttgttaagg

SEQ ID NO: 109782 - DNA, 648 bp, Homo sapiens
  misc_feature: GYAE6OF02IF97J.10.7.A07.1.454.CMB.1.raw
  modified_base (175)..(175): a, c, t, g, unknown or other
  misc_feature (175)..(175): n is a, c, g, or t
  modified_base (516)..(516): a, c, t, g, unknown or other
  misc_feature (516)..(516): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactcaccatggagtttgggctgagctgggttttcctcgttgcttcttttaagnggtgtccagtgtcgaggggctaggttggtggtagtcggtgggggagtcgtggtccagccgtgggacggtccctggagacttcctccgtgtcgcagccttcgtggtactttcgattccttcgtagttgtctggtggtcgttcacgtcgggtccgccgacggcctccgacggtacggaacggggtcgtacgggtacgtgggggtacgacgtaggttaaactacgtcgtaagtagttaggtaagttagggaaacgttacgtaggttaaactacgtaccgacgtacgtactcgtagtaggaacggtcctattcacttactccgtacagaacactaactaccaaanaacacgtgtacgtacttactaaccgtaaatcgaacgtacgtcctagaccgcgtacggacggacggtcgggtagttaccgtattccgtgttacggacggtaaggtacggttaggtacggtacttaggtttagg

SEQ ID NO: 109783 - DNA, 793 bp, Homo sapiens
  misc_feature: GYAE6OF02H1JXC.10.7.A07.1.454.CMB.1.raw
  modified_base (177)..(177): a, c, t, g, unknown or other
  misc_feature (177)..(177): n is a, c, g, or t
  modified_base (453)..(453): a, c, t, g, unknown or other
  misc_feature (453)..(453): n is a, c, g, or t
  modified_base (468)..(468): a, c, t, g, unknown or other
  misc_feature (468)..(468): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactcaccatggagttgggctgagctgggttttcctcgtgcttcgtttaagaggtntccagtgtcgaggggctaggttggtggagtcggtgggggacgtcggtggtccgaaggccgttggggacggttccctaggaacggtccttccgttccgtggtcggaccacggtcccttcgtaggtactttccggccctagttcgggtaattcggtaaccgttcgaaggtacgtaacctactactacgtacgtaccggtcgggtccccaccgaggccttacccggaagggggaacgggtccgtaggggtaggttcggtttacagttactaagtttacncgttaggtggtagtntaaccagtatacctaagcgaagtactcgtagggtaacggtaacggccgttaattaccaaacccgtgttacccgtaccgaaagggaaccctaaaccgaaccggtaaaacgtacccttacgacccgttacgtttaaaccgttttacgaaccgttaaaacgtaacccgtaacccgacccgttaggacccgtaacggaccccggtaaagccccgggtaacccgttaccgtaaaggttaccttaccggtggttaaccggaaccggttaaacgttaaaacccggttcccccggtttacgaaccgggtttttagttacccttttaaacccgg

SEQ ID NO: 109784 - DNA, 777 bp, Homo sapiens
  misc_feature: GYAE6OF02FNSE1.10.7.A07.1.454.CMB.1.raw
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagagactcacatggagtttgggctgagcgttgggttttcctgttgcttacttttaagaggttgtccagtgtcgagggctaggttggtggagtcgtgggggaggtcgtcggtaccagccgtgggacgtccctganctctcgtgtncgagcctcgtggtacttcaactttccttcagtttcgcgttggttcgggtccgtttacctccgggttccggggtcccgccgtacgggtccctacggacgggtaccggtaacgggggtcttgggaccggtggggggttaccacgtaaacggttaattagtccggaagtgttagaagtacgggttaattaacgtttcgtaaacttacgtaacgtccgaagttacctacggtaaggtaccgggtaacgggtacgttacgttaccgtaaccttacgttacctacccgaagtaaccgttaacctaacgtttaaccgaaacgtaacccaagttacgggttaccttactaccgttaaacaacggttaacaaccgtacgtccgtaaccggtcgtaacccgtagggaccggtacgggttaccgggttactaaccggttttacgttaacccgttcgggtaacggtaaccgttaaagggggtaacggttttaaggtaacgggtttaacgtttacgggtttttaacggg

SEQ ID NO: 109785 - DNA, 863 bp, Homo sapiens
  misc_feature: GYAE6OF02IFYU4.10.7.A07.1.454.CMB.1.raw
  modified_base (140)..(140): a, c, t, g, unknown or other
  misc_feature (140)..(140): n is a, c, g, or t
  modified_base (144)..(144): a, c, t, g, unknown or other
  misc_feature (144)..(144): n is a, c, g, or t
tcagcatagtagtgcacgaccggtgctcgatttagcacgtgtcgcaggggagctctgggagaggagcccagcactagaagtcggcggttgtttccattcggtgatcagcactgaacacagagactcacagtggagttggngtgngtcgttggttttccgttcgttgtcttacttttaaggtggtgttcgtagtgtcgagggtcgtagttagggtggtacggtcggtgggggtagggtcggtacggtccgaacggtcccggttcgggggtacgggttacccgtacggtacgtacccgtttcccgttccgtacgggtgtaccgaccgttccgttcgtaacggttactttcgtacttccgtttacgttaggttcgtaccggtttggtacggttcccggttaccgtaccggttcccgggtacccgtaccggtacgtcccggttaccgaggacggggtaacgggtcggtcggtacgggtgggtacggacctttaagtaacgttacgtacggtaagttagttacggtaaggttagggtaaaccggttactttaaccgggtttaaattacccgggtaaaccgttagacgtttaaccgtagtaacggggtacggtaccggtaacgttaccttaacgtacctttaactacccggtactaaacgacgttaaaccttaaccgtaaaccgtaaagtaacccgtaagtacccgttaagttaacccttaccgtaaaccgtaaggtaccgaaccgttccgtacgtacgtacgtaaccggttacggacggtcccggtacggttaccgttagttagttaacggtcggaaacggttacggtaaagggtggttacggtttaaccggtgttttaggtttacgg

SEQ ID NO: 109786 - DNA, 717 bp, Homo sapiens
  misc_feature: GYAE6OF02JI1C2.10.7.A07.1.454.CMB.1.raw
  modified_base (177)..(177): a, c, t, g, unknown or other
  misc_feature (177)..(177): n is a, c, g, or t
  modified_base (196)..(196): a, c, t, g, unknown or other
  misc_feature (196)..(196): n is a, c, g, or t
  modified_base (251)..(251): a, c, t, g, unknown or other
  misc_feature (251)..(251): n is a, c, g, or t
  modified_base (288)..(288): a, c, t, g, unknown or other
  misc_feature (288)..(288): n is a, c, g, or t
tcagcatagtagtgcacgaccggtgctcgatttagcacgtgtcgcaggggagctctgggagaggagcccagcactagaagtcggcggtgtttccattcggtgatcagcactgaacacagaggactccaccatcggagtttgggctgagcgttgggtttcctcgttgcttctttaagnggtgtccagtgtcagggcngttggtgagtcgtgggggagcgtgcagtcctggcggtcctgagtctctactgtancgagtcctgtggtacttcgacttcgttcgtaggttcncgttgggtcggtacttcgacgttcgggtccaccgtagtcctacgacggccgtaaacgggggcctagggtaccggttggggtaccgacgttaacgttataagcccggtaagtaccgtggtaacgtaaggggaaacctttaccggtgtttaaacccaacggttccgaacgtaacggccgtacgtacggtacgggtaacgggaccgttaacgtaccgttactacgttacctaccgacggtaaccgtaacgtaacttaaccgtaaacaaccgaacgtaacgtacgtacccttaccgtaaccctaacgtaacgtaaccgtacgtccgttacgccgtacgtacgacggtaccgggtacggtaccgttaacgtaagttaccccgttagtacggtacggtaaggttacggttaggtacgtaacggttcgtttaacgg

SEQ ID NO: 109787 - DNA, 431 bp, Homo sapiens
  misc_feature: GYAE6OF01CBB5T.21.60.F05.1.454.CMB.1.raw
  modified_base (342)..(342): a, c, t, g, unknown or other
  misc_feature (342)..(342): n is a, c, g, or t
  modified_base (425)..(431): a, c, t, g, unknown or other
  misc_feature (425)..(431): n is a, c, g, or t
tcagtcgtcgctcgcacgaccggtgctcgatttagtacgtcatcagggaagggctggagtgggttggccgtattggaagcaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaagggccccatcggtcttccccctggccgccctgcctccaggancacctccgagagcacagcgccctgggctgcctggtcaaggctacttccctcgtctctactgagcgggctggcaggcgcatagnnnnnnn

SEQ ID NO: 109788 - DNA, 433 bp, Homo sapiens
  misc_feature: GYAE6OF01BKKKL.21.60.F05.1.454.CMB.1.raw
  modified_base (425)..(433): a, c, t, g, unknown or other
  misc_feature (425)..(433): n is a, c, g, or t
tcagtcgtcgctcgcacgaccggtgctcgatttagtacgtcatcagggaaagggctggagtgggttggccgtattggaagcaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccgggaaccctggtcaccgtctcctcggcctccaccaagggccccatcggtcttccccctggcgccctgctccaggagcacctccgagagcacagcggccctgggctgcctggtcaaggctacttccctcgtctctactgagcgggctggcaaggcgcatagnnnnnnnnn

SEQ ID NO: 109789 - DNA, 461 bp, Homo sapiens
  misc_feature: GYAE6OF01EAAWH.21.60.F05.1.454.CMB.1.raw
  modified_base (406)..(406): a, c, t, g, unknown or other
  misc_feature (406)..(406): n is a, c, g, or t
  modified_base (439)..(461): a, c, t, g, unknown or other
  misc_feature (439)..(461): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgctaaatgagcagcctgaaaaccgaggacacggccgtctattacgtgtgctagacctaggtggctcgtccgactggttgaagttcgacccctggggccgggaaccctggtcaccgtctcctcggcctccaccaagggcccatccggtccttcccccgtggccgccccgtggcctccgaggcgccacctccgagacgcacagcggccctggggctgcctggtcaaggctacttcccngtctctactgagcggctggcaaggcgcagtagnnnnnnnnnnnnnnnnnnnnnnn

SEQ ID NO: 109790 - DNA, 435 bp, Homo sapiens
  misc_feature: GYAE6OF01CTYHS.21.60.F05.1.454.CMB.1.raw
  modified_base (426)..(435): a, c, t, g, unknown or other
  misc_feature (426)..(435): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagttcgaccccgtggggccgggaaccctggtcaccgtctcctcggcctccaccaagggcccatcggtcttccccctggccgccctgctccaggagcacctcgagagcacagcggccctgggctgcctggtcaaggctacttccctcgtctctactgagcggctggcaaggcgcatagnnnnnnnnnn

SEQ ID NO: 109791 - DNA, 433 bp, Homo sapiens
  misc_feature: GYAE6OF01BMFEE.21.60.F05.1.454.CMB.1.raw
  modified_base (419)..(419): a, c, t, g, unknown or other
  misc_feature (419)..(419): n is a, c, g, or t
  modified_base (425)..(433): a, c, t, g, unknown or other
  misc_feature (425)..(433): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccgggaaccctggtcaccgtctcctcggcctccaccaagggcccatcggtcttccccctggcgccctgctccaggagcacctccgagagcacagcggccctgggctgcctggtcaaggctacttccctcgtctctactgagcgggctggcaaggcncatagnnnnnnnnn

SEQ ID NO: 109792 - DNA, 435 bp, Homo sapiens
  misc_feature: GYAE6OF01B5NKI.21.60.F05.1.454.CMB.1.raw
  modified_base (422)..(422): a, c, t, g, unknown or other
  misc_feature (422)..(422): n is a, c, g, or t
  modified_base (428)..(435): a, c, t, g, unknown or other
  misc_feature (428)..(435): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaaggcccatcggtcttccccctggccgccctgcctccaggacgcacctccgagacgcacagcggccctgggctgcctggtcaaggctactccctcgtctctactgagcgggctggcaaggcncatagnnnnnnnn

SEQ ID NO: 109793 - DNA, 437 bp, Homo sapiens
  misc_feature: GYAE6OF01C76LI.21.60.F05.1.454.CMB.1.raw
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
  modified_base (428)..(437): a, c, t, g, unknown or other
  misc_feature (428)..(437): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccaagggccccatcggtcttccccctggcgccctgcctccaggancacctccgagngcacagcggccctgggctgcctggtcaaggctacttccctcgtctctactgagcgggctggcaggcgcatagnnnnnnnnnn

SEQ ID NO: 109794 - DNA, 428 bp, Homo sapiens
  misc_feature: GYAE6OF01CZ2Y0.21.60.F05.1.454.CMB.1.raw
  modified_base (390)..(390): a, c, t, g, unknown or other
  misc_feature (390)..(390): n is a, c, g, or t
  modified_base (424)..(428): a, c, t, g, unknown or other
  misc_feature (424)..(428): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccgggaaccctggtcaccgtctcctcggcctccaccaagggcccatcggtcttccccctggcgccctgctccaggagcacctccgagagcacagcgccctgggctgcctggtcaaggctacttcccncgtctctactgagcgggctggcaaggcgcatagnnnnn

SEQ ID NO: 109795 - DNA, 430 bp, Homo sapiens
  misc_feature: GYAE6OF01BSLYF.21.60.F05.1.454.CMB.1.raw
  modified_base (425)..(430): a, c, t, g, unknown or other
  misc_feature (425)..(430): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccgggaaccctggtcaccgtctcctcggcctccaccaagggcccatcggtcttccccctggcgccctgctccaggacgcacctccgagagcacagcggccctgggctgcctggtcaaggctacttccctcgtctctactgagcgggctggcaggcgcatagnnnnnn

SEQ ID NO: 109796 - DNA, 437 bp, Homo sapiens
  misc_feature: GYAE6OF01CF30V.21.60.F05.1.454.CMB.1.raw
  modified_base (194)..(194): a, c, t, g, unknown or other
  misc_feature (194)..(194): n is a, c, g, or t
  modified_base (429)..(437): a, c, t, g, unknown or other
  misc_feature (429)..(437): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgacccctgggggccgggaaccctggtcaccgtctcctcggcctccaccaagggcccatcggtccttccccctggccgccctgctcaaggagcacctccgagagcacagccggccctgggctgcctggtcaaggactactccctcgtctctactgacgcgggctggcaggcgcatagnnnnnnnnn

SEQ ID NO: 109797 - DNA, 429 bp, Homo sapiens
  misc_feature: GYAE6OF01DEJQ8.21.60.F05.1.454.CMB.1.raw
  modified_base (425)..(429): a, c, t, g, unknown or other
  misc_feature (425)..(429): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccgggaaccctggtcaccgtctcctcggcctccaccaagggcccatcggtcttccccctggcgccctgctccaggagcacctccgagagcacagcggccctgggctgcctggtcaaggctacttccctcgtctctactgagcgggctggcaaggcgcatagnnnnn

SEQ ID NO: 109798 - DNA, 436 bp, Homo sapiens
  misc_feature: GYAE6OF01DGMA2.21.60.F05.1.454.CMB.1.raw
  modified_base (343)..(343): a, c, t, g, unknown or other
  misc_feature (343)..(343): n is a, c, g, or t
  modified_base (355)..(355): a, c, t, g, unknown or other
  misc_feature (355)..(355): n is a, c, g, or t
  modified_base (429)..(436): a, c, t, g, unknown or other
  misc_feature (429)..(436): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttccgaccccgtgggggccggggaaccctggtcaccgtctcctcggcctccaccaagggcccatcggtcttccccctggcgccctgctccaggngcacctccgagngcacagcggccctgggctgcctggtcaaggactacttccctcgtctctactgagcggctggcaaggcgcatagnnnnnnnn

SEQ ID NO: 109799 - DNA, 441 bp, Homo sapiens
  misc_feature: GYAE6OF01EW5F9.21.60.F05.1.454.CMB.1.raw
  modified_base (429)..(441): a, c, t, g, unknown or other
  misc_feature (429)..(441): n is a, c, g, or t
tcagtcgtcgctcgcacgaccggtgctcgatttagtacgtcatcagggaaagggctgggagtgggttggccgtattggaagcaaaactaacaattacgcgacaacatatgctgcgtcggtgaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaagggcccatcggtcttccccctggcgccctgcctccaggacgcacctccgagagcacagcggccctgggctgcctggtcaaggctacttccctcgtctctactgacgcgggctggcaaggcgcatagnnnnnnnnnnnnn

SEQ ID NO: 109800 - DNA, 454 bp, Homo sapiens
  misc_feature: GYAE6OF01A00QO.21.60.F05.1.454.CMB.1.raw
  modified_base (197)..(197): a, c, t, g, unknown or other
  misc_feature (197)..(197): n is a, c, g, or t
  modified_base (217)..(217): a, c, t, g, unknown or other
  misc_feature (217)..(217): n is a, c, g, or t
  modified_base (434)..(454): a, c, t, g, unknown or other
  misc_feature (434)..(454): n is a, c, g, or t
tcagtcgtcgctcgcacgaccggtgctcgatttagtacgtcatcagggaaaggggctggagtgggttggccgtattggaagcaaaactaacaattacgcgacaacactatgctgcgtcgggtgaaaggcaggttcaccatctccagagatgattcaaagaacacggcgtatctgcaaatgagcagcctgaaaaccgnggacacggccgtctattacngtgctagacctagtggcctcgtccgactggttgaagttccgaccccgtggggcccgggaaccctggtcaccgtctcctcggcctccaccaagggccccatcggtcttccccctggcgccctgcctccaggagcacctccgagagcacagccggccctgggctgcctggcaaggctacttccctcgtctctactgagcgggctggcaaggcgcatagnnnnnnnnnnnnnnnnnnnnn

SEQ ID NO: 109801 - DNA, 676 bp, Homo sapiens
  misc_feature: GYAE6OF01A3A9Q.21.60.F05.1.454.CMB.1.raw
tcagtcgtcgctcgcacgaccggtgctcgatttagtacgtcatcagggaaagggtcgtggagtgggttggccgtattggaagcaaaactaacaattacgcgacaacatatgctgcgtcggtgaaaggcaggttcaccatctccagagagtgattcaaagaacacggtcgtatctgctaaatgagcagcctgaaaaccgaggacacggccgtctattactggtgctagacctagtcgggctcgtccgactggttgaagttccgaccccgtggggccgggaaccctggtccaccgtctcctcggcctccaccgaagggcccagtccggtccttcccccgtggccgcccgtggccgtccagggacgccgacctccgagagaccacgacgccggcccgtgggcctagcccgtgggtaccgaagggtaccttaccgtttccccgtcggttaccgttccgttaaccgtcgggaacggtcccgggggtaccgttacggggaacccgtaaacggggtacccggtacccgtaaacggttaacgggtactacgtcgttacgttagacgtagacgtacgtacgacgtacgtacgacgacgtacgtacgtacgacgtacgtagtacgtcgcgcgagagtacgtagagtacgtacgtaggtacggtacgacgtagtacgtgtcggtacg

SEQ ID NO: 109802 - DNA, 452 bp, Homo sapiens
  misc_feature: GYAE6OF01E3JYW.21.60.F05.1.454.CMB.1.raw
  modified_base (195)..(195): a, c, t, g, unknown or other
  misc_feature (195)..(195): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (397)..(397): a, c, t, g, unknown or other
  misc_feature (397)..(397): n is a, c, g, or t
  modified_base (427)..(427): a, c, t, g, unknown or other
  misc_feature (427)..(427): n is a, c, g, or t
  modified_base (432)..(452): a, c, t, g, unknown or other
  misc_feature (432)..(452): n is a, c, g, or t
tcagtcgtcgctcgcacgaccggtgctcgatttagtacgtcatcagggaaagggcgtggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgaccccgtgggggccgggaaccctggtcaccgtctcctcggcctccaccaaggcccatcgtctccccgtggcnccctgctccaggncacctccgagacgcacgaggccggccctggggctggccctggtcaaggctacttcccncgtctctactgacgcgggctggcaaggcgnatagnnnnnnnnnnnnnnnnnnnnn

SEQ ID NO: 109803 - DNA, 526 bp, Homo sapiens
  misc_feature: GYAE6OF01BH0JG.21.60.F05.1.454.CMB.1.raw
  modified_base (195)..(195): a, c, t, g, unknown or other
  misc_feature (195)..(195): n is a, c, g, or t
  modified_base (216)..(216): a, c, t, g, unknown or other
  misc_feature (216)..(216): n is a, c, g, or t
  modified_base (484)..(485): a, c, t, g, unknown or other
  misc_feature (484)..(485): n is a, c, g, or t
  modified_base (489)..(526): a, c, t, g, unknown or other
  misc_feature (489)..(526): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgctaaatgagcagcctgaaaaccgnggacacggccgtctattacgngtgctagacctagtggctcgtccgactggttgaagttccgaccctggggccgggaacctggtcaccgtctcctcggcctccaccaagggccccatccggtccttcccccgtggccgcccgtgcctcccgaggcgccacctcgagacgcacgagccggccctggggcctgcccgttgggtaccaaagggccttaccgtttcccctcggttcctccgtaaccgtcggaacggtccgggacttgggaccgaacgggccgacgaagtacggnngtcnnnnnnnnnnnnnnnnnnnnnnnnnnnnnnnnnnnnnn

SEQ ID NO: 109804 - DNA, 436 bp, Homo sapiens
  misc_feature: GYAE6OF01AIEV6.21.60.F05.1.454.CMB.1.raw
  modified_base (429)..(436): a, c, t, g, unknown or other
  misc_feature (429)..(436): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccgggaaccctggtcaccgtctcctcggcctccaccaagggcccatccggtcttccccctggccgccctgcctccaggacgcacctccgagagcacagccggccctgggctgcctggtcaaggctacttccctcgtctctactgagcgggctggcaggcgcatagnnnnnnnn

SEQ ID NO: 109805 - DNA, 444 bp, Homo sapiens
  misc_feature: GYAE6OF01E2GGD.21.60.F05.1.454.CMB.1.raw
  modified_base (330)..(330): a, c, t, g, unknown or other
  misc_feature (330)..(330): n is a, c, g, or t
  modified_base (432)..(432): a, c, t, g, unknown or other
  misc_feature (432)..(432): n is a, c, g, or t
  modified_base (437)..(444): a, c, t, g, unknown or other
  misc_feature (437)..(444): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtgggggcccgggaaccctggtcaccgtctcctcggcctccaccagggcccatccggtcttccccctggccncccctgcctccgaggcgcacctccgagacgcacgagccggccctgggcctgcctggtcaaggcctacttccctcgtctctactgacgcgggctggcaaggcncatgnnnnnnnn

SEQ ID NO: 109806 - DNA, 436 bp, Homo sapiens
  misc_feature: GYAE6OF01AJK4K.21.60.F05.1.454.CMB.1.raw
  modified_base (195)..(195): a, c, t, g, unknown or other
  misc_feature (195)..(195): n is a, c, g, or t
  modified_base (336)..(336): a, c, t, g, unknown or other
  misc_feature (336)..(336): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (428)..(428): a, c, t, g, unknown or other
  misc_feature (428)..(428): n is a, c, g, or t
  modified_base (434)..(436): a, c, t, g, unknown or other
  misc_feature (434)..(436): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgactgggttgaacgttccgaccccgtgggggcccggggaaccctggtcaccgtctcctcggcctccaccaagggccccatcggtccttccccctggcnccctgctccaggacncaccctcgagngcacagcggccctggctgcctggtcaaggctactccctgtctctactgacgcgggctggcaaggcncatagnnn

SEQ ID NO: 109807 - DNA, 496 bp, Homo sapiens
  misc_feature: GYAE6OF01DIITG.21.60.F05.1.454.CMB.1.raw
  modified_base (196)..(196): a, c, t, g, unknown or other
  misc_feature (196)..(196): n is a, c, g, or t
  modified_base (248)..(248): a, c, t, g, unknown or other
  misc_feature (248)..(248): n is a, c, g, or t
  modified_base (330)..(330): a, c, t, g, unknown or other
  misc_feature (330)..(330): n is a, c, g, or t
  modified_base (466)..(496): a, c, t, g, unknown or other
  misc_feature (466)..(496): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaaagaacacggcgtatctgcaaatgagcagcctagaaaaccgnggacacggtccgtctattactgtgctagacctagtggctcgtcgactggttnaagttcgaccccgtgggggcccgggaaccctggtcaccgtctcctcggcctccaccgaagggcccatcggtccttcccccgnggccgccctgcctcccgaggacgccacccgtccgagacgccacacggccggccctggggcctgccgttggtaccaaagggaccttacctttcccgcgttctctactggacgcgggctgggcaagggtcacatacgnnnnnnnnnnnnnnnnnnnnnnnnnnnnnnn

SEQ ID NO: 109808 - DNA, 472 bp, Homo sapiens
  misc_feature: GYAE6OF01ACB35.21.60.F05.1.454.CMB.1.raw
  modified_base (455)..(472): a, c, t, g, unknown or other
  misc_feature (455)..(472): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttccgaccccgtggggccggggaaccctggtcaccgtctcctcggcctccaccaagggcccatccggtcttcccccgtggccgccctcgcctccgaggacgccacctccgagacgcacacgccggcccgtgggcctgcctgggtcaaggtactaccttccctcgtcctctacgtgacggccgggtctgggacagggcgacagtagnnnnnnnnnnnnnnnnnn

SEQ ID NO: 109809 - DNA, 431 bp, Homo sapiens
  misc_feature: GYAE6OF01B9459.21.60.F05.1.454.CMB.1.raw
  modified_base (425)..(431): a, c, t, g, unknown or other
  misc_feature (425)..(431): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccgggaaccctggtcaccgtctcctcggcctccaccaagggcccatcggtcttccccctggccgccctgctccaggagcacctccgagagcacagcggccctgggctgcctggtcaaggctactccctcgtctctactgagcgggctggcaaggcgcatagnnnnnnn

SEQ ID NO: 109810 - DNA, 429 bp, Homo sapiens
  misc_feature: GYAE6OF01C1HDQ.21.60.F05.1.454.CMB.1.raw
  modified_base (423)..(429): a, c, t, g, unknown or other
  misc_feature (423)..(429): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccgggaaccctggtcaccgtctcctcggcctccaccaagggcccatcggtcttccccctggcgccctgctccaggagcacctccgagagcacagcgccctgggctgcctggtcaaggactactccctcgtctctactgagcggctggcaaggcgcatagnnnnnnn

SEQ ID NO: 109811 - DNA, 431 bp, Homo sapiens
  misc_feature: GYAE6OF01A7A9S.21.60.F05.1.454.CMB.1.raw
  modified_base (194)..(194): a, c, t, g, unknown or other
  misc_feature (194)..(194): n is a, c, g, or t
  modified_base (426)..(431): a, c, t, g, unknown or other
  misc_feature (426)..(431): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgacccctggggccgggaaccctggtcaccgtctcctcggcctccaccaagggccccatcggtcttccccctggcgccctgctccaggagcacctccgagagcacagcggccctgggctgcctggtcaaggctacttcccgagcgacgactgagcgggctggcaaggcgcatagnnnnnn

SEQ ID NO: 109812 - DNA, 451 bp, Homo sapiens
  misc_feature: GYAE6OF01BMSP4.21.60.F05.1.454.CMB.1.raw
  modified_base (445)..(451): a, c, t, g, unknown or other
  misc_feature (445)..(451): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtggggccggggaaccctggtcaccgtctcctcggcctccacaacgggcccatccggtccttcccctggccgccctgcctccaggagccacctccgagagcacagccggccctgggcctgccctggtccaaggtacctaccttccctcgtcctctactggacgcgggctcgggcaagggcacatagnnnnnnn

SEQ ID NO: 109813 - DNA, 430 bp, Homo sapiens
  misc_feature: GYAE6OF01DSN3Y.21.60.F05.1.454.CMB.1.raw
  modified_base (421)..(421): a, c, t, g, unknown or other
  misc_feature (421)..(421): n is a, c, g, or t
  modified_base (427)..(430): a, c, t, g, unknown or other
  misc_feature (427)..(430): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagttcgaccccgtgggggccgggaaccctggtcaccgtctcctcggcctccaccaagggcccatcggtcttccccctggcgccctgctccaggagcacctccgagagcacagcggccctgggctgcctggtcaaggctactccctcgtctctactgagcgggctggcaaggcncatagnnnn

SEQ ID NO: 109814 - DNA, 436 bp, Homo sapiens
  misc_feature: GYAE6OF01EQQCR.21.60.F05.1.454.CMB.1.raw
  modified_base (341)..(341): a, c, t, g, unknown or other
  misc_feature (341)..(341): n is a, c, g, or t
  modified_base (428)..(436): a, c, t, g, unknown or other
  misc_feature (428)..(436): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtgggggccgggaaccctggtcaccgtctcctcggcctccaccaagggcccatcggtcttccccctggcgccctgctccaggngcacctccgagagcacagcggccctgggctgcctggtcaaggctacttcccgagcgacgactgagcgggctggcaaggcgcagtagnnnnnnnnn

SEQ ID NO: 109815 - DNA, 508 bp, Homo sapiens
  misc_feature: GYAE6OF01C67TJ.21.60.F05.1.454.CMB.1.raw
  modified_base (196)..(196): a, c, t, g, unknown or other
  misc_feature (196)..(196): n is a, c, g, or t
  modified_base (491)..(508): a, c, t, g, unknown or other
  misc_feature (491)..(508): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaaagaacacggcgtatctgcaaatgagcagcctagaaaaccgnggacacggccgtctattactgtgctagacctagtggctcgtccgactggttgaacgttccgaccccgtgggggcccgggaaccctggtccaccgtctccgtcggccctccaccgaagggccccagtccggtccttcccccgtggccgcccctgcctcccgaggacgccacccgtccggagacgcacgacgccggcccgtggggcctgcccgttaggtacaaacgggtccttaccgtttccccgtcgtccttccgtaacgtggacggccgggctgggaccgaaggcgacagtacgnnnnnnnnnnnnnnnnnn

SEQ ID NO: 109816 - DNA, 437 bp, Homo sapiens
  misc_feature: GYAE6OF01AMPRL.21.60.F05.1.454.CMB.1.raw
  modified_base (423)..(423): a, c, t, g, unknown or other
  misc_feature (423)..(423): n is a, c, g, or t
  modified_base (429)..(437): a, c, t, g, unknown or other
  misc_feature (429)..(437): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtgggggccggggaaccctggtcaccgtctcctcggcctccaccaagggcccatcggtcttccccctggccgccctgctccaggagcacctccgagagcacagcggccctgggctgcctggtcaaggctacttccctcgtctctactgagcgggctggcaaggcncatagnnnnnnnnn

SEQ ID NO: 109817 - DNA, 429 bp, Homo sapiens
  misc_feature: GYAE6OF01B295O.21.60.F05.1.454.CMB.1.raw
  modified_base (418)..(418): a, c, t, g, unknown or other
  misc_feature (418)..(418): n is a, c, g, or t
  modified_base (424)..(429): a, c, t, g, unknown or other
  misc_feature (424)..(429): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccgggaccctggtcaccgtctcctcggcctccaccaagggcccatccggcttccccctggcgccctgcctccaggagcacctccgagagcacagcggccctgggctgccctggtcaaggctacttccgagcgacgactgagcggctggcaaggcncatagnnnnnn

SEQ ID NO: 109818 - DNA, 438 bp, Homo sapiens
  misc_feature: GYAE6OF01B1XZJ.21.60.F05.1.454.CMB.1.raw
  modified_base (193)..(193): a, c, t, g, unknown or other
  misc_feature (193)..(193): n is a, c, g, or t
  modified_base (423)..(423): a, c, t, g, unknown or other
  misc_feature (423)..(423): n is a, c, g, or t
  modified_base (429)..(438): a, c, t, g, unknown or other
  misc_feature (429)..(438): n is a, c, g, or t
tcagtcgtcgctcgcacgaccggtgctcgatttagtacgtcatcagggaaagggctggagtgggttggccgtattggaagcaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgacccctggggccgggaaccctggtcaccgtctcctcggcctccaccaagggcccatcggtccttccccctggccgccctgcctccaggagccacctccgagagcacagccggccctgggctgcctggtcaaggactacttccctcgttctactgagcgggctggcaaggcncatagnnnnnnnnnn

SEQ ID NO: 109819 - DNA, 446 bp, Homo sapiens
  misc_feature: GYAE6OF01DS4U8.21.60.F05.1.454.CMB.1.raw
  modified_base (195)..(195): a, c, t, g, unknown or other
  misc_feature (195)..(195): n is a, c, g, or t
  modified_base (435)..(446): a, c, t, g, unknown or other
  misc_feature (435)..(446): n is a, c, g, or t
tcagtcgtcgctcgcacgaccggtgctcgatttagtacgtcatcagggaaagggcgtggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgacccctggggccgggaaccctggtcaccgtctcctcggcctccaccaaggcccatcggtctcccctggcgccctgctccaggcgccacctccgagacgccacacgccggcccctggggcctgcctggtcaaggcctacttccctcgtctctactgacgccgggctggacaaggcgcatagnnnnnnnnnnnn

SEQ ID NO: 109820 - DNA, 526 bp, Homo sapiens
  misc_feature: GYAE6OF01D2C5P.21.60.F05.1.454.CMB.1.raw
  modified_base (195)..(195): a, c, t, g, unknown or other
  misc_feature (195)..(195): n is a, c, g, or t
  modified_base (496)..(496): a, c, t, g, unknown or other
  misc_feature (496)..(496): n is a, c, g, or t
  modified_base (498)..(526): a, c, t, g, unknown or other
  misc_feature (498)..(526): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgatggttgaagttccgaccccgtgggggcccgggaaccctggtccaccgtctcctcggcctccaccgaagggccccatccggtccttcccccgtggccgcccctgcctcccagggacgccacccgtccggagacgccaacgcggccggccctggggcctcggcccgttgggtaccaaagggtacccttacctttccccgtcggttccttccgtacgtcggacggtccggggctcgggacgaacgggcgacaatacggngnnnnnnnnnnnnnnnnnnnnnnnnnnnnn

SEQ ID NO: 109821 - DNA, 433 bp, Homo sapiens
  misc_feature: GYAE6OF01EYAQI.21.60.F05.1.454.CMB.1.raw
  modified_base (429)..(433): a, c, t, g, unknown or other
  misc_feature (429)..(433): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtggggccgggaaccctggtcaccgtctcctcggcctccaccaagggcccatcggtcttccccctggcgccctgctcccaggacgcacctccgagagcacagcggccctgggctgcctggtcaaggactacttccctcgtctctactgagcgggctggcaaggcgcatagnnnnn

SEQ ID NO: 109822 - DNA, 427 bp, Homo sapiens
  misc_feature: GYAE6OF01DL8T3.21.60.F05.1.454.CMB.1.raw
  modified_base (351)..(351): a, c, t, g, unknown or other
  misc_feature (351)..(351): n is a, c, g, or t
  modified_base (424)..(427): a, c, t, g, unknown or other
  misc_feature (424)..(427): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccgggaaccctggtcaccgtctcctcggcctccaccaagggcccatcggtcttccccctggcgccctgctccaggagcacctccgagngcacagcggccctgggctgcctggtcaaggactactccctcgtctctactgagcggctggcaaggcgcatagnnnn

SEQ ID NO: 109823 - DNA, 430 bp, Homo sapiens
  misc_feature: GYAE6OF01A976H.21.60.F05.1.454.CMB.1.raw
  modified_base (340)..(340): a, c, t, g, unknown or other
  misc_feature (340)..(340): n is a, c, g, or t
  modified_base (420)..(420): a, c, t, g, unknown or other
  misc_feature (420)..(420): n is a, c, g, or t
  modified_base (424)..(430): a, c, t, g, unknown or other
  misc_feature (424)..(430): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccgggaacctggtcaccgtctcctcggcctccaccaagggcccatccggtcttccccctggccgccctgctcaaggngccacctccgagagcacagccggccctgggctgcctggcaaggctacttccctcgtctctctgagcgggctggcaggcgnatgnnnnnnn

SEQ ID NO: 109824 - DNA, 470 bp, Homo sapiens
  misc_feature: GYAE6OF01DYU90.21.60.F05.1.454.CMB.1.raw
  modified_base (459)..(470): a, c, t, g, unknown or other
  misc_feature (459)..(470): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagttccgaccccgtgggggcccgggaaccctggtcaccgtctcctcggcctccaccaagggcccatcggtccttccccctggccgccctgcctccgaggacgccacccgtccgagacgccacgacggccggccctgggcctcggcccgtggtccaaggcctacgtcccgagccgacgactggacggcgggctgggcaagggcgacagtagnnnnnnnnnnnn

SEQ ID NO: 109825 - DNA, 518 bp, Homo sapiens
  misc_feature: GYAE6OF01C75CC.21.60.F05.1.454.CMB.1.raw
  modified_base (195)..(195): a, c, t, g, unknown or other
  misc_feature (195)..(195): n is a, c, g, or t
  modified_base (485)..(485): a, c, t, g, unknown or other
  misc_feature (485)..(485): n is a, c, g, or t
  modified_base (487)..(518): a, c, t, g, unknown or other
  misc_feature (487)..(518): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgactggttgaagttcgaccccgtgggggccgggaaccctggtcaccgtctccgtcggcctccaccgaacgggcccagtccggtccttcccccgtggccgcccctgcctccgaggacgccacccgtccgaagcgccacgacgccggccccgtggggcttcgcccgttgggtaccaaacgggtaccttaaccgtcccggagccggacgacgtggacggccgggctgggaccaagggccgacaagtacgngnnnnnnnnnnnnnnnnnnnnnnnnnnnnnnnn

SEQ ID NO: 109826 - DNA, 435 bp, Homo sapiens
  misc_feature: GYAE6OF01CH4LL.21.60.F05.1.454.CMB.1.raw
  modified_base (341)..(341): a, c, t, g, unknown or other
  misc_feature (341)..(341): n is a, c, g, or t
  modified_base (423)..(423): a, c, t, g, unknown or other
  misc_feature (423)..(423): n is a, c, g, or t
  modified_base (428)..(435): a, c, t, g, unknown or other
  misc_feature (428)..(435): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagttcgaccccgtggggccgggaaccctggtcaccgtctcctcggcctccaccagggcccatcggtccttccccctggcgccctgctccaggngcacctcgagagcacagccggccctgggctgcctggtcaaggactacttccctcgtctctactgagcgggctggcaaggcgnatagnnnnnnnn

SEQ ID NO: 109827 - DNA, 465 bp, Homo sapiens
  misc_feature: GYAE6OF01C5GGM.21.60.F05.1.454.CMB.1.raw
  modified_base (346)..(346): a, c, t, g, unknown or other
  misc_feature (346)..(346): n is a, c, g, or t
  modified_base (455)..(465): a, c, t, g, unknown or other
  misc_feature (455)..(465): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagttccgaccccgtgggggccgggaaccctggtcaccgtctcctcggcctccaccaagggcccatccggtcttccccctggccgccctgctccaggcncacctccgagcgcacacgccggcccgtggggcctcgccgtgggtacaaacgggtaccttacgttccccttcgtcctctacctgacgcgggctggcgaaggcgacatagnnnnnnnnnnn

SEQ ID NO: 109828 - DNA, 564 bp, Homo sapiens
  misc_feature: GYAE6OF01C4BUY.21.60.F05.1.454.CMB.1.raw
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (528)..(564): a, c, t, g, unknown or other
  misc_feature (528)..(564): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattacngtgctagacctagtggctcgtccgatggttgaagttccgaccccgtgggggcccggggaaccctggtccaccgtcctccgtcggccctccaccgacgggccccagtccggtccttcccccgtggcccgtccctgcctccgaggcgcctacccgtccgagacgccacgacggccggcccgtgggcctcggcccgttggtaccgaacgggtacccttacccgtttccccgttccggttccttaccgttaaccgttgggaaccgggtccggggtacgtcggggaccgaacggggcccgtacgtaagtacggncngnnnnnnnnnnnnnnnnnnnnnnnnnnnnnnnnnnnnn

SEQ ID NO: 109829 - DNA, 434 bp, Homo sapiens
  misc_feature: GYAE6OF01DNKBB.21.60.F05.1.454.CMB.1.raw
  modified_base (195)..(195): a, c, t, g, unknown or other
  misc_feature (195)..(195): n is a, c, g, or t
  modified_base (248)..(248): a, c, t, g, unknown or other
  misc_feature (248)..(248): n is a, c, g, or t
  modified_base (356)..(356): a, c, t, g, unknown or other
  misc_feature (356)..(356): n is a, c, g, or t
  modified_base (423)..(423): a, c, t, g, unknown or other
  misc_feature (423)..(423): n is a, c, g, or t
  modified_base (427)..(434): a, c, t, g, unknown or other
  misc_feature (427)..(434): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagaccttagtggctcgtccgactggttnaagttcgaccccgtggggccgggaaccctggtcaccgtctcctcggcctccaccaacgggcccatcggtccttccccctggcgccctgcctccaggcgcacctccgancgcacagcgcctggactgcctggtcaaggactactccctcgtctctactgagcggctgggcaggcgnatgnnnnnnnn

SEQ ID NO: 109830 - DNA, 516 bp, Homo sapiens
  misc_feature: GYAE6OF01B8F3J.21.60.F05.1.454.CMB.1.raw
  modified_base (194)..(194): a, c, t, g, unknown or other
  misc_feature (194)..(194): n is a, c, g, or t
  modified_base (499)..(516): a, c, t, g, unknown or other
  misc_feature (499)..(516): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagtttccgaccccgtgggggccggggaaccctggtccaccgtctcctcggccctccaccaacgggcccactccggttccttccccccgtggccgtcccctgccctccaggacgccaccctcccggagacgccacgacggccggccccgtggggccctggcccctgggtaccaaacgggtacccttaccgtttcccctcgttcttacccttaccttggacgccgggggtctagggccaagggccgacagtagnnnnnnnnnnnnnnnnnn

SEQ ID NO: 109831 - DNA, 443 bp, Homo sapiens
  misc_feature: GYAE6OF01B49A8.21.60.F05.1.454.CMB.1.raw
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
  modified_base (417)..(443): a, c, t, g, unknown or other
  misc_feature (417)..(443): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtggggccgggaaccctggtcaccgtctcctcggcctccaccaggccatcgtctccccngcncctgctcaggngcacctcgagagcacagcggccctgggctgcctggcaaggctactcccgagcgacgactgacgcgggctggcaaggcgacagtagnnnnnnnnnnnnnnnnnnnnnnnnnnn

SEQ ID NO: 109832 - DNA, 476 bp, Homo sapiens
  misc_feature: GYAE6OF01ABZUW.21.60.F05.1.454.CMB.1.raw
  modified_base (192)..(192): a, c, t, g, unknown or other
  misc_feature (192)..(192): n is a, c, g, or t
  modified_base (243)..(243): a, c, t, g, unknown or other
  misc_feature (243)..(243): n is a, c, g, or t
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (430)..(430): a, c, t, g, unknown or other
  misc_feature (430)..(430): n is a, c, g, or t
  modified_base (433)..(434): a, c, t, g, unknown or other
  misc_feature (433)..(434): n is a, c, g, or t
  modified_base (438)..(438): a, c, t, g, unknown or other
  misc_feature (438)..(438): n is a, c, g, or t
  modified_base (441)..(442): a, c, t, g, unknown or other
  misc_feature (441)..(442): n is a, c, g, or t
  modified_base (446)..(451): a, c, t, g, unknown or other
  misc_feature (446)..(451): n is a, c, g, or t
  modified_base (453)..(476): a, c, t, g, unknown or other
  misc_feature (453)..(476): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaccnggacacggccgtctattactgtgctagcctagtggctcgtccgactggttnaagttcgaccctgggccgggacctgcacgtcnctggcctcacaggcccatcggtctcccctggcnccctgctccgaggcgcaccgtccgagacgcacgagccggcctggggctcgcccgtggtccaagggtcctaacgttcccggagtccgacgactcgagccgggctggccaaggtcgcatacggnatnnctgnacnngacnnnnnntnnnnnnnnnnnnnnnnnnnnnnnn

SEQ ID NO: 109833 - DNA, 498 bp, Homo sapiens
  misc_feature: GYAE6OF01BJ45M.21.60.F05.1.454.CMB.1.raw
  modified_base (195)..(195): a, c, t, g, unknown or other
  misc_feature (195)..(195): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (479)..(480): a, c, t, g, unknown or other
  misc_feature (479)..(480): n is a, c, g, or t
  modified_base (482)..(498): a, c, t, g, unknown or other
  misc_feature (482)..(498): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgactggttgagttcgaccccgtgggggccgggaacctggtccaccgtctcctcggccctccaccaacgggcccatccggtccttcccccgnggccnccctcgcctccgaggcgccacctccggagacgcacacgccggcccctggggcctggtccctgggtaccgaaacgggtacccttacctttccccgtcgttcctcctaccgtggacggccgggctgggaccacgggccgcaagtagnngnnnnnnnnnnnnnnnnn

SEQ ID NO: 109834 - DNA, 441 bp, Homo sapiens
  misc_feature: GYAE6OF01ETACN.21.60.F05.1.454.CMB.1.raw
  modified_base (194)..(194): a, c, t, g, unknown or other
  misc_feature (194)..(194): n is a, c, g, or t
  modified_base (434)..(441): a, c, t, g, unknown or other
  misc_feature (434)..(441): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgaccccgtgggggccggggaaccctggtcaccgtctcctcggcctccaccaagggcccatcggtcttccccctggccgccctgcctccaggacgcacctccgagacgcacacgccggccctggggctgcctggtcaaggctacttccctcgtctctactgagcgggctggcaggcgcatagnnnnnnnn

SEQ ID NO: 109835 - DNA, 441 bp, Homo sapiens
  misc_feature: GYAE6OF01BL3TS.21.60.F05.1.454.CMB.1.raw
  modified_base (370)..(370): a, c, t, g, unknown or other
  misc_feature (370)..(370): n is a, c, g, or t
  modified_base (425)..(425): a, c, t, g, unknown or other
  misc_feature (425)..(425): n is a, c, g, or t
  modified_base (431)..(441): a, c, t, g, unknown or other
  misc_feature (431)..(441): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtggggccggggaaccctggtcaccgtctcctcggcctccaccaagggccccatccggtcttccccctggccgccctgctccaggagcacctccgagagcacagccggcccngggctgcctggtcaaggctacttcccgagcgacgactgagcggctggcaaggcgnagtagnnnnnnnnnnn

SEQ ID NO: 109836 - DNA, 521 bp, Homo sapiens
  misc_feature: GYAE6OF01BMSCW.21.60.F05.1.454.CMB.1.raw
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (358)..(358): a, c, t, g, unknown or other
  misc_feature (358)..(358): n is a, c, g, or t
  modified_base (454)..(454): a, c, t, g, unknown or other
  misc_feature (454)..(454): n is a, c, g, or t
  modified_base (464)..(464): a, c, t, g, unknown or other
  misc_feature (464)..(464): n is a, c, g, or t
  modified_base (468)..(474): a, c, t, g, unknown or other
  misc_feature (468)..(474): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
  modified_base (504)..(505): a, c, t, g, unknown or other
  misc_feature (504)..(505): n is a, c, g, or t
  modified_base (507)..(507): a, c, t, g, unknown or other
  misc_feature (507)..(507): n is a, c, g, or t
  modified_base (509)..(510): a, c, t, g, unknown or other
  misc_feature (509)..(510): n is a, c, g, or t
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
  modified_base (519)..(521): a, c, t, g, unknown or other
  misc_feature (519)..(521): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagacacggcgtatctgcaaatgagcagcctgaaaaccgnggacacggccgtctattacngtgctagacctagnggctcgccgtactggttgagttccgacccgtgggggccggacctggtcaccgtctcctcggcctcaccaaggccagtcgtctcccctggccgcctgctcgagacncacctcgngcgcacgcgacgggcccngggctcggcctgggtcaaacgggaccttacgttccccgtcgttacttacgtaccgtgggacggccgggtctacgggctaagggcggacctaagcanccgatgctangacnnnnnnngngtcgcnacncncncgacgngacgcgcgnngncnnctcncancnnn

SEQ ID NO: 109837 - DNA, 563 bp, Homo sapiens
  misc_feature: GYAE6OF01CIBC6.21.60.F05.1.454.CMB.1.raw
  modified_base (523)..(529): a, c, t, g, unknown or other
  misc_feature (523)..(529): n is a, c, g, or t
  modified_base (531)..(563): a, c, t, g, unknown or other
  misc_feature (531)..(563): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgacttggttgaacgttccgaccccgtgggggaccgggaaccctggtcaccgtctcctcggcctccaccgagggcccagtccggtcttccccccgtggccgcccctgcctccgaggacgcacccgtccggagacgcaaccgagccggccccgtggggcctcggcccgttgggtaccaaacgggtacccttaccgtttccccctcggttcccttccgttaccgttgggaaccgggtcccggggtcgttacggggccgaaacggggcccggtaccaagttaacgggcnnnnnnngnnnnnnnnnnnnnnnnnnnnnnnnnnnnnnnnn

SEQ ID NO: 109838 - DNA, 524 bp, Homo sapiens
  misc_feature: GYAE6OF01A7KS7.21.60.F05.1.454.CMB.1.raw
  modified_base (494)..(524): a, c, t, g, unknown or other
  misc_feature (494)..(524): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtggggccgggaaccctggtccaccgtctccgtcggcctccaccaagggccccatccggtccttcccccgtggccgccctgcctccgaggacgccaccctccgagacgccacgacggccggccccgtggggccttcggcccgttgggtacaaacggaccttaccctttccccgtccgttcctccttaacgtcgacgggcgggcgttcgggaccgaacgggccgacgtaagtacgcnnnnnnnnnnnnnnnnnnnnnnnnnnnnnnn

SEQ ID NO: 109839 - DNA, 443 bp, Homo sapiens
  misc_feature: GYAE6OF01EM8R5.21.60.F05.1.454.CMB.1.raw
  modified_base (323)..(323): a, c, t, g, unknown or other
  misc_feature (323)..(323): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (435)..(443): a, c, t, g, unknown or other
  misc_feature (435)..(443): n is a, c, g, or t
tcagtcgtcgctcgcacgaccggtgctcgatttagtacgtcatcagggaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaacgttccgaccccgtgggggcccgggaaccctggtccaccgtctcctcggcctcaccaggcccatcggtctccccngcncctgctccaggancacctcganacgcacagcgctcgtgggctgccgtggtacaaggtactaccgtcccgagccgacgactggaggccgggctgggcaagggcgcatagnnnnnnnnn

SEQ ID NO: 109840 - DNA, 442 bp, Homo sapiens
  misc_feature: GYAE6OF01CXENR.21.60.F05.1.454.CMB.1.raw
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
  modified_base (435)..(442): a, c, t, g, unknown or other
  misc_feature (435)..(442): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagccctagaaaaccgaggacacggccgtctattactgtgctagacctagtggctcgtccgactggttgaagttcgaccccgtggggcccgggaaccctggtcaccgtctcctcggcctccaccaagggcccatcggtcttccccctggccgccctgcctccgaggnccacctccgagngcacagccggccctgggctgcctggtcaaggcctacttccctcgtctctacngaggcgggctggcaaggcncatagnnnnnnnn

SEQ ID NO: 109841 - DNA, 475 bp, Homo sapiens
  misc_feature: GYAE6OF01CIWIX.21.60.F05.1.454.CMB.1.raw
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
  modified_base (449)..(449): a, c, t, g, unknown or other
  misc_feature (449)..(449): n is a, c, g, or t
  modified_base (455)..(475): a, c, t, g, unknown or other
  misc_feature (455)..(475): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagttccgaccccgtgggggacccggggaaccctggtcaccgtctcctcggcctccaccaagggccccatcggtccttcccccgtggccgccctgcctccaggcnccaccctccgagagcacgngccggccctgggctcgcctgggtacaacggtcctaccttccctcgtctctacgtgacgcgggtcctggccaaggccanagtcgnnnnnnnnnnnnnnnnnnnnn

SEQ ID NO: 109842 - DNA, 436 bp, Homo sapiens
  misc_feature: GYAE6OF01DV03T.21.60.F05.1.454.CMB.1.raw
  modified_base (326)..(326): a, c, t, g, unknown or other
  misc_feature (326)..(326): n is a, c, g, or t
  modified_base (398)..(398): a, c, t, g, unknown or other
  misc_feature (398)..(398): n is a, c, g, or t
  modified_base (421)..(421): a, c, t, g, unknown or other
  misc_feature (421)..(421): n is a, c, g, or t
  modified_base (427)..(436): a, c, t, g, unknown or other
  misc_feature (427)..(436): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagttccgaccccgtgggggccgggaaccctggtccaccgtctccgtcggcctcacgaacggccatcggtcttccccnggcgcctgctcaggagcacctcgagagcacacgcggccctgggctgctggtcaaggctactccgagcgacgngtgacgcgggctggacgaaggcnagtagnnnnnnnnnn

SEQ ID NO: 109843 - DNA, 457 bp, Homo sapiens
  misc_feature: GYAE6OF01CB1VW.21.60.F05.1.454.CMB.1.raw
  modified_base (193)..(193): a, c, t, g, unknown or other
  misc_feature (193)..(193): n is a, c, g, or t
  modified_base (429)..(429): a, c, t, g, unknown or other
  misc_feature (429)..(429): n is a, c, g, or t
  modified_base (436)..(457): a, c, t, g, unknown or other
  misc_feature (436)..(457): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagacacggcgtatctgcaaatgagcagcctgaaaaccgnggacacggccgtctattactgtgctagacctagtggctcgtccgactggttgaagttcgacccctgggggccgggaaccctggtcaccgtctcctcggcctccaccaagggcccatcggtcttccccctggccgccctgcctccgaggagccacctccgagacgcacgagccggccctgggctgccctggtcaaggctacttccctcgtctctactggacgcgggctggcaaggcncatagcnnnnnnnnnnnnnnnnnnnnnn

SEQ ID NO: 109844 - DNA, 434 bp, Homo sapiens
  misc_feature: GYAE6OF01DPR0R.21.60.F05.1.454.CMB.1.raw
  modified_base (333)..(333): a, c, t, g, unknown or other
  misc_feature (333)..(333): n is a, c, g, or t
  modified_base (336)..(336): a, c, t, g, unknown or other
  misc_feature (336)..(336): n is a, c, g, or t
  modified_base (425)..(434): a, c, t, g, unknown or other
  misc_feature (425)..(434): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgacttggttgaagttccgacccgtgggggccggggaaccctggtcaccgtctcctcggcctcaccaaggccatcggtctcccctgcgcctgctcnggncacctccgagcgcacacgcggcctgggctgccctggtcaaggcttaccttccctcgtctctactcgagcggctggccaaggcgcatagnnnnnnnnnn

SEQ ID NO: 109845 - DNA, 462 bp, Homo sapiens
  misc_feature: GYAE6OF01CSFHW.21.60.F05.1.454.CMB.1.raw
  modified_base (245)..(245): a, c, t, g, unknown or other
  misc_feature (245)..(245): n is a, c, g, or t
  modified_base (324)..(324): a, c, t, g, unknown or other
  misc_feature (324)..(324): n is a, c, g, or t
  modified_base (341)..(341): a, c, t, g, unknown or other
  misc_feature (341)..(341): n is a, c, g, or t
  modified_base (448)..(462): a, c, t, g, unknown or other
  misc_feature (448)..(462): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggtnaagttcgaccccgtgggggccggggaaccctggtcaccgtctcctcggcctccaccaagggcccatcggccttcccccnggcgccctgctccaggncacctcgagacgcacgagccggccctggggctcggcccgtgggtacaacggacctaccttcccgtcgtctctactgacgccgggctgggacaagggccgacagtagnnnnnnnnnnnnnnn

SEQ ID NO: 109846 - DNA, 534 bp, Homo sapiens
  misc_feature: GYAE6OF01ARXFW.21.60.F05.1.454.CMB.1.raw
  modified_base (139)..(139): a, c, t, g, unknown or other
  misc_feature (139)..(139): n is a, c, g, or t
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (375)..(375): a, c, t, g, unknown or other
  misc_feature (375)..(375): n is a, c, g, or t
  modified_base (497)..(497): a, c, t, g, unknown or other
  misc_feature (497)..(497): n is a, c, g, or t
  modified_base (499)..(501): a, c, t, g, unknown or other
  misc_feature (499)..(501): n is a, c, g, or t
  modified_base (503)..(534): a, c, t, g, unknown or other
  misc_feature (503)..(534): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatcnccagagatgattcaaagacacggctatctgacaaatgagccagcctagaaaaccgggacacggccgtntattactgtnctagacctagtgctcgtccgacttggttgaacggtttccggaccccgtgggggcccggggtaaccctgggtccaccgtctccgtcggccctccaccgacgggccccagtccgtccttccccccgnggccnccctgctccgaggacgccacctccgganacgccacgcggccggcccgtggggcctcgcccgtggtaccaacggtacctttacccttccccgtgttcctcgttagtcggacgggccggctagggacctaacgggccacgttaagaggcagncnnncnnnnnnnnnnnnnnnnnnnnnnnnnnnnnnnn

SEQ ID NO: 109847 - DNA, 442 bp, Homo sapiens
  misc_feature: GYAE6OF01AXB70.21.60.F05.1.454.CMB.1.raw
  modified_base (194)..(194): a, c, t, g, unknown or other
  misc_feature (194)..(194): n is a, c, g, or t
  modified_base (328)..(328): a, c, t, g, unknown or other
  misc_feature (328)..(328): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
  modified_base (433)..(442): a, c, t, g, unknown or other
  misc_feature (433)..(442): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgacccctggggccgggaaccctggtcaccgtctcctcggcctccaccaaggccccatcggtccttccccctggccnccctgcctccaggacgccacctccgagacgcacagccggccctgggctgcctggcaaggactacttccctcgtctctactgagcgggntgggcaaggcncatagnnnnnnnnnn

SEQ ID NO: 109848 - DNA, 540 bp, Homo sapiens
  misc_feature: GYAE6OF01DC3MM.21.60.F05.1.454.CMB.1.raw
  modified_base (195)..(195): a, c, t, g, unknown or other
  misc_feature (195)..(195): n is a, c, g, or t
  modified_base (214)..(214): a, c, t, g, unknown or other
  misc_feature (214)..(214): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (475)..(475): a, c, t, g, unknown or other
  misc_feature (475)..(475): n is a, c, g, or t
  modified_base (498)..(498): a, c, t, g, unknown or other
  misc_feature (498)..(498): n is a, c, g, or t
  modified_base (500)..(501): a, c, t, g, unknown or other
  misc_feature (500)..(501): n is a, c, g, or t
  modified_base (503)..(505): a, c, t, g, unknown or other
  misc_feature (503)..(505): n is a, c, g, or t
  modified_base (507)..(507): a, c, t, g, unknown or other
  misc_feature (507)..(507): n is a, c, g, or t
  modified_base (509)..(511): a, c, t, g, unknown or other
  misc_feature (509)..(511): n is a, c, g, or t
  modified_base (513)..(540): a, c, t, g, unknown or other
  misc_feature (513)..(540): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaaagacacggcgtatctgcaaatgagcagcctagaaaaccgnggacacggcctctattacngtgctagacctaggtcgctccggtccgacgttggttgaagttcccggaccccggttggggggcccgggaaccctcgggtacctacccggtcctcccgtccggtccctcccgaaccgaacgggcccctagttcccggtcccttccccccgnggcccncccgtgcctaccgaggtccgcctacctccgagacgcacgacggccgccgtggctcgcctggacacggccttacctcccgtcgtctcctacgtgggacgcggtcgnggaccgacgggccacgtaatgancnntnnncnannncnnnnnnnnnnnnnnnnnnnnnnnnnnnn

SEQ ID NO: 109849 - DNA, 441 bp, Homo sapiens
  misc_feature: GYAE6OF01BKP4Q.21.60.F05.1.454.CMB.1.raw
  modified_base (194)..(194): a, c, t, g, unknown or other
  misc_feature (194)..(194): n is a, c, g, or t
  modified_base (425)..(425): a, c, t, g, unknown or other
  misc_feature (425)..(425): n is a, c, g, or t
  modified_base (431)..(441): a, c, t, g, unknown or other
  misc_feature (431)..(441): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgacccctgggggccggggaaccctggtcaccgtctcctcggcctccaccaagggcccatcggtcttccccctggccgccctgctccaggagccacctccgagagcacagccggccctgggctgcctggtcaaggctacttccctcgtctctactgacgcgggctggcaaggcncatagnnnnnnnnnnn

SEQ ID NO: 109850 - DNA, 495 bp, Homo sapiens
  misc_feature: GYAE6OF01CYDKJ.21.60.F05.1.454.CMB.1.raw
  modified_base (195)..(195): a, c, t, g, unknown or other
  misc_feature (195)..(195): n is a, c, g, or t
  modified_base (357)..(357): a, c, t, g, unknown or other
  misc_feature (357)..(357): n is a, c, g, or t
  modified_base (473)..(495): a, c, t, g, unknown or other
  misc_feature (473)..(495): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggaccacggccgtctattactgtgatagacctagtggctcgtccgactggttgaagttccgaccccgtgggggccggggaaccctggtccaccgtctcctcggccctccaccgaacgggcccatccggtccttccccccgtggccgccctgcctccgagganccacctccgagacgccacgagccggcccgtgggcctcgccgttggtacgaacggccttaccttcccctcgtcttcgttactgacggccgggtctgggaccaagggcgcagtagcgnnnnnnnnnnnnnnnnnnnnnnn

SEQ ID NO: 109851 - DNA, 553 bp, Homo sapiens
  misc_feature: GYAE6OF01CBWXV.21.60.F05.1.454.CMB.1.raw
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (520)..(553): a, c, t, g, unknown or other
  misc_feature (520)..(553): n is a, c, g, or t
tcagtcgtcgctcgcacgaccggtgctcgatttagtacgtcatcagggaaagggctggagtgggttggccgtattggaagcaaaactaacaattacgcgacaacatatgctgcttcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtggggccgggaaccctggtcaccgtctcctcgcctccaccaaggccatcgtcttccccctggccgccctgcctccaggacgccaccgtcccggagacgcaccgaggcccgggccccgtggggcctcggcccgttggggtaccaaacgggtacccttaaccctttccccccgtcggttaccttcccgtaaccgttgggaacgggccccgggggtcgttcggggacccgaaaggggcccgacccgtaagttacgggcngcngnnnnnnnnnnnnnnnnnnnnnnnnnnnnnnnnnn

SEQ ID NO: 109852 - DNA, 541 bp, Homo sapiens
  misc_feature: GYAE6OF01D9QZE.21.60.F05.1.454.CMB.1.raw
  modified_base (357)..(357): a, c, t, g, unknown or other
  misc_feature (357)..(357): n is a, c, g, or t
  modified_base (507)..(541): a, c, t, g, unknown or other
  misc_feature (507)..(541): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagttccgaccccgtgggggccgggaaccctggtccaccgttctccgtcgccctccaccgaacgggccccatcggtcccttcccccgtggccgtccctgcctccgagganccacctccggaagacggccacgacggccggcccgtggggctcggcccgtggtaccgaaacggtaccttaccgttccccgtcgttcctacgttaccgtcggacgggtccggggtcctcgggacctaaggggcccgacgtaagttaggctcnnnnnnnnnnnnnnnnnnnnnnnnnnnnnnnnnnn

SEQ ID NO: 109853 - DNA, 540 bp, Homo sapiens
  misc_feature: GYAE6OF01BLPAY.21.60.F05.1.454.CMB.1.raw
  modified_base (518)..(518): a, c, t, g, unknown or other
  misc_feature (518)..(518): n is a, c, g, or t
  modified_base (520)..(540): a, c, t, g, unknown or other
  misc_feature (520)..(540): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtcggctcgtccgtacgtggttagaacgttccgaccccggtgggggacccggggaaccctggtccaccgtcctccgtccggccctaccgaccgaacgggccccagttccgggtcccttccccccgtggcccgccccgttcgccctaccgaggacgccacccgtccgagacgcacgacggccggcccgtgggcctcgcccgtggtaccaacggtaccttacccgttccctccgtaccttccgtacgtcgggacggccgggtacgtcgggaccgaacgggccgactagtagcngnnnnnnnnnnnnnnnnnnnnn

SEQ ID NO: 109854 - DNA, 441 bp, Homo sapiens
  misc_feature: GYAE6OF01BKHTY.21.60.F05.1.454.CMB.1.raw
  modified_base (424)..(424): a, c, t, g, unknown or other
  misc_feature (424)..(424): n is a, c, g, or t
  modified_base (429)..(441): a, c, t, g, unknown or other
  misc_feature (429)..(441): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtgggggccgggaaccctggtcaccgtctcctcggcctccaccaagggcccatcggtcttccccctggccgccctgctccgaggcgcacctccgagacgcacagccggccctgggctgcctggtcaaggactactccctgtctctactgacgcgggctggcaggcncatgnnnnnnnnnnnnn

SEQ ID NO: 109855 - DNA, 457 bp, Homo sapiens
  misc_feature: GYAE6OF01EY80E.21.60.F05.1.454.CMB.1.raw
  modified_base (245)..(245): a, c, t, g, unknown or other
  misc_feature (245)..(245): n is a, c, g, or t
  modified_base (338)..(338): a, c, t, g, unknown or other
  misc_feature (338)..(338): n is a, c, g, or t
  modified_base (443)..(457): a, c, t, g, unknown or other
  misc_feature (443)..(457): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctcagagatgattcaaagaacacggcgtatctgcaaatgagcagcctgaaaaccgaggacacggccgtctattactgtgctagacctagtggctcgtccgactggttnaagttcgacccctggggcccgggaccctggtcacgtctcctcggcctccaccaaggcccatcggtcttccccctggcgccctgctccgaggcnccacctccgagacgcacgacgcggccctgggctcgccgtggtcaaacggcctaccttcccctcggttcctctacgtgacgcgggtctcggcaacggcgaccatgnnnnnnnnnnnnnnn

SEQ ID NO: 109856 - DNA, 472 bp, Homo sapiens
  misc_feature: GYAE6OF01D20NY.21.60.F05.1.454.CMB.1.raw
  modified_base (194)..(194): a, c, t, g, unknown or other
  misc_feature (194)..(194): n is a, c, g, or t
  modified_base (457)..(472): a, c, t, g, unknown or other
  misc_feature (457)..(472): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttccgaccccgtggggcccgggaaccctggtcaccgtcctcctcggcctccaccaacgggcccatccggtccttccccctggcccgccctgcctccgaggcgccacctccgagacgcacacggccggcccgtggggctcggcctgggtaccaaggtcctaccttccctcgtctctactggacgcgggctcgggcaagggcacagtagnnnnnnnnnnnnnnnn

SEQ ID NO: 109857 - DNA, 541 bp, Homo sapiens
  misc_feature: GYAE6OF01BSNQO.21.60.F05.1.454.CMB.1.raw
  modified_base (502)..(541): a, c, t, g, unknown or other
  misc_feature (502)..(541): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaaagaacacggcgtatctgcaaatgagcagcctagaaaaccgaggacacggccgtctattactgtgctagacctagtggctcgtccgactggttgaagttccgaccccgtgggggccgggaaccctggtccaccgtctccgtcggcctccaccaagggccccagtccggtccttcccccgtggccgccctgcctccgaaggcgccacccgtccgagacgccaacgacggccggcccgtggggcctcggtcccgttgggtacccaaacgggtaccttaccgtttcccccgtcgttcctaccgtacgtcggacgggccgggtctcgggaccgaagggtcctacgaagtagnnnnnnnnnnnnnnnnnnnnnnnnnnnnnnnnnnnnnnnn

SEQ ID NO: 109858 - DNA, 550 bp, Homo sapiens
  misc_feature: GYAE6OF01CXG3H.21.60.F05.1.454.CMB.1.raw
  modified_base (337)..(337): a, c, t, g, unknown or other
  misc_feature (337)..(337): n is a, c, g, or t
  modified_base (518)..(550): a, c, t, g, unknown or other
  misc_feature (518)..(550): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgacaaatgagcagcctagaaaaccgaggacacggccgtctattactgtgctagacctagtcggctcgtccgcttggtagtacgttccgacccggtgggggccgggaaccctggtccaccggtctccgtcgcctaccacgaacggcccagtccggttccttcccccgngccgccctgctccgaggacgccacccgtcgagacgccaacgcggccggtcccgtggggtctcggcccgttgggtaaccaaacgggtaccttaccccggttaccggacgtccggaacggtactagggacggggccgggtcggttcgggaacgtaaccggggaccgaccgtaggtacgcgagnnnnnnnnnnnnnnnnnnnnnnnnnnnnnnnnn

SEQ ID NO: 109859 - DNA, 442 bp, Homo sapiens
  misc_feature: GYAE6OF01A5L9U.21.60.F05.1.454.CMB.1.raw
  modified_base (432)..(442): a, c, t, g, unknown or other
  misc_feature (432)..(442): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaaggcccatcggtcttccccctggccgccctgctccaggacgccaccctccgagagcacgagccggccctgggctgcctggtcaaggcctacttccctcgtctctactgacgcgggctggcaggcgcatagnnnnnnnnnnn

SEQ ID NO: 109860 - DNA, 447 bp, Homo sapiens
  misc_feature: GYAE6OF01CEHEW.21.60.F05.1.454.CMB.1.raw
  modified_base (432)..(447): a, c, t, g, unknown or other
  misc_feature (432)..(447): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgagttcgacccctggggccgggaaccctggtcaccgtctcctcggcctccaccaagggcccatcggtcttccccctggcgccctgcctccaggacgcacctccgagacgcacagccggccctggggcctgcctggtcaagggacctactccctcgtctctactgagcgggctggcaaggcgcatagnnnnnnnnnnnnnnnn

SEQ ID NO: 109861 - DNA, 655 bp, Homo sapiens
  misc_feature: GYAE6OF01DT33V.21.60.F05.1.454.CMB.1.raw
  modified_base (180)..(180): a, c, t, g, unknown or other
  misc_feature (180)..(180): n is a, c, g, or t
  modified_base (198)..(198): a, c, t, g, unknown or other
  misc_feature (198)..(198): n is a, c, g, or t
  modified_base (364)..(364): a, c, t, g, unknown or other
  misc_feature (364)..(364): n is a, c, g, or t
  modified_base (392)..(392): a, c, t, g, unknown or other
  misc_feature (392)..(392): n is a, c, g, or t
  modified_base (539)..(539): a, c, t, g, unknown or other
  misc_feature (539)..(539): n is a, c, g, or t
  modified_base (545)..(545): a, c, t, g, unknown or other
  misc_feature (545)..(545): n is a, c, g, or t
  modified_base (586)..(586): a, c, t, g, unknown or other
  misc_feature (586)..(586): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattacaaagaacacggctatctgacaaatgancagacctaaggaaaccgnggaccgaccggtccgttactattacgtgtgactacgacctaggtcgctcggtaccgtagtggttgaaccgttccggacccggtcggggacccggtacctggtacctaccgtctccgtccgtaccctaccgaccgacggtcccacgttccggttaccccttccccgnggccctccgtcgccgtaccggaaggccncctaccgtccgagcgtacacgcgtccggcccgtggtcgtcgtccgtacgggtacaaccggtacctttacccggacccggagtaccgacggtaacgtcgggacgggtcccggtcgtaacgggaccgaaccgggtcgtagtaacgtggncggtancgttcgcagcgacgtcgtacgtcgtcgtcgcgtcgtcgtcncgtacgtacgtacgcgtcgcgtacgtacgtcgtacgcgtcgtacgtgcgtacgacgagtcgtcgcgtcg

SEQ ID NO: 109862 - DNA, 533 bp, Homo sapiens
  misc_feature: GYAE6OF01A49TU.21.60.F05.1.454.CMB.1.raw
  modified_base (147)..(147): a, c, t, g, unknown or other
  misc_feature (147)..(147): n is a, c, g, or t
  modified_base (197)..(197): a, c, t, g, unknown or other
  misc_feature (197)..(197): n is a, c, g, or t
  modified_base (355)..(355): a, c, t, g, unknown or other
  misc_feature (355)..(355): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (476)..(476): a, c, t, g, unknown or other
  misc_feature (476)..(476): n is a, c, g, or t
  modified_base (478)..(481): a, c, t, g, unknown or other
  misc_feature (478)..(481): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (505)..(506): a, c, t, g, unknown or other
  misc_feature (505)..(506): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (515)..(516): a, c, t, g, unknown or other
  misc_feature (515)..(516): n is a, c, g, or t
  modified_base (520)..(521): a, c, t, g, unknown or other
  misc_feature (520)..(521): n is a, c, g, or t
  modified_base (527)..(528): a, c, t, g, unknown or other
  misc_feature (527)..(528): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
tcagtcgtcgctcgcacgaccggtgctcgatttagtacgtcatcagggaaagggcgtggagtgggttggccgtattggaagcaaaactaacaattacgcgacaacatatgctgcgtcggtgaaaggcaggttcaccatctccagagntgattcaaagaacacggctatctgcaaatgagcagccctaggaaaaccgnggacacggccgtactattactgtcgctacgcctaggtcggctccgtccggactggttgaacgttccgacccgtggggcccgggaacctggtccaccgtctcctcggcctccacagggcccatccggtcctcccccgtgccgtcccagcctccgaggcnccaccgtcgagacgcacgacgccggccctggctcgccgtaggtcaaggaccttccgttccctcgtcctctacgtcggagcgggtctacgggtcaagggtccacgtaagtacggnantnacntnnnncgcgctcncnctncngngcncgcnncgngngntnncgcnncgcgcnncngnc

SEQ ID NO: 109863 - DNA, 512 bp, Homo sapiens
  misc_feature: GYAE6OF01C8A51.21.60.F05.1.454.CMB.1.raw
  modified_base (330)..(330): a, c, t, g, unknown or other
  misc_feature (330)..(330): n is a, c, g, or t
  modified_base (351)..(351): a, c, t, g, unknown or other
  misc_feature (351)..(351): n is a, c, g, or t
  modified_base (482)..(512): a, c, t, g, unknown or other
  misc_feature (482)..(512): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagtcgaccccgtggggccgggaaccctggtcaccgtctcccgtcggcctccaccgaacggcccagtccggtccttcccccgnggccgccctgcctccgaggcnccaccgtccgagacgccacgaggccggcccgtggggcctcggccgttggtaccgaacggtaccttaccttccccgtcgtccttctactggcggaccgggtcgtcgggaccgaagggcccgactaagcgtannnnnnnnnnnnnnnnnnnnnnnnnnnnnnn

SEQ ID NO: 109864 - DNA, 556 bp, Homo sapiens
  misc_feature: GYAE6OF01DQMV5.21.60.F05.1.454.CMB.1.raw
  modified_base (355)..(355): a, c, t, g, unknown or other
  misc_feature (355)..(355): n is a, c, g, or t
  modified_base (514)..(516): a, c, t, g, unknown or other
  misc_feature (514)..(516): n is a, c, g, or t
  modified_base (518)..(522): a, c, t, g, unknown or other
  misc_feature (518)..(522): n is a, c, g, or t
  modified_base (524)..(525): a, c, t, g, unknown or other
  misc_feature (524)..(525): n is a, c, g, or t
  modified_base (527)..(527): a, c, t, g, unknown or other
  misc_feature (527)..(527): n is a, c, g, or t
  modified_base (529)..(533): a, c, t, g, unknown or other
  misc_feature (529)..(533): n is a, c, g, or t
  modified_base (535)..(541): a, c, t, g, unknown or other
  misc_feature (535)..(541): n is a, c, g, or t
  modified_base (543)..(548): a, c, t, g, unknown or other
  misc_feature (543)..(548): n is a, c, g, or t
  modified_base (550)..(550): a, c, t, g, unknown or other
  misc_feature (550)..(550): n is a, c, g, or t
  modified_base (552)..(556): a, c, t, g, unknown or other
  misc_feature (552)..(556): n is a, c, g, or t
tcagtcgtcgctcgcacgaccggtgctcgattttagtacgtcatcagggaaagggctggagtgggttggccgtattggaagcaaaactaacaattacgcgacaacatatgctgcgtcggtgaaaggcaggttcaccatctccagagatgattcaaagaaccacggcgtatctgacaaatgagcagcctagaaaaccgaggacacggccgtctattactgtgactacgaccttaggtcggctccgtccgacgttggttagaacgttccgaccccggtgggggaccgggacctggtccaccgtctccgtcggcctccaaccgaacggcctacgtccggtcccttcccccgtggcccncctcgcctccgaggacgcctaccgtacgacggacgaccgtacgacggccgcccggtggcctcggcgttcggacgaacggccttaccgtcccggagtaccgacgtacgtcggacgggccgggtcgtacggaccggtaggccgacgtaatcggatcggacnnngnnnnncnncngnnnnncnnnnnnncnnnnnncnannnnn

SEQ ID NO: 109865 - DNA, 524 bp, Homo sapiens
  misc_feature: GYAE6OF01B2A5O.21.60.F05.1.454.CMB.1.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (502)..(524): a, c, t, g, unknown or other
  misc_feature (502)..(524): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaaagaacacggcgtatctgcaaaatgagcagcctagaaaaccgnggacacggccgtntattacngtgntagacctagtggctcgtccgactggtgaacgttccggaccccgtgggggacccgggtaacccgtggtccaccgtcctcccgtccggtccctaccaccgaacgggcccctagtccggtcccttccccccgtggcccgtccctgcctccgagacgccacccgtccgagacgacacgacgccggtcccgtgggcctagccgtggtaccaaaggaccctttaaccgtccccttcggtctcttaacgtggacggtcgggtccgtaggacgaaggcgtacagtagcnnnnnnnnnnnnnnnnnnnnnnn

SEQ ID NO: 109866 - DNA, 711 bp, Homo sapiens
  misc_feature: GYAE6OF01DD0VB.21.60.F05.1.454.CMB.1.raw
  modified_base (627)..(627): a, c, t, g, unknown or other
  misc_feature (627)..(627): n is a, c, g, or t
  modified_base (642)..(642): a, c, t, g, unknown or other
  misc_feature (642)..(642): n is a, c, g, or t
  modified_base (648)..(648): a, c, t, g, unknown or other
  misc_feature (648)..(648): n is a, c, g, or t
  modified_base (653)..(653): a, c, t, g, unknown or other
  misc_feature (653)..(653): n is a, c, g, or t
  modified_base (658)..(658): a, c, t, g, unknown or other
  misc_feature (658)..(658): n is a, c, g, or t
  modified_base (666)..(666): a, c, t, g, unknown or other
  misc_feature (666)..(666): n is a, c, g, or t
  modified_base (668)..(668): a, c, t, g, unknown or other
  misc_feature (668)..(668): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
  modified_base (679)..(679): a, c, t, g, unknown or other
  misc_feature (679)..(679): n is a, c, g, or t
  modified_base (686)..(686): a, c, t, g, unknown or other
  misc_feature (686)..(686): n is a, c, g, or t
  modified_base (689)..(689): a, c, t, g, unknown or other
  misc_feature (689)..(689): n is a, c, g, or t
  modified_base (693)..(693): a, c, t, g, unknown or other
  misc_feature (693)..(693): n is a, c, g, or t
  modified_base (702)..(702): a, c, t, g, unknown or other
  misc_feature (702)..(702): n is a, c, g, or t
  modified_base (704)..(705): a, c, t, g, unknown or other
  misc_feature (704)..(705): n is a, c, g, or t
  modified_base (707)..(707): a, c, t, g, unknown or other
  misc_feature (707)..(707): n is a, c, g, or t
  modified_base (709)..(709): a, c, t, g, unknown or other
  misc_feature (709)..(709): n is a, c, g, or t
  modified_base (711)..(711): a, c, t, g, unknown or other
  misc_feature (711)..(711): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaccgaggacacggccgtctattactgtgctagaccttagtcggctcgtccgacgttgggttacgaacgtttccggacccccgttggggggacccgggtaacccttgggtaccaccggtccttcccgtaccgggcccttaccgaacccggaaacgggcccctacgttcccggttccctttccccccggtagggcccgtccccgttggcccttacccggaacggggtaacgtccccaaacccgttcccggaaacggaccgaccgaccgacgggtcccggtccccggttcgggggccttacgggcccgtttgggttaaacccaaacgggttaccctttaaccgtttccccgttcgtaccgtttaccgttaaccgcgggttaaccgggccggggtaccgttacgggaccgaaaccggggtccgtacgtaaaggttaacggcncgtacgagacgtcgngtcgancgcgngcgancgtacgcncncgtagcncncngtcgtcntgnacgngcgcacgcncnncngngn

SEQ ID NO: 109867 - DNA, 499 bp, Homo sapiens
  misc_feature: GYAE6OF01CP236.21.60.F05.1.454.CMB.1.raw
  modified_base (359)..(359): a, c, t, g, unknown or other
  misc_feature (359)..(359): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (471)..(471): a, c, t, g, unknown or other
  misc_feature (471)..(471): n is a, c, g, or t
  modified_base (474)..(499): a, c, t, g, unknown or other
  misc_feature (474)..(499): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgacaaatgagcagcctagaaaaccgaggacacggccgtactattactgtgctagacctaggtcgctcgtccgacgtggttgacggttccgacccggtgggggcccgggaacctggtccaccgtctccgtcggccctccgaaccgacggccctagtccggtcccttccccggcccgcctgcctcgaggcnccaccgtcgagcnctacncggccgtccgtggctcgccgttggacacggtcctacgtccgagaccggacgtcgtgggacggcggtcgtagggacgtaacgggcgacaagtggnagnnnnnnnnnnnnnnnnnnnnnnnnnn

SEQ ID NO: 109868 - DNA, 658 bp, Homo sapiens
  misc_feature: GYAE6OF01D3UHE.21.60.F05.1.454.CMB.1.raw
  modified_base (196)..(196): a, c, t, g, unknown or other
  misc_feature (196)..(196): n is a, c, g, or t
  modified_base (616)..(616): a, c, t, g, unknown or other
  misc_feature (616)..(616): n is a, c, g, or t
  modified_base (618)..(619): a, c, t, g, unknown or other
  misc_feature (618)..(619): n is a, c, g, or t
  modified_base (621)..(624): a, c, t, g, unknown or other
  misc_feature (621)..(624): n is a, c, g, or t
  modified_base (627)..(643): a, c, t, g, unknown or other
  misc_feature (627)..(643): n is a, c, g, or t
  modified_base (645)..(658): a, c, t, g, unknown or other
  misc_feature (645)..(658): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggctatctgacaaatgagcagcctaggaaaaccgngacaccggccgtactattactgtgctacgacctagtcggcctcgtccgtacgttggttgaacgttccgaccccggtgggggacccggggtaacccttgggtccaaccggtctccccgtaccggtccctaccgaacccgaaacggggcccctagtccggttccccctttaccccccgtcggggccccgtaccccgtggtaccgtaacccgaaaaggggaccggccctaaccccgtacccggaaggaccgcccgaaacgccgggacccgggtcccgtcgggggcctcggggtcccgttagggaaccaaaaccgggtacctttaccccgttcccccgttaccggttccttaccgttaacccgtagggaccggggtcgggtccttaccggggaaccgaaggggaccctacgtaaagttagccgnanngnnnncgnnnnnnnnnnnnnnnnngnnnnnnnnnnnnnn

SEQ ID NO: 109869 - DNA, 511 bp, Homo sapiens
  misc_feature: GYAE6OF01AY9TS.21.60.F05.1.454.CMB.1.raw
  modified_base (332)..(332): a, c, t, g, unknown or other
  misc_feature (332)..(332): n is a, c, g, or t
  modified_base (478)..(478): a, c, t, g, unknown or other
  misc_feature (478)..(478): n is a, c, g, or t
  modified_base (485)..(511): a, c, t, g, unknown or other
  misc_feature (485)..(511): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggcctctattactgtgctagacctagtggctcgtccgactggttgaagttccgaccccgtgggggcccgggaccctggtccaccgtctccgtcggcctccaccgaacggcccactccggtccttcccccgnggccgccctcgcctccgaggcgccaccgtccgagacgcacgacggcccggcccgtgggccgtcgcccgtaggtccgaaacggtcccttaccttcccccgtcgtacctccgtacgtgacggccgggtctagggaccaacgggccganacgtagnnnnnnnnnnnnnnnnnnnnnnnnnnn

SEQ ID NO: 109870 - DNA, 545 bp, Homo sapiens
  misc_feature: GYAE6OF01BREAZ.21.60.F05.1.454.CMB.1.raw
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (330)..(330): a, c, t, g, unknown or other
  misc_feature (330)..(330): n is a, c, g, or t
  modified_base (503)..(503): a, c, t, g, unknown or other
  misc_feature (503)..(503): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (510)..(525): a, c, t, g, unknown or other
  misc_feature (510)..(525): n is a, c, g, or t
  modified_base (527)..(545): a, c, t, g, unknown or other
  misc_feature (527)..(545): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacgggcgtatctgcaaatgagcagcctgaaaaccgnggacacggccgtctattacngtgctagacctagtggctcgtccgactggttgaacgttcgacccctgggggccggggacctggtcaccgtctcctcggcctccaccgaagggccccatccggtccttccccccgnggccgccctgcctcgaacggcgccaccctccgacgagccacgacggccggtcccgtggggcctcgcccgttgggtaccgaaacgggtaccttacccgtttcccctcggttccttcgttaccggtcgtaacgggccggggtcgttcggggaccgaacgggtcgaccaagtacgncgnancnnnnnnnnnnnnnnnncnnnnnnnnnnnnnnnnnnn

SEQ ID NO: 109871 - DNA, 567 bp, Homo sapiens
  misc_feature: GYAE6OF01DGTGC.21.60.F05.1.454.CMB.1.raw
  modified_base (178)..(178): a, c, t, g, unknown or other
  misc_feature (178)..(178): n is a, c, g, or t
  modified_base (390)..(390): a, c, t, g, unknown or other
  misc_feature (390)..(390): n is a, c, g, or t
  modified_base (406)..(406): a, c, t, g, unknown or other
  misc_feature (406)..(406): n is a, c, g, or t
  modified_base (542)..(567): a, c, t, g, unknown or other
  misc_feature (542)..(567): n is a, c, g, or t
tcagtcgtcgctcgcacgaccggtgctcgatttagtacgtcatcagggaaagggctggagtgggtggccgtattggaagcaaaactaacaattacgcgacaacatatgctgcgtcggtgaaaggcaggttcaccatctccagagatgattcaaagaacacggcgtatctgcaaatgancagcctagaaaaccggagacaccggccgtctattactgtgctagacctagtcggcttccggtccgacgttggttagaacgttcccggacccccgtggggggacccgggtaacccttgggtcctacccggtctcccgtccggccctaccgaccgtaacgggccccagttcccggttcccttcccccgtggccgccctgccctcccgagggtcncctaccctcgacgacncctaagcgcccgggcccgttgggcttacggcccgttagggtaccgaaacggtcccttacccttccccccgtttagtcccttaccgtacgtcgggacgggcgggtaccctgggaaccacggggtcacgtagtacggnnnnnnnnnnnnnnnnnnnnnnnnnn

SEQ ID NO: 109872 - DNA, 655 bp, Homo sapiens
  misc_feature: GYAE6OF01E6CEJ.21.60.F05.1.454.CMB.1.raw
  modified_base (408)..(408): a, c, t, g, unknown or other
  misc_feature (408)..(408): n is a, c, g, or t
  modified_base (620)..(621): a, c, t, g, unknown or other
  misc_feature (620)..(621): n is a, c, g, or t
  modified_base (623)..(655): a, c, t, g, unknown or other
  misc_feature (623)..(655): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtcggtgaaaggcaggttcaccatctccagagatagattacaaagaaccacggctatctgacaaagtgagcacgcctaagaaaaccgaggaccaccggccttacttattcgtagtcgactacgtaccgtaggtcgtccttccgtaccgtcgttagggttacgtaccggttccccggaccccggggtcgggggtaccccggtaccgtcggtaccctacccgttcctccccgtccggccctacccgaaccggaccggtcccctacgtccccggttacccccttccccgcggtcccncccgtcgaccctccgacggccgacccttacccggaccgaggtaccgccgtaccggaccggtcccggtacccggtcgggtcgttcccggacccgtttagggttaaccccgtaaccgtttaccccgtttcccgtttaccccggttccgttaccgttacggttaaccgggtccggacgggggtcccggaccgcgggaaccgacggcaagtcagcnncnnnnnnnnnnnnnnnnnnnnnnnnnnnnnnnnn

SEQ ID NO: 109873 - DNA, 694 bp, Homo sapiens
  misc_feature: GYAE6OF01EMNI9.21.60.F05.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (612)..(612): a, c, t, g, unknown or other
  misc_feature (612)..(612): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
  modified_base (630)..(630): a, c, t, g, unknown or other
  misc_feature (630)..(630): n is a, c, g, or t
  modified_base (655)..(655): a, c, t, g, unknown or other
  misc_feature (655)..(655): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtcggtgaaaggcaggttcaccatctccagagatgaattacaaagaacacggcgtatctgacaaagtgagcacgcctaagaaaacgngacgacggtccgtntagttactgtgctaacgaccgtagtcggcttcggaccgtagtgggttacgtaacggtttcccggaccccggggttgggggaccccggtaaccgtcggtaccctaccggttccgtcccgtccggtaccctacccgaaccgaaccgggtccctcggttccggtttcccgttcccccggtggccccgttccccgtcgtccgttacccgaggaccgtcccgtacctaccggacgacgtacccggaaccgtccggccggtacccgtcggtccgtcggtcccggtaggtaacccgtaaacggttccctttaaccggttccctaccgtttaccgtagttaccgtcgggacgggtcggtccggtaacggtccggaaccggtcgtacgtaacgtacgcgtcagttnacgcgtcgtgancngtcngacgcgcgtgcgcgcgctcgtcgcncgagcgctgcgcgatgacgcgacgtagtcgtcgtcgacg

SEQ ID NO: 109874 - DNA, 735 bp, Homo sapiens
  misc_feature: GYAE6OF01AJL5O.21.60.F05.1.454.CMB.1.raw
  modified_base (447)..(447): a, c, t, g, unknown or other
  misc_feature (447)..(447): n is a, c, g, or t
  modified_base (650)..(650): a, c, t, g, unknown or other
  misc_feature (650)..(650): n is a, c, g, or t
  modified_base (655)..(655): a, c, t, g, unknown or other
  misc_feature (655)..(655): n is a, c, g, or t
  modified_base (658)..(658): a, c, t, g, unknown or other
  misc_feature (658)..(658): n is a, c, g, or t
  modified_base (666)..(666): a, c, t, g, unknown or other
  misc_feature (666)..(666): n is a, c, g, or t
  modified_base (670)..(670): a, c, t, g, unknown or other
  misc_feature (670)..(670): n is a, c, g, or t
  modified_base (672)..(672): a, c, t, g, unknown or other
  misc_feature (672)..(672): n is a, c, g, or t
  modified_base (674)..(674): a, c, t, g, unknown or other
  misc_feature (674)..(674): n is a, c, g, or t
  modified_base (676)..(676): a, c, t, g, unknown or other
  misc_feature (676)..(676): n is a, c, g, or t
  modified_base (679)..(679): a, c, t, g, unknown or other
  misc_feature (679)..(679): n is a, c, g, or t
  modified_base (682)..(682): a, c, t, g, unknown or other
  misc_feature (682)..(682): n is a, c, g, or t
  modified_base (684)..(684): a, c, t, g, unknown or other
  misc_feature (684)..(684): n is a, c, g, or t
  modified_base (688)..(688): a, c, t, g, unknown or other
  misc_feature (688)..(688): n is a, c, g, or t
  modified_base (690)..(690): a, c, t, g, unknown or other
  misc_feature (690)..(690): n is a, c, g, or t
  modified_base (696)..(696): a, c, t, g, unknown or other
  misc_feature (696)..(696): n is a, c, g, or t
  modified_base (702)..(702): a, c, t, g, unknown or other
  misc_feature (702)..(702): n is a, c, g, or t
  modified_base (706)..(706): a, c, t, g, unknown or other
  misc_feature (706)..(706): n is a, c, g, or t
  modified_base (709)..(709): a, c, t, g, unknown or other
  misc_feature (709)..(709): n is a, c, g, or t
  modified_base (724)..(724): a, c, t, g, unknown or other
  misc_feature (724)..(724): n is a, c, g, or t
  modified_base (730)..(730): a, c, t, g, unknown or other
  misc_feature (730)..(730): n is a, c, g, or t
  modified_base (732)..(732): a, c, t, g, unknown or other
  misc_feature (732)..(732): n is a, c, g, or t
tcagtcgtcgctcgcacgaccggtgctcgatttagtacgtcatcagggaaagggctggagtgggttgccgtattggaagcaaaactaacaattacgcgacaacatatgctgcgtcggtagaaaggcaggttcacatctccagagatgtatacgaaaagaaccacggtcgtacttcgtacgaactaaaagtgacgactacgaccgtaacggaaaaccggaggaccgaccggtaccgttcttatttacgtcgtcgtacctacgtaaccgttaggtcgtccgtccggtccggtacgttgggttacggtaaccgtccccggtacccggtcgggggaccccggtaccgtcggtcctacccgttcctccgtccggtccctaccgaccgacggcccttacggttcccgtcccttccccggccggtcccgtccctcgtccgtaccgacggtaccnccgtaccggtaccgacggaccgtaccaccgggaccgggcccgggtacccgtcggggtacccgttccggtcccggttacgggtaaccgtaaccgggttacctttaacccgggtaccccgggaacgttacccgggaccggtaaccggtaccgggacggttaccgggcgggtacgggaaccggcggaccgggtaaccttagggccngtacncgngctagacntagncncncncgngtncncgcncncacgcncacgtntcgntcngcgcgtacgcgtcgngatcgngngtc

SEQ ID NO: 109875 - DNA, 467 bp, Homo sapiens
  misc_feature: GYAE6OF01CL3WH.21.60.F05.1.454.CMB.1.raw
  modified_base (194)..(194): a, c, t, g, unknown or other
  misc_feature (194)..(194): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (450)..(467): a, c, t, g, unknown or other
  misc_feature (450)..(467): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacatggcgtatctgcaaatgagcagcctgaaaaccgnggacacggccgtcattactgtgctagacctagtggctcgtccgatggttgaagttcgaccccgtggggccggggaaccctggtccaccgtctcctcggcctccaccaaggccccancggtctccccnggccnccctgcctccaggagcacctccgagacgcaacaggccggccctggggcctgaccctggtcaaacgggctaacgtttcccctcggtcttcctactgaggccgggctggactaaggcctcgatagnnnnnnnnnnnnnnnnnn

SEQ ID NO: 109876 - DNA, 557 bp, Homo sapiens
  misc_feature: GYAE6OF01DP1SP.21.60.F05.1.454.CMB.1.raw
  modified_base (196)..(196): a, c, t, g, unknown or other
  misc_feature (196)..(196): n is a, c, g, or t
  modified_base (217)..(217): a, c, t, g, unknown or other
  misc_feature (217)..(217): n is a, c, g, or t
  modified_base (520)..(520): a, c, t, g, unknown or other
  misc_feature (520)..(520): n is a, c, g, or t
  modified_base (527)..(557): a, c, t, g, unknown or other
  misc_feature (527)..(557): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctaggaaaaccgnggaccacggccgtctattacngtgctacgacctagtgctcgtccgacgttggtgaacgttccgaccccgtgggggaccggggaaccctggtccaccggtctcccgtccggccctccgaccaacggggcccagtccggtaccttccccccgtggccgccctggccctccgaggcgccaccgtccgagacgcacgacgccggccctggggcctcggcccgttcgggtacgaaacggtcctttaacccgttccccgttacgttccttaccttacgttcggacgggaccggggtctcgggaccgaacgggccgactacgtaaggctgnagcagcnnnnnnnnnnnnnnnnnnnnnnnnnnnnnnn

SEQ ID NO: 109877 - DNA, 544 bp, Homo sapiens
  misc_feature: GYAE6OF01ATHPS.21.60.F05.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
  modified_base (346)..(346): a, c, t, g, unknown or other
  misc_feature (346)..(346): n is a, c, g, or t
  modified_base (503)..(503): a, c, t, g, unknown or other
  misc_feature (503)..(503): n is a, c, g, or t
  modified_base (505)..(508): a, c, t, g, unknown or other
  misc_feature (505)..(508): n is a, c, g, or t
  modified_base (510)..(544): a, c, t, g, unknown or other
  misc_feature (510)..(544): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtcggtgaaggcaggttcaccatctccagagatgattacaaagaacacggcgtatctgacaaatgagcagcctagaaaaccgnggacncggcgtactattacngtgctagacctagtgcctcgtaccgctggttagaacgttcccggaccccgtgggggacccgggtaaccctggtaccaccgtctccgtccggcctaccaccgaacggccctacgtccgtccttcccccgnggcccgtccctgccctaccgaggaaccgccacccgtacgacgacgacacgaggccggccggtcggcgtacgtcgtggactaacggtaccttacctcccgtcgtactacccgtatacggaggtccgggacccttaggaccgaaggcccagtagtaagntnnnnannnnnnnnnnnnnnnnnnnnnnnnnnnnnnnnnnn

SEQ ID NO: 109878 - DNA, 690 bp, Homo sapiens
  misc_feature: GYAE6OF01D2NRJ.21.60.F05.1.454.CMB.1.raw
  modified_base (172)..(172): a, c, t, g, unknown or other
  misc_feature (172)..(172): n is a, c, g, or t
  modified_base (182)..(182): a, c, t, g, unknown or other
  misc_feature (182)..(182): n is a, c, g, or t
  modified_base (642)..(642): a, c, t, g, unknown or other
  misc_feature (642)..(642): n is a, c, g, or t
  modified_base (645)..(645): a, c, t, g, unknown or other
  misc_feature (645)..(645): n is a, c, g, or t
  modified_base (648)..(651): a, c, t, g, unknown or other
  misc_feature (648)..(651): n is a, c, g, or t
  modified_base (653)..(653): a, c, t, g, unknown or other
  misc_feature (653)..(653): n is a, c, g, or t
  modified_base (655)..(655): a, c, t, g, unknown or other
  misc_feature (655)..(655): n is a, c, g, or t
  modified_base (657)..(658): a, c, t, g, unknown or other
  misc_feature (657)..(658): n is a, c, g, or t
  modified_base (660)..(662): a, c, t, g, unknown or other
  misc_feature (660)..(662): n is a, c, g, or t
  modified_base (664)..(665): a, c, t, g, unknown or other
  misc_feature (664)..(665): n is a, c, g, or t
  modified_base (667)..(667): a, c, t, g, unknown or other
  misc_feature (667)..(667): n is a, c, g, or t
  modified_base (669)..(690): a, c, t, g, unknown or other
  misc_feature (669)..(690): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtcggtgaaaggcaggttcaccatctccagagatgattacaaagaacacggcgtatcngacaaatgancagacctaaggaaaaccggcggacgaccggtccgttatatttacgtgtgtacgtaacgaccttaggtcgtccttccggtaccgtagttggttaacgaaccggttcccggacccgggtggggggacccgggtacctggtacccacccgttcctccggtccgtccctaccgaaccggaccggccccttacggttcccccgggttaccccctttccccccgggcgggtacccccgtccccgttcgggtaccccgtaccgggaacgggacccacccggttaacccgtacggaaacggaccggaccgtaaccggccgggtaccccgggtccggtacggggtcctccggtaaccgtttacgggacgtaaaaccggtccctttacccgaccgggacggacgtaacccgtacggcggggaacgggtcccggtagtaccggggaacgaacggggtctaacgtaagtcgnagngannnncngngnngnnngnncngnnnnnnnnnnnnnnnnnnnnnn

SEQ ID NO: 109879 - DNA, 498 bp, Homo sapiens
  misc_feature: GYAE6OF01ERJOT.21.60.F05.1.454.CMB.1.raw
  modified_base (366)..(366): a, c, t, g, unknown or other
  misc_feature (366)..(366): n is a, c, g, or t
  modified_base (432)..(432): a, c, t, g, unknown or other
  misc_feature (432)..(432): n is a, c, g, or t
  modified_base (472)..(473): a, c, t, g, unknown or other
  misc_feature (472)..(473): n is a, c, g, or t
  modified_base (475)..(498): a, c, t, g, unknown or other
  misc_feature (475)..(498): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaaagaacacggcgtatctgcaaatgagcagcctgaaaaacccgaggacacggccgtctattactgtgctagacctagtggctcgtccgaactggttgaagttcgacccccgtgggggccggggaaccctggtcaccgtctcccgtcggcctccaccgaacgggcccaagttcggtccttccccccgtgggccgtcccctggctccagggtacnccgacctcccgaggacgcacaggccggaccctgggctgccgtacgtcgaaaggtaccactttcccncgtctctacctgacgtcggctgggccaaggcgacagtagnngnnnnnnnnnnnnnnnnnnnnnnnn

SEQ ID NO: 109880 - DNA, 639 bp, Homo sapiens
  misc_feature: GYAE6OF01A217W.21.60.F05.1.454.CMB.1.raw
  modified_base (194)..(194): a, c, t, g, unknown or other
  misc_feature (194)..(194): n is a, c, g, or t
  modified_base (535)..(535): a, c, t, g, unknown or other
  misc_feature (535)..(535): n is a, c, g, or t
  modified_base (560)..(560): a, c, t, g, unknown or other
  misc_feature (560)..(560): n is a, c, g, or t
  modified_base (570)..(570): a, c, t, g, unknown or other
  misc_feature (570)..(570): n is a, c, g, or t
  modified_base (629)..(629): a, c, t, g, unknown or other
  misc_feature (629)..(629): n is a, c, g, or t
tcagtcgtcgctcgcacgaccggtgctcgatttagtacgtcatcagggaaagggcgtggagtgggttggccgtattggaagcaaaactaacaattacgcgacaacatatgctgcgtcggtgaagcaggttcaccatctccagagatgattcaaagaacacggcgtatctgcaaatgagcagcctagaaaaccgnggacacggccgtctattactgtgctagacctagtgctcgtccgactggtagagttccgacccgtggggccggaacctggtcaccgtctccgtcggcctccacgaacgggccctagtccggtccttacccccgtggccgtacccctgcctaccgaggacgtccacccgtccgagacgctaaccgacggccggtacccgtgggaccttcggccgttacgggtactaaaccgggtaccttaccctttcccgtaccgttctacccgtaacgttcggacggtaccgggtccgtacgggaccgtaacgggtcccggtacgaaacggttacggactacggactacggngtgtacgtagtagtacatacgcganagtagtacgngtacgtagtacgtagtcgacgacgtacgacgtacgtgacgtcacgtcgacgacacgacnctcgtcgacg

SEQ ID NO: 109881 - DNA, 675 bp, Homo sapiens
  misc_feature: GYAE6OF01EJ7ZW.21.60.F05.1.454.CMB.1.raw
  modified_base (632)..(632): a, c, t, g, unknown or other
  misc_feature (632)..(632): n is a, c, g, or t
  modified_base (637)..(638): a, c, t, g, unknown or other
  misc_feature (637)..(638): n is a, c, g, or t
  modified_base (642)..(642): a, c, t, g, unknown or other
  misc_feature (642)..(642): n is a, c, g, or t
  modified_base (645)..(646): a, c, t, g, unknown or other
  misc_feature (645)..(646): n is a, c, g, or t
  modified_base (648)..(675): a, c, t, g, unknown or other
  misc_feature (648)..(675): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattacaaaagaacacggcgtatctgacaaatgagcagcctagaaaaccgaggacacggccgttctattacgtgtgctacgaccttagtggcctcggtccgacgttggttagacggttcccggaccccggtcgggggaccccggggtaacccttcggccctacccgttccgtcccgtccggccctacccgaacccggaacggcccctagttccccgggttcccctttccccccggcgggtccccgtccccgtttcggccccgttacccggaacgggtacccgtaccccaccccggttacccggaacggtaccgacccgacggtaccggtccccggccccggttggggcccctaccgggtacccgttacgggtaaaccggtaaccgggttaaccctttacccccgttttacccccgtcgttcccttaccgtacggttcgggaccggggttccgggtacgtacgggacgacggcctacggaactggntccgnngcgntanntnnnnnnnnnnnnnnnnnnnnnnnnnnnn

SEQ ID NO: 109882 - DNA, 608 bp, Homo sapiens
  misc_feature: GYAE6OF01C8S0H.21.60.F05.1.454.CMB.1.raw
  modified_base (165)..(165): a, c, t, g, unknown or other
  misc_feature (165)..(165): n is a, c, g, or t
  modified_base (189)..(189): a, c, t, g, unknown or other
  misc_feature (189)..(189): n is a, c, g, or t
  modified_base (210)..(210): a, c, t, g, unknown or other
  misc_feature (210)..(210): n is a, c, g, or t
  modified_base (235)..(235): a, c, t, g, unknown or other
  misc_feature (235)..(235): n is a, c, g, or t
  modified_base (512)..(512): a, c, t, g, unknown or other
  misc_feature (512)..(512): n is a, c, g, or t
  modified_base (528)..(528): a, c, t, g, unknown or other
  misc_feature (528)..(528): n is a, c, g, or t
  modified_base (532)..(532): a, c, t, g, unknown or other
  misc_feature (532)..(532): n is a, c, g, or t
  modified_base (539)..(539): a, c, t, g, unknown or other
  misc_feature (539)..(539): n is a, c, g, or t
  modified_base (555)..(555): a, c, t, g, unknown or other
  misc_feature (555)..(555): n is a, c, g, or t
  modified_base (570)..(570): a, c, t, g, unknown or other
  misc_feature (570)..(570): n is a, c, g, or t
  modified_base (586)..(586): a, c, t, g, unknown or other
  misc_feature (586)..(586): n is a, c, g, or t
  modified_base (592)..(592): a, c, t, g, unknown or other
  misc_feature (592)..(592): n is a, c, g, or t
  modified_base (595)..(596): a, c, t, g, unknown or other
  misc_feature (595)..(596): n is a, c, g, or t
  modified_base (598)..(598): a, c, t, g, unknown or other
  misc_feature (598)..(598): n is a, c, g, or t
  modified_base (600)..(601): a, c, t, g, unknown or other
  misc_feature (600)..(601): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtcggtgaaaggctaggttcaccatcctccagagatgattacgaaagaacncggctatcgtacgataaagtggancgacgtcccaaggaaaaccgnggtaccacggtcgtacttagttcgngtcgctagaccgttagtcgcgtcgccgtagtgtagacgtccgacccggtggggaccggtaccgtcgtccgaccgtctccgacggtcctaccgaccgtacgccgtcgtccggttcccttcccggcgcccgtaccgtcgaccgtacggacggtaccgcccgtaccgtacgaacgaccgaccgtaccggccggccgtaccggtggtcgtccgccggttagacgtaccgtaccttccgtcctacgtcctacgtacgcggacgtcggtcgtagacccggtancgacgtcgcgcgatcngtcncgtcgangcgacgcgcgtgacgngacgcgacgtctacnctctcgcgtgacgcgngcgtcncgnncncnncngngtg

SEQ ID NO: 109883 - DNA, 496 bp, Homo sapiens
  misc_feature: GYAE6OF01A77L1.21.60.F05.1.454.CMB.1.raw
  modified_base (160)..(160): a, c, t, g, unknown or other
  misc_feature (160)..(160): n is a, c, g, or t
  modified_base (195)..(195): a, c, t, g, unknown or other
  misc_feature (195)..(195): n is a, c, g, or t
  modified_base (237)..(237): a, c, t, g, unknown or other
  misc_feature (237)..(237): n is a, c, g, or t
  modified_base (320)..(320): a, c, t, g, unknown or other
  misc_feature (320)..(320): n is a, c, g, or t
  modified_base (356)..(356): a, c, t, g, unknown or other
  misc_feature (356)..(356): n is a, c, g, or t
  modified_base (453)..(453): a, c, t, g, unknown or other
  misc_feature (453)..(453): n is a, c, g, or t
  modified_base (457)..(458): a, c, t, g, unknown or other
  misc_feature (457)..(458): n is a, c, g, or t
  modified_base (461)..(496): a, c, t, g, unknown or other
  misc_feature (461)..(496): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacncggcgtatctgcaaatgagcagcctagaaaaccgnggacacggccgtctatactgtgctagacctagtgctcgccgntggtgagttccgacccgtggggccgggaacctggcaccgtcctccgcggcctccgacacgggcccatccggtcccttccccgnggccgtccctggcctccggagcgacaccgtcgagcncacgcgccggcctggctcgccgtggacacggtaccttacgttccccgtgtcctctacgtggacggtccgtggtcgaccggtacgggctacaagtcgntcgnngcnnnnnnnnnnnnnnnnnnnnnnnnnnnnnnnnnnnn

SEQ ID NO: 109884 - DNA, 540 bp, Homo sapiens
  misc_feature: GYAE6OF01BDKQP.21.60.F05.1.454.CMB.1.raw
  modified_base (196)..(196): a, c, t, g, unknown or other
  misc_feature (196)..(196): n is a, c, g, or t
  modified_base (378)..(378): a, c, t, g, unknown or other
  misc_feature (378)..(378): n is a, c, g, or t
  modified_base (522)..(540): a, c, t, g, unknown or other
  misc_feature (522)..(540): n is a, c, g, or t
tcagtcgtcgctcgcacgaccggtgctcgatttagtacgtcatcagggaaagggcgtggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggcctcgtccgacgtggttgaagttccgaccccgtgggggcccggggaaccctggtccaccgtctccgtccggccctccacccgaacgggcccctagtccggtccctttccccccgtgggcccgcccgttcgcctcccgagggtaccnccgaccctcccggagaccgcaaccgacggcccgggtcccgtgggggcctcgggccccgttagggtacccgaaacgggtacctttacctttccccgtacgtccttactacgttcggacggcgggctggacgacgggcacagtagnnnnnnnnnnnnnnnnnnn

SEQ ID NO: 109885 - DNA, 661 bp, Homo sapiens
  misc_feature: GYAE6OF01BTDBO.21.60.F05.1.454.CMB.1.raw
  modified_base (137)..(137): a, c, t, g, unknown or other
  misc_feature (137)..(137): n is a, c, g, or t
  modified_base (191)..(191): a, c, t, g, unknown or other
  misc_feature (191)..(191): n is a, c, g, or t
  modified_base (361)..(361): a, c, t, g, unknown or other
  misc_feature (361)..(361): n is a, c, g, or t
  modified_base (609)..(610): a, c, t, g, unknown or other
  misc_feature (609)..(610): n is a, c, g, or t
  modified_base (612)..(615): a, c, t, g, unknown or other
  misc_feature (612)..(615): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (624)..(624): a, c, t, g, unknown or other
  misc_feature (624)..(624): n is a, c, g, or t
  modified_base (627)..(629): a, c, t, g, unknown or other
  misc_feature (627)..(629): n is a, c, g, or t
  modified_base (632)..(633): a, c, t, g, unknown or other
  misc_feature (632)..(633): n is a, c, g, or t
  modified_base (636)..(636): a, c, t, g, unknown or other
  misc_feature (636)..(636): n is a, c, g, or t
  modified_base (638)..(639): a, c, t, g, unknown or other
  misc_feature (638)..(639): n is a, c, g, or t
  modified_base (641)..(642): a, c, t, g, unknown or other
  misc_feature (641)..(642): n is a, c, g, or t
  modified_base (644)..(644): a, c, t, g, unknown or other
  misc_feature (644)..(644): n is a, c, g, or t
  modified_base (646)..(648): a, c, t, g, unknown or other
  misc_feature (646)..(648): n is a, c, g, or t
  modified_base (650)..(653): a, c, t, g, unknown or other
  misc_feature (650)..(653): n is a, c, g, or t
  modified_base (655)..(655): a, c, t, g, unknown or other
  misc_feature (655)..(655): n is a, c, g, or t
  modified_base (657)..(657): a, c, t, g, unknown or other
  misc_feature (657)..(657): n is a, c, g, or t
  modified_base (659)..(661): a, c, t, g, unknown or other
  misc_feature (659)..(661): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaggcaggttcacatcncagagatgattcaaagacaggcgtatctgcaaagtgagcagcctagaaaaccgnggacaccggcctctaattacgtagtcgactaacgaccgttagtggctcgtaccgacttgggttaagaacgtttccggccccgtagggggacccggggtaaccctggtccaccggtcctccgtaccggccctaccaccgaacgggccctacgtccggtacccttcccccgnggacccgtcccgtcgaccgtaccgacggtacggaccacccgtccggaacggaccaccgaaccgacgggaccccgggtcccggtcggggccgttacggaccccggttacggggtaacccgtaaacggggtacccctttaaacccgttttccccccgtacggttttaaccccgtaccttaaccggttcggggaaccgggtccggggtaccgggtcggaacgtaaccgggcgtacgaaagtacgcaggacnncnnnngtananacngannncannacnanncnnancnnnannnnanancnnn

SEQ ID NO: 109886 - DNA, 466 bp, Homo sapiens
  misc_feature: GYAE6OF01AWKWR.21.60.F05.1.454.CMB.1.raw
  modified_base (197)..(197): a, c, t, g, unknown or other
  misc_feature (197)..(197): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (394)..(394): a, c, t, g, unknown or other
  misc_feature (394)..(394): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (436)..(438): a, c, t, g, unknown or other
  misc_feature (436)..(438): n is a, c, g, or t
  modified_base (440)..(466): a, c, t, g, unknown or other
  misc_feature (440)..(466): n is a, c, g, or t
tcagtcgtcgctcgcacgaccggtgctcgatttagtacgtcatcagggaaagggctggagtgggttggccgtatttggaagcaaaactaacaattacgcgacaaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgatggttgaagtttccgacccctgggggcccgggaaccctggtcaccgtctcctcggcctccaccaggccatcggtcttccccnggcncctnctccaggacncacctcgangcacngccgccctggctgccgtggtacaaggcttaccttcccncgtctctactgagcgggtctaggcaagggccanacgtagntnnncnnnnnnnnnnnnnnnnnnnnnnnnnnn

SEQ ID NO: 109887 - DNA, 676 bp, Homo sapiens
  misc_feature: GYAE6OF01ATR9Y.21.60.F05.1.454.CMB.1.raw
  modified_base (221)..(221): a, c, t, g, unknown or other
  misc_feature (221)..(221): n is a, c, g, or t
  modified_base (255)..(255): a, c, t, g, unknown or other
  misc_feature (255)..(255): n is a, c, g, or t
  modified_base (599)..(599): a, c, t, g, unknown or other
  misc_feature (599)..(599): n is a, c, g, or t
  modified_base (610)..(610): a, c, t, g, unknown or other
  misc_feature (610)..(610): n is a, c, g, or t
  modified_base (629)..(629): a, c, t, g, unknown or other
  misc_feature (629)..(629): n is a, c, g, or t
  modified_base (675)..(675): a, c, t, g, unknown or other
  misc_feature (675)..(675): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctagcaaatgagcagcctagaaaaccgaggacaccggccgtacttacttacgngtcgactagacctaggtcgctcgtccgattggtnaacggttccggacccgtcgggggaccgggtaacccttcggtacaccggttcgtcccgtcgccgtaccaccgaacggccctagtccggttaccctccccggtgacccgtccctacgcctaccggaggtccgacctaccccgtacgacgtaacgcctaacggccgtcccgggtcccgttcgggcttcccgggtccgtacgggtaacgaaaacggttcccctttaccgttacccgtttcccggttcccttaccgttaacgtaccgggccgggtacccgggtggttaccggaaccgggttaccggactaacccggttaacgtacggtcgacgctccgaagcctagacncgcgacgcacncgcgcgacgtctcgtcgcncgcgtacgtctcgtacgtcgtcacgcgcacgacgtagagtgcgcgnc

SEQ ID NO: 109888 - DNA, 520 bp, Homo sapiens
  misc_feature: GYAE6OF01EYX59.21.60.F05.1.454.CMB.1.raw
  modified_base (196)..(196): a, c, t, g, unknown or other
  misc_feature (196)..(196): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (469)..(469): a, c, t, g, unknown or other
  misc_feature (469)..(469): n is a, c, g, or t
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
  modified_base (484)..(486): a, c, t, g, unknown or other
  misc_feature (484)..(486): n is a, c, g, or t
  modified_base (488)..(493): a, c, t, g, unknown or other
  misc_feature (488)..(493): n is a, c, g, or t
  modified_base (495)..(520): a, c, t, g, unknown or other
  misc_feature (495)..(520): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaaagaacacggcgtatctgcaaatgagcagcctagaaaaccgnggacacggcctactattactgtgctagacctagtggctccggtccgacgtggttagaacgttccgaccccgtgggggcccggaaccctggtccaccgtctccgcgcctccacaggcccatccgtcctccccnggccncctncctcgagcncaccgtcgagagccacgacggccggccctgggccttcgcgtacggtacgaaacggtccttaaccgtttcccctaccgttctacttacgtaggccgggcgggtccgtacgggacaacccggggnacgtagaagnacngnnncnnnnnncnnnnnnnnnnnnnnnnnnnnnnnnnn

SEQ ID NO: 109889 - DNA, 716 bp, Homo sapiens
  misc_feature: GYAE6OF01BXATR.21.60.F05.1.454.CMB.1.raw
  modified_base (230)..(230): a, c, t, g, unknown or other
  misc_feature (230)..(230): n is a, c, g, or t
  modified_base (467)..(467): a, c, t, g, unknown or other
  misc_feature (467)..(467): n is a, c, g, or t
  modified_base (669)..(669): a, c, t, g, unknown or other
  misc_feature (669)..(669): n is a, c, g, or t
  modified_base (675)..(675): a, c, t, g, unknown or other
  misc_feature (675)..(675): n is a, c, g, or t
  modified_base (681)..(686): a, c, t, g, unknown or other
  misc_feature (681)..(686): n is a, c, g, or t
  modified_base (688)..(698): a, c, t, g, unknown or other
  misc_feature (688)..(698): n is a, c, g, or t
  modified_base (700)..(700): a, c, t, g, unknown or other
  misc_feature (700)..(700): n is a, c, g, or t
  modified_base (702)..(716): a, c, t, g, unknown or other
  misc_feature (702)..(716): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattacaaagaacacggcgtatctgacaaagtgagcacgcctaaggaaaaccggagaccgaccggtccgttacttaattacgngtctactacgtacctaggtcggtcttaccgtcggtacgttgggttacgtaacggttcccggacccgggtcggggggacccgggtaacccgttcggtacccgtacccggttccctacccggtccggtaccctaacccggaaccggaacccggggtccccttaacgttccccggggtttccccttccccgggcggtcccgtcccgtcgacccgtaccggacggacacccctaccggtanaacggaccgaaccgaccgggaccgggtaccccggtcccgggtcgggtaacccttcgggcccggttaccgggaaaccgtaaacccggtttaccctttaccccctttcccggtactttacccgttccgtttaaccgggcggggtacccgggtcggggtccgtaacgggaaccggtaacggggtcaaccgtaaggtacgcgttanccgtangctcgnnnnnncnnnnnnnnnnngngnnnnnnnnnnnnnnn

SEQ ID NO: 109890 - DNA, 539 bp, Homo sapiens
  misc_feature: GYAE6OF01BC5H1.21.60.F05.1.454.CMB.1.raw
  modified_base (194)..(194): a, c, t, g, unknown or other
  misc_feature (194)..(194): n is a, c, g, or t
  modified_base (335)..(335): a, c, t, g, unknown or other
  misc_feature (335)..(335): n is a, c, g, or t
  modified_base (499)..(499): a, c, t, g, unknown or other
  misc_feature (499)..(499): n is a, c, g, or t
  modified_base (502)..(503): a, c, t, g, unknown or other
  misc_feature (502)..(503): n is a, c, g, or t
  modified_base (505)..(539): a, c, t, g, unknown or other
  misc_feature (505)..(539): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgacttggttgaagttccgaccccgtgggggcccgggacctggtccaccgtctccgtcggcctccaccgagggcccagtccgtccttcccccgtggccnccctgcctccgaggcgccacctccgagcgacacgacggccggccccgtggggcctcggcccgtagggtccgaacgggtaccttacccgtttcccgtcgtcctccgttacgttggaccgggtcggggtcgtacgggaccgtaacgggccgtaccgtaagttacgncgnngnnnnnnnnnnnnnnnnnnnnnnnnnnnnnnnnnnn

SEQ ID NO: 109891 - DNA, 573 bp, Homo sapiens
  misc_feature: GYAE6OF01CIFWU.21.60.F05.1.454.CMB.1.raw
  modified_base (123)..(123): a, c, t, g, unknown or other
  misc_feature (123)..(123): n is a, c, g, or t
  modified_base (326)..(326): a, c, t, g, unknown or other
  misc_feature (326)..(326): n is a, c, g, or t
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
  modified_base (402)..(402): a, c, t, g, unknown or other
  misc_feature (402)..(402): n is a, c, g, or t
  modified_base (411)..(411): a, c, t, g, unknown or other
  misc_feature (411)..(411): n is a, c, g, or t
  modified_base (494)..(494): a, c, t, g, unknown or other
  misc_feature (494)..(494): n is a, c, g, or t
  modified_base (507)..(507): a, c, t, g, unknown or other
  misc_feature (507)..(507): n is a, c, g, or t
  modified_base (535)..(573): a, c, t, g, unknown or other
  misc_feature (535)..(573): n is a, c, g, or t
tcagtcgtcgctcgcacgaccggtgctcgatttagtacgtcatcaggggaaaggggctggagtgggttggccgtattggaagcaaaactaacaattacgcgaacaacatactgctgcgtcgtnaaaggcaggttcaccatctccagagattcgattcaaaagacacggctatctgacaaatgagcagcctagaaaaccgtggaactcggcctctaattacgtgtgcgtagaccttagcgctcgtaccggctgggtttacgaacgggtttcccaaaccccggttggggggacccggggtaaacccttcggggtcctaacccgttccncccgtcggacccctaccgaacccgaagggtcccccaagttcccggtcctttcccccgnggtcccncccctaggccnccgaaggcncaccctcggagacgctacgcgtccggccctaggggcctggcctggtaccaaggtaccttcgttccccctggtctccgttacgnggacggccgggtnacgggacgaaggcgttacaagtacggcnnnnnnnnnnnnnnnnnnnnnnnnnnnnnnnnnnnnnnn

SEQ ID NO: 109892 - DNA, 520 bp, Homo sapiens
  misc_feature: GYAE6OF01DH9X1.21.60.F05.1.454.CMB.1.raw
  modified_base (193)..(193): a, c, t, g, unknown or other
  misc_feature (193)..(193): n is a, c, g, or t
  modified_base (211)..(211): a, c, t, g, unknown or other
  misc_feature (211)..(211): n is a, c, g, or t
  modified_base (279)..(279): a, c, t, g, unknown or other
  misc_feature (279)..(279): n is a, c, g, or t
  modified_base (457)..(457): a, c, t, g, unknown or other
  misc_feature (457)..(457): n is a, c, g, or t
  modified_base (484)..(486): a, c, t, g, unknown or other
  misc_feature (484)..(486): n is a, c, g, or t
  modified_base (488)..(520): a, c, t, g, unknown or other
  misc_feature (488)..(520): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagacacggctatctgcaaatgagcagcctagaaaaccgnggacacggctctattacngtgctagacctagtgctcgtccgactggttacgaagttccgacccgtgggggcccgggaacctggtcnccgtctccgtcggccctccaaccgacgggccctagtccggtccttcccccgtggccgcccctagcctccgagggacccgaccgtccgagacgccgtaacgcggccggtaccctggggctcggcctacgggtcaacgggacttaccttcccctcggtctaccgtacgtggacggtcggntacgggacaacgggtcactgtacggannngnnnnnnnnnnnnnnnnnnnnnnnnnnnnnnnnn

SEQ ID NO: 109893 - DNA, 701 bp, Homo sapiens
  misc_feature: GYAE6OF01DLMJG.21.60.F05.1.454.CMB.1.raw
  modified_base (658)..(658): a, c, t, g, unknown or other
  misc_feature (658)..(658): n is a, c, g, or t
  modified_base (663)..(663): a, c, t, g, unknown or other
  misc_feature (663)..(663): n is a, c, g, or t
  modified_base (669)..(701): a, c, t, g, unknown or other
  misc_feature (669)..(701): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattacaaaagaacacggcgtatctgacaaatgagcacgacctagaaaaccggagaccgacggccgttacttattacctggtcgtactagaccgttaggtcggtacgttccgtccggtacgttgggtttacggtaaaccggttcccgggtacccccggggtaccgggggggaccccggggtaacccgttcgggtacccgtaccccgtccgttaccccggtccggaccccctacccgaacccggtaaccggggtacccccttaggttccccggtttaccccctttcccccggccgggtcccctccccgtccgtccctacccggacggtaccgcccgtacccgtaaccggacgaccgaccacggtaccggccccggcccgggttggtcctacccggtcggtacgggtaccctaaacgggttccctttaccccgtcccctttacggtcccttaccgttacggtcgggtaccggggtcccggggtacacggggtaaccgacggccgaacgttagngcagnttgctnnnnnnnnnnnnnnnnnnnnnnnnnnnnnnnnn

SEQ ID NO: 109894 - DNA, 819 bp, Homo sapiens
  misc_feature: GYAE6OF01CA9LL.21.60.F05.1.454.CMB.1.raw
  modified_base (737)..(737): a, c, t, g, unknown or other
  misc_feature (737)..(737): n is a, c, g, or t
  modified_base (774)..(774): a, c, t, g, unknown or other
  misc_feature (774)..(774): n is a, c, g, or t
  modified_base (776)..(776): a, c, t, g, unknown or other
  misc_feature (776)..(776): n is a, c, g, or t
  modified_base (785)..(785): a, c, t, g, unknown or other
  misc_feature (785)..(785): n is a, c, g, or t
  modified_base (803)..(803): a, c, t, g, unknown or other
  misc_feature (803)..(803): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattacaaagaacgacggcgtatctgacaaagtgagcagcctagaaaaccgaggacgaccggccgtatacttacgtgtcgcttaacgaccgttaggtcgtccgtccgtaccgtactttggtttagtaaacggtttcccggacccccggttcggggggaccccggggtaaccccgtgggttacccgtaaccccggttccttccccggttaccggacccccgtacccgaaccccggaaccgggtcccctacggttcccgggttcccccgtttaccccccggtcggtcccggtccccgttaccgcccgtaccggtacggaacggaccctacccgtaccggacggaccgaccgaaccgacggccccggtaccggtcgggtaccgttccggcccggttaacggttaccggaaacccggttacccgtttaacccgtttcccccggtttaccgtttaccctttaccggttaaacggtccggggttaaacccgggggccgggtttaccggaacccggggtaacgggtaaccccggggtcgtaaccccgttaaaaggcggacggtccgtaatccgcgtcgcgtcgtacgtacgacgcgngtacgtacgtacgtacgtacgacgtacgagcgcgacncngacgacgtnactacgacagacgtcganacgtacgacgtacgtc

SEQ ID NO: 109895 - DNA, 1049 bp, Homo sapiens
  misc_feature: GYAE6OF01EAZKL.21.60.F05.1.454.CMB.1.raw
  modified_base (146)..(146): a, c, t, g, unknown or other
  misc_feature (146)..(146): n is a, c, g, or t
  modified_base (919)..(919): a, c, t, g, unknown or other
  misc_feature (919)..(919): n is a, c, g, or t
tcagtcgtcgctcgcacgaccggtgctcgatttagtacgtcatcagggaaagggctggagtgggttggccgtattggaagcaaaactaacaattacgcgacaacatatgcctgcggtcggagaagcgtagtaccacatcacgagangtagtatacgaaagacgacggtacgtactcgtagaactaagtacgacgacgacgtaccgtaaaacggaaaccggacggaccggtacccggttacgttaacgttaacgtttacgtcggttacgttaacgtaaccggtttaaccgttagggtcgttacccggttaccgttaaccgggtacggtttaagggttaacggttaaccgggttaccccgggtaccccgggggttacggggggaacccccgggttaacccggttcgggttaaaccccggtcccgtttcccggtttaccccgggtaccccgttccccgttaaacccggaaaacccggggtacccccggtaaccgtttaccccgggtttccccccgggttttaacccccccgttcccccggggtcccgggggttaccccctcccggtttaccccggtaccccggttaaacccgggtaaacgggggtcccctaaaccccgtttaacccccggggtaaaccgggaaaaccgggtcccggaaaccccggaaacccgggtttaccccggggccccccggggggttaacccgttacgggggtccgtttaccccccggacccggggtttaaacggggaacccggttaaaacccggtttacccccgttttaccccggttttcccccggttacgttacccccgtttaaaggtaccccgggtttacggggaccccgggggttacccgggtacgggttaacccggaaaccgggggttaccgaccgggtttaaacgtaaggtaccgatcgtacngtcgtacgacgacgcgtacgtacgtacgtacgacgtcgagtaccgacgtacgacgtcgacgtcgtacgacgtacgtacgtaacgtacgagacgacgtacgtaacgtacgacctactacgttacgtcgtcg

SEQ ID NO: 109896 - DNA, 583 bp, Homo sapiens
  misc_feature: GYAE6OF01ARVO0.21.60.F05.1.454.CMB.1.raw
  modified_base (196)..(196): a, c, t, g, unknown or other
  misc_feature (196)..(196): n is a, c, g, or t
  modified_base (344)..(344): a, c, t, g, unknown or other
  misc_feature (344)..(344): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (548)..(550): a, c, t, g, unknown or other
  misc_feature (548)..(550): n is a, c, g, or t
  modified_base (552)..(583): a, c, t, g, unknown or other
  misc_feature (552)..(583): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattacaaaagacacggctatctgacaaatgagcagcctaagaaaccgnggacaccggtcctctattcgtgtgactagacctgtcggctcgtccgagttggtacgacgtcccgacccggtgggggacccgggtacctggtccaccgtctccgtccgccctaccgacgacgggccctagttcccgtcccttccccggnggcccctcccgtgtaccgtaccgacggacgcccgtacccgtcggaagacaccgaacgccggtccccggaccggttggacctcccggcccgtagggtaaccaacggtttacctttaccctttcccgtgtttacccctcgtaaccggcggtaccgggcccgggtactacgggactaagggtcccgataacgtcggancngtnancnnncnnnnnnnnnnnnnnnnnnnnnnnnnnnnnnnn

SEQ ID NO: 109897 - DNA, 582 bp, Homo sapiens
  misc_feature: GYAE6OF01D33LB.21.60.F05.1.454.CMB.1.raw
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (545)..(548): a, c, t, g, unknown or other
  misc_feature (545)..(548): n is a, c, g, or t
  modified_base (550)..(550): a, c, t, g, unknown or other
  misc_feature (550)..(550): n is a, c, g, or t
  modified_base (555)..(582): a, c, t, g, unknown or other
  misc_feature (555)..(582): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtcggtgaaaggcaggttcaccatctccagagatgattacaaagaaccacggcgtatctgacaaatgagcagcctagaaaaccgngacacggccgtntattactgtgctagacctaggtcggctccgtccgacgttggtagtaacgttccgaccccggtgggggacccgggaaccctggtccaccgtcctccgtccgcctccaaccgaccgggcctacgtccggtcccttcccccgtcggccgtccccgtcgcctccgacggcgccacccgtccggaagacgccaacgaccggccggcccggtgggcctacggtcccgttgggacctaaacgggtccctttaaccgttcccgttccggttccttacttacgtacggacggggccgggtacgtcgggtaccgaacgggtccgacgtagtacgcgcagtgcgnnnncntcgcnnnnnnnnnnnnnnnnnnnnnnnnnnnn

SEQ ID NO: 109898 - DNA, 621 bp, Homo sapiens
  misc_feature: GYAE6OF01D688G.21.60.F05.1.454.CMB.1.raw
  modified_base (183)..(183): a, c, t, g, unknown or other
  misc_feature (183)..(183): n is a, c, g, or t
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (575)..(575): a, c, t, g, unknown or other
  misc_feature (575)..(575): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
  modified_base (587)..(589): a, c, t, g, unknown or other
  misc_feature (587)..(589): n is a, c, g, or t
  modified_base (591)..(621): a, c, t, g, unknown or other
  misc_feature (591)..(621): n is a, c, g, or t
tcagtcgtcgctcgcacgaccggtgctcgatttagtacgtcatcagggaaagggctggagtgggtggccgtattggaagcaaaactaacaattacgcgacaacatatggctgcggtcggtagaaaggcaggttcaccatctccagagatgacttacaaagacacgggctatctgacaaatgancacgccaagaaaccgngccacggcctactattacgngtcnctacggactgtgctcgcgtagtgtagtacgtccggacccggtggggacccgggtaccgtggtaccgtccgtccgtccgccggtcctaccgaaccgaccgggcctacggttccccggttccccttcccccggcgggcccgtacccgtcgcccgtaccggaggaccgtcccgaccgtacccgaggaccgtacgaccgaccgggtcccccggtccggtcgggtccgtaccggtcccggtacgggtaaccgtaaccgggttacccttacccggtaccccgggagtaaccccggtacggaaccgttacggggaccggggccggtaccgggtacgggaacgaacgggtcgaaacgtanaggcncagcngnnngnnnnnnnnnnnnnnnnnnnnnnnnnnnnnnn

SEQ ID NO: 109899 - DNA, 567 bp, Homo sapiens
  misc_feature: GYAE6OF01EYGV8.21.60.F05.1.454.CMB.1.raw
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (302)..(302): a, c, t, g, unknown or other
  misc_feature (302)..(302): n is a, c, g, or t
  modified_base (469)..(469): a, c, t, g, unknown or other
  misc_feature (469)..(469): n is a, c, g, or t
  modified_base (519)..(519): a, c, t, g, unknown or other
  misc_feature (519)..(519): n is a, c, g, or t
  modified_base (528)..(528): a, c, t, g, unknown or other
  misc_feature (528)..(528): n is a, c, g, or t
  modified_base (530)..(552): a, c, t, g, unknown or other
  misc_feature (530)..(552): n is a, c, g, or t
  modified_base (554)..(567): a, c, t, g, unknown or other
  misc_feature (554)..(567): n is a, c, g, or t
tcagtcgtcgctcgcacgaccggtgctcgattttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaaatgagcaggccctagaaaaccgnggacacggccgtctattacngngctagacctagtggctcgtccgtagttggttanacggttccgaccccggtgggggacccgggaacctggtaccaccgtccnccgttccggccctaccaccgaagggccccagttccggtcccttcccccgtgggcccgtaccccttggacctcccgaggtaccgccgaaccccgtcggaacgacgccaacggtaccgccggcccgtgggacctgtcccgtaggtaccgaaagtacctaccctttcccncgtcttacgagtcggacgggtcggacgtcggacgtaacgggccacgtaanggtactgcngnnnnnnnnnnnnnnnnnnnnnnngnnnnnnnnnnnnnn

SEQ ID NO: 109900 - DNA, 809 bp, Homo sapiens
  misc_feature: GYAE6OF01DOOPH.21.60.F05.1.454.CMB.1.raw
  modified_base (103)..(103): a, c, t, g, unknown or other
  misc_feature (103)..(103): n is a, c, g, or t
  modified_base (159)..(159): a, c, t, g, unknown or other
  misc_feature (159)..(159): n is a, c, g, or t
  modified_base (728)..(728): a, c, t, g, unknown or other
  misc_feature (728)..(728): n is a, c, g, or t
  modified_base (746)..(747): a, c, t, g, unknown or other
  misc_feature (746)..(747): n is a, c, g, or t
  modified_base (749)..(749): a, c, t, g, unknown or other
  misc_feature (749)..(749): n is a, c, g, or t
  modified_base (753)..(753): a, c, t, g, unknown or other
  misc_feature (753)..(753): n is a, c, g, or t
  modified_base (755)..(755): a, c, t, g, unknown or other
  misc_feature (755)..(755): n is a, c, g, or t
  modified_base (757)..(757): a, c, t, g, unknown or other
  misc_feature (757)..(757): n is a, c, g, or t
  modified_base (766)..(766): a, c, t, g, unknown or other
  misc_feature (766)..(766): n is a, c, g, or t
  modified_base (770)..(770): a, c, t, g, unknown or other
  misc_feature (770)..(770): n is a, c, g, or t
  modified_base (772)..(772): a, c, t, g, unknown or other
  misc_feature (772)..(772): n is a, c, g, or t
  modified_base (786)..(786): a, c, t, g, unknown or other
  misc_feature (786)..(786): n is a, c, g, or t
  modified_base (789)..(789): a, c, t, g, unknown or other
  misc_feature (789)..(789): n is a, c, g, or t
  modified_base (793)..(793): a, c, t, g, unknown or other
  misc_feature (793)..(793): n is a, c, g, or t
  modified_base (799)..(799): a, c, t, g, unknown or other
  misc_feature (799)..(799): n is a, c, g, or t
  modified_base (801)..(801): a, c, t, g, unknown or other
  misc_feature (801)..(801): n is a, c, g, or t
  modified_base (804)..(804): a, c, t, g, unknown or other
  misc_feature (804)..(804): n is a, c, g, or t
  modified_base (807)..(807): a, c, t, g, unknown or other
  misc_feature (807)..(807): n is a, c, g, or t
tcagtcgtcgctcgcacgaccggtgctcgatttagtacgtcatcagggaaagggctggagtgggttgcgtattggaagcaaaactaacaattacgcgacaacntatgctgcgtcggtgaaaggcaggttcaccatctcagagatgactacgaaagaacncggtctatcgtagaactaaagtcggacgtaccgaacgtaccgtaaaacgggaaaaacccggacgggtaacccgtaccggggtacccgtttacttaaacgttttacgtcggttacggtaccttaaaccggtaaccggtagggttcccgggttccttaacccgggttaccggttacgggtttagggtttaaccggggtaaccggttcccccgggtaacccggggggtccggggggtaacccgggttaaacccgtcggtaccccgtccgttcccgttacccggtccgtaccccgaccgaaccggaccggtcccctaccggtttccccgttccccgtcccggtacggcccgttcccgtacgtcccgtacggaccgggtacctaccgtacccggtaccgacgtaccggccgtaaccgggccggtaccccggtccggtcggcggtccgtacggtacgggttaaccaacggtttccccttaaccgtttccccgtacggttacccttcggaccgggttcggtaccggggcgggtaaccgtacgggaccgaacgggttcccgaagttaagcgtacgtnagtgcgtcaagtcgtaanncncgcncngntcgacgctntcgngngtcgcgatacgcgntcngagngcgtcngncgngtncg

SEQ ID NO: 109901 - DNA, 843 bp, Homo sapiens
  misc_feature: GYAE6OF01B8AP3.21.60.F05.1.454.CMB.1.raw
  modified_base (227)..(227): a, c, t, g, unknown or other
  misc_feature (227)..(227): n is a, c, g, or t
  modified_base (508)..(508): a, c, t, g, unknown or other
  misc_feature (508)..(508): n is a, c, g, or t
  modified_base (773)..(773): a, c, t, g, unknown or other
  misc_feature (773)..(773): n is a, c, g, or t
  modified_base (810)..(810): a, c, t, g, unknown or other
  misc_feature (810)..(810): n is a, c, g, or t
  modified_base (817)..(817): a, c, t, g, unknown or other
  misc_feature (817)..(817): n is a, c, g, or t
  modified_base (834)..(834): a, c, t, g, unknown or other
  misc_feature (834)..(834): n is a, c, g, or t
  modified_base (840)..(840): a, c, t, g, unknown or other
  misc_feature (840)..(840): n is a, c, g, or t
tcagtcgtcgctcgcacgaccggtgctcgatttagtacgtcatcagggaaagggctggagtgggttgccgtattggaagcaaaactaacaattacgcgacaacatatgctgcgtcggtgaaaggcaggttcaccatctccagagatgtattacgaaaagaaccgacggtcgttaactcgttagacctaaagtgaacgtcgaacgtacccgtaacggaaaaacccggnggtaacccgaccggttaccgttactttaacgttaccgttaggtcgtaaccgtaaccgttaccgttagggttaccggtcccgtttccggtaccccggtaagtttcggttaacggtaaaccggtttcccccgggaccccggggttaccgggggaaccccgggtaaacccttcgggttaaccccgtacccggtttcccgtaccccgtaccgggtcccctaacccggaacccggttaaacggccccttacggttttacccccggttccccgtttacccccccggnggtacccccggttcccgttacggcccgttaccgaacggggcctaccccggtacccgtaaccggaccgtcgtaccccgaacgtaccgggcccgtaacctcggggttaccggacctttaccgggcctttaaccgggtaacgaaccccgtttacccgtttaacccctttccccgtaggttccgtacggttagggccgggtcggcggtacggacggacgtacggtacgtacgacgtcgtcagtgcgtcgcgcgtaaaacgcgtacgtancggtactaccgtagccgttagcgtacgcgtcgcgagntagctgntcgagatgcgtacgcanctcgtnacg

SEQ ID NO: 109902 - DNA, 587 bp, Homo sapiens
  misc_feature: GYAE6OF01BNTFY.21.60.F05.1.454.CMB.1.raw
  modified_base (120)..(120): a, c, t, g, unknown or other
  misc_feature (120)..(120): n is a, c, g, or t
  modified_base (200)..(200): a, c, t, g, unknown or other
  misc_feature (200)..(200): n is a, c, g, or t
  modified_base (389)..(389): a, c, t, g, unknown or other
  misc_feature (389)..(389): n is a, c, g, or t
  modified_base (545)..(548): a, c, t, g, unknown or other
  misc_feature (545)..(548): n is a, c, g, or t
  modified_base (550)..(558): a, c, t, g, unknown or other
  misc_feature (550)..(558): n is a, c, g, or t
  modified_base (560)..(587): a, c, t, g, unknown or other
  misc_feature (560)..(587): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtnaaaggcaggttcaccatctccagagatgattcaaaagacacggctatctgacaaagtgagcacgcctaagaaaaaccggnggaccacgggtccgtcttattactggtcgtactaagaccttaggtcggccttcggtaccgacgtttggttacgaaacggtttcccggaccccggtggggggacccggggtaacctgggttaccaccgttcctccggtccggccctaccaccggtaacgggcccctaaggttccccggttcctcccccgnggcccgtcccctggaaccctcggaacggcgtacccaccgtcggaacgcgtacaacgcggcccggtcctgggccctggaccctaggtacgaacgtacctccgttcccgtacgtcttacgacgtggtaacggcggtcgtggacgacggcgacgagtannnngnnnnnnnnngnnnnnnnnnnnnnnnnnnnnnnnnnnnn

SEQ ID NO: 109903 - DNA, 535 bp, Homo sapiens
  misc_feature: GYAE6OF01C4PKZ.21.60.F05.1.454.CMB.1.raw
  modified_base (164)..(164): a, c, t, g, unknown or other
  misc_feature (164)..(164): n is a, c, g, or t
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
  modified_base (218)..(218): a, c, t, g, unknown or other
  misc_feature (218)..(218): n is a, c, g, or t
  modified_base (293)..(293): a, c, t, g, unknown or other
  misc_feature (293)..(293): n is a, c, g, or t
  modified_base (314)..(314): a, c, t, g, unknown or other
  misc_feature (314)..(314): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (353)..(353): a, c, t, g, unknown or other
  misc_feature (353)..(353): n is a, c, g, or t
  modified_base (487)..(488): a, c, t, g, unknown or other
  misc_feature (487)..(488): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
  modified_base (503)..(510): a, c, t, g, unknown or other
  misc_feature (503)..(510): n is a, c, g, or t
  modified_base (512)..(518): a, c, t, g, unknown or other
  misc_feature (512)..(518): n is a, c, g, or t
  modified_base (520)..(520): a, c, t, g, unknown or other
  misc_feature (520)..(520): n is a, c, g, or t
  modified_base (522)..(535): a, c, t, g, unknown or other
  misc_feature (522)..(535): n is a, c, g, or t
tcagtcgtcgctcgcacgaccggtgctcgatttagtacgtcatcagggaaagggctggagtgggtggccgtattggaagcaaaactaacaattacgcgacaacatatgctgcggtcggtgaaaggcaggttcaccatctccagagatgattcaaagaacacggngtatctagacaaatgagcagcctaagaaaccgnggacgacggccgtntattacngtgctacgacgtgcgctacgtccgagtgtgaacgttccggcccggtgggggaccggacctcggtcaccgtctccncggccctccaccgaacggccnctccgtcctttccccgnggccncctnccgtcgacggacnccaccgtcgagacgaccacgtacggccggtccgtcggggtactcgtaccggtcggtacaacggtacctttaccgttccctacgttcctacgtaccgtaggccgggcgtcggacggtacgaacgcgtacagtagnnacngtgntgcatcgnnnnnnnntnnnnnnngngnnnnnnnnnnnnnn

SEQ ID NO: 109904 - DNA, 626 bp, Homo sapiens
  misc_feature: GYAE6OF01AQ4DJ.21.60.F05.1.454.CMB.1.raw
  modified_base (181)..(181): a, c, t, g, unknown or other
  misc_feature (181)..(181): n is a, c, g, or t
  modified_base (199)..(199): a, c, t, g, unknown or other
  misc_feature (199)..(199): n is a, c, g, or t
  modified_base (328)..(328): a, c, t, g, unknown or other
  misc_feature (328)..(328): n is a, c, g, or t
  modified_base (395)..(395): a, c, t, g, unknown or other
  misc_feature (395)..(395): n is a, c, g, or t
  modified_base (422)..(422): a, c, t, g, unknown or other
  misc_feature (422)..(422): n is a, c, g, or t
  modified_base (582)..(582): a, c, t, g, unknown or other
  misc_feature (582)..(582): n is a, c, g, or t
  modified_base (585)..(585): a, c, t, g, unknown or other
  misc_feature (585)..(585): n is a, c, g, or t
  modified_base (588)..(588): a, c, t, g, unknown or other
  misc_feature (588)..(588): n is a, c, g, or t
  modified_base (592)..(592): a, c, t, g, unknown or other
  misc_feature (592)..(592): n is a, c, g, or t
  modified_base (595)..(601): a, c, t, g, unknown or other
  misc_feature (595)..(601): n is a, c, g, or t
  modified_base (603)..(626): a, c, t, g, unknown or other
  misc_feature (603)..(626): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggctatcctgccaaaatgancacgcctacgaaaaccgnggaccgaccggtccgtactattacgtgtcgactaggacctaggtcggtcctcgtccgacgttgggttagaaccgtttccgggccccggtcggggggaccccggggaacctcggtaccgaccccggtccnccgttaccggccctccgaaccgaacggggcccctagttccccggtccccttacccccgcgggccccncccgttagccctacccggaagggtccncccgtaaccccgtcgacggccgaccgtaacgcggtcccggacccgtggggtctacggccggttcgaccgaacggttacccgtaccgttcccggcggtaccggaaccggcgttacggaccgggtccggggctaccggggcgttaaacggcccagtaacgtnccngcntagnctnnnnnnngnnnnnnnnnnnnnnnnnnnnnnnn

SEQ ID NO: 109905 - DNA, 428 bp, Homo sapiens
  misc_feature: GYAE6OF02FYLJ9.21.60.F05.1.454.CMB.1.raw
  modified_base (424)..(428): a, c, t, g, unknown or other
  misc_feature (424)..(428): n is a, c, g, or t
tcagtcgtcgctcgcacgaccggtgctcgatttagtacgtcatcagggaaagggctggagtgggttggccgtattggaagcaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaagggcccatcggtcttccccctggcgccctgctccaggagcacctccgagagcacagcggccctgggctgcctggtcaaggctactccctcgtctctactgagcgggctggcaaggcgcatagnnnnn

SEQ ID NO: 109906 - DNA, 430 bp, Homo sapiens
  misc_feature: GYAE6OF02HMJ51.21.60.F05.1.454.CMB.1.raw
  modified_base (425)..(430): a, c, t, g, unknown or other
  misc_feature (425)..(430): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccgggaaccctggtcaccgtctcctcggcctccaccaagggcccatcggtcttccccctggcgccctgctccaggagcacctccgagagcacagcggccctgggctgcctggtcaaggctacttccctcgtctctactgagcgggctggcaaggcgcatagnnnnnn

SEQ ID NO: 109907 - DNA, 431 bp, Homo sapiens
  misc_feature: GYAE6OF02G7ZK3.21.60.F05.1.454.CMB.1.raw
  modified_base (425)..(431): a, c, t, g, unknown or other
  misc_feature (425)..(431): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaagggcccatcggtcttccccctggcgccctgctccaggagcacctccgagagcacagcggccctgggctgcctggtcaaggctactccctcgtctctactgagcgggctggcaaggcgcatagnnnnnnn

SEQ ID NO: 109908 - DNA, 430 bp, Homo sapiens
  misc_feature: GYAE6OF02HMWTU.21.60.F05.1.454.CMB.1.raw
  modified_base (339)..(339): a, c, t, g, unknown or other
  misc_feature (339)..(339): n is a, c, g, or t
  modified_base (425)..(430): a, c, t, g, unknown or other
  misc_feature (425)..(430): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccaagggcccatcggtctcccctggcgccctgctccaggngcacctccgagagcacagcggccctgggctgcctggtcaaggactactcccgagcgacgactgagcgggctggcaaggcgcatagnnnnnn

SEQ ID NO: 109909 - DNA, 431 bp, Homo sapiens
  misc_feature: GYAE6OF02HAGXW.21.60.F05.1.454.CMB.1.raw
  modified_base (193)..(193): a, c, t, g, unknown or other
  misc_feature (193)..(193): n is a, c, g, or t
  modified_base (424)..(431): a, c, t, g, unknown or other
  misc_feature (424)..(431): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaatgagcagcctgaaaaccgnggacacggccgtctattactgtgctagacctagtggctcgtccgactggttgaagttcgacccctggggccggggaaccctggtcaccgtctcctcggcctccaccaagggcccatcggtcttccccctggcgccctgctccaggagcacctccgagagcacagcggccctgggctgcctggtcaaggctactcccgagcgacgactgagcgggctggcaaggcgcatagnnnnnnnn

SEQ ID NO: 109910 - DNA, 433 bp, Homo sapiens
  misc_feature: GYAE6OF02HW78G.21.60.F05.1.454.CMB.1.raw
  modified_base (428)..(433): a, c, t, g, unknown or other
  misc_feature (428)..(433): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccaagggcccatcggtcttccccctggcgccctgctccaggagcacctccgagagcacagcggccctgggctgcctggtcaaggactacttcccgagcgacgactgagcgggctggcaaggcgcatagnnnnnn

SEQ ID NO: 109911 - DNA, 434 bp, Homo sapiens
  misc_feature: GYAE6OF02IHQNY.21.60.F05.1.454.CMB.1.raw
  modified_base (339)..(339): a, c, t, g, unknown or other
  misc_feature (339)..(339): n is a, c, g, or t
  modified_base (427)..(434): a, c, t, g, unknown or other
  misc_feature (427)..(434): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgacttgttgaagttcgacccctggggccggggaaccctggtcaccgtctcctcggcctccaccaagggcccatcggtcttcccctggcgccctgctccaggngcacctccgagacgcacagcagcccctgggctgcctggtcaaggctacttccctcgtctctactgagcgggctggcaaggcgcatagnnnnnnnn

SEQ ID NO: 109912 - DNA, 508 bp, Homo sapiens
  misc_feature: GYAE6OF02HRX6G.21.60.F05.1.454.CMB.1.raw
  modified_base (210)..(210): a, c, t, g, unknown or other
  misc_feature (210)..(210): n is a, c, g, or t
  modified_base (347)..(347): a, c, t, g, unknown or other
  misc_feature (347)..(347): n is a, c, g, or t
  modified_base (464)..(464): a, c, t, g, unknown or other
  misc_feature (464)..(464): n is a, c, g, or t
  modified_base (470)..(508): a, c, t, g, unknown or other
  misc_feature (470)..(508): n is a, c, g, or t
tcagtcgtcgctcgcacgaccggtgctcgatttagtacgtcatcagggaaaggggtcgtggacgtgggttggccgtacttggaagcgaaaacttaacaattacggcgacaactatatgcctgcgtcggtgaaagggcaggttccaccatctcccagacgatgatttcaaagaacacggcgtatctgcaaatgagcaggcctgaaaaccgnggacacggccgtctattactagtgcgtagacctagtggctcgtccgactggttgaagttcgacccctggggccgggaacccttggtccaccgtctccgtcggcctccaccgaagggccccatcggtcttccccccgnggggaccgcccctggcctccgagggaggccacctccgagacgccacaggccggccctgggctgcctggtacaaggcctacttcccgaagccgacgctgagcgggctggcaagggccncatagnnnnnnnnnnnnnnnnnnnnnnnnnnnnnnnnnnnnnnn

SEQ ID NO: 109913 - DNA, 459 bp, Homo sapiens
  misc_feature: GYAE6OF02IL4T5.21.60.F05.1.454.CMB.1.raw
  modified_base (196)..(196): a, c, t, g, unknown or other
  misc_feature (196)..(196): n is a, c, g, or t
  modified_base (344)..(344): a, c, t, g, unknown or other
  misc_feature (344)..(344): n is a, c, g, or t
  modified_base (361)..(361): a, c, t, g, unknown or other
  misc_feature (361)..(361): n is a, c, g, or t
  modified_base (431)..(459): a, c, t, g, unknown or other
  misc_feature (431)..(459): n is a, c, g, or t
tcagtcgtcgctcgcacgaccggtgctcgatttagtacgtcatcagggaaaggggctggagtgggttggccgtattggaagcaaaactaacaattacgcgacaacatatgctgcgtcgggtgaaaggcaggttcaccatctccagagatgattcaaagaacacggcgtatctgcaaatgagcagcctgaaaaccgnggacacggccgtctattactgtgctagacctagtggcctcgtccgactggttgaagttcgaccccgtgggggcccggggaacctggtcaccgtctcctcggcctccaccaagggcccatcggtcttcccctggcgccctgctccaggngcacctccgagagcacngccgcctgggctgcctggtcaaggactacttccctcgtctctactgacgcgggctggcaaggcgcatagnnnnnnnnnnnnnnnnnnnnnnnnnnnnn

SEQ ID NO: 109914 - DNA, 442 bp, Homo sapiens
  misc_feature: GYAE6OF02H5RYJ.21.60.F05.1.454.CMB.1.raw
  modified_base (428)..(442): a, c, t, g, unknown or other
  misc_feature (428)..(442): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttgaccccctgggggccgggggaaccctggtcaccgtctcctcggcctccaccaagggccccatcggtcttccccctgcgccctgctccagagcacctccgagagcacagcggccctgggctgcctggtcaaaggactactccctcgtctctactgagcgggctggcaaggcgcatagnnnnnnnnnnnnnnn

SEQ ID NO: 109915 - DNA, 433 bp, Homo sapiens
  misc_feature: GYAE6OF02HOBIM.21.60.F05.1.454.CMB.1.raw
  modified_base (427)..(433): a, c, t, g, unknown or other
  misc_feature (427)..(433): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaagggcccatcggtcttccccctggcgccctgctccaggagcacctccgagagcacagcggccctggggctgcctggtcaaggctacttccctcgtctctactgagcgggctggcaaggcgcatagnnnnnnn

SEQ ID NO: 109916 - DNA, 435 bp, Homo sapiens
  misc_feature: GYAE6OF02GSY5U.21.60.F05.1.454.CMB.1.raw
  modified_base (429)..(435): a, c, t, g, unknown or other
  misc_feature (429)..(435): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccaagggcccatcggtcttccccctggccgccctgcctccaggacgcacctccgagagcacagcggccctgggctgcctggtcaaggctactccctcgtctctactgagcgggctggcaaggcgcatagnnnnnnn

SEQ ID NO: 109917 - DNA, 432 bp, Homo sapiens
  misc_feature: GYAE6OF02JUL7A.21.60.F05.1.454.CMB.1.raw
  modified_base (194)..(194): a, c, t, g, unknown or other
  misc_feature (194)..(194): n is a, c, g, or t
  modified_base (214)..(214): a, c, t, g, unknown or other
  misc_feature (214)..(214): n is a, c, g, or t
  modified_base (387)..(387): a, c, t, g, unknown or other
  misc_feature (387)..(387): n is a, c, g, or t
  modified_base (418)..(432): a, c, t, g, unknown or other
  misc_feature (418)..(432): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattacngtgctagacctagtggctcgtccgactggttgaagttcgacccctggggcccgggaacctggtcaccgtctcctcggcctccacaggcccatcggtctcccctggcgccctgcctccaggcgcacctccgagagcacagcggccctgggctgcctggtcaaggctacttcccngtctctactgagcggctggcaaggcgcatgnnnnnnnnnnnnnnn

SEQ ID NO: 109918 - DNA, 431 bp, Homo sapiens
  misc_feature: GYAE6OF02G76SB.21.60.F05.1.454.CMB.1.raw
  modified_base (427)..(431): a, c, t, g, unknown or other
  misc_feature (427)..(431): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccaagggcccatcggtcttccccctggcgccctgctccaggagcacctccgagagcacagcggccctgggctgcctggtcaaggctacttccctcgtctctactgagcgggctggcaaggcgcatagnnnnn

SEQ ID NO: 109919 - DNA, 431 bp, Homo sapiens
  misc_feature: GYAE6OF02F4KA9.21.60.F05.1.454.CMB.1.raw
  modified_base (427)..(431): a, c, t, g, unknown or other
  misc_feature (427)..(431): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaagggcccatcggtcttccccctggcgccctgcctccaggagcacctccgagagcacagcggccctgggctgcctggtcaaggctacttccctcgtctctactgagcgggctggcaaggcgcatagnnnnn

SEQ ID NO: 109920 - DNA, 440 bp, Homo sapiens
  misc_feature: GYAE6OF02IJW0E.21.60.F05.1.454.CMB.1.raw
  modified_base (341)..(341): a, c, t, g, unknown or other
  misc_feature (341)..(341): n is a, c, g, or t
  modified_base (426)..(440): a, c, t, g, unknown or other
  misc_feature (426)..(440): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccacaagggcccatcggtcttccccctggccgccctgctccaggancacctccgagagcacagcggccctgggctgcctggtcaaggctacttccctcgtctctactgagcgggctggcaaggcgcatagnnnnnnnnnnnnnnn

SEQ ID NO: 109921 - DNA, 459 bp, Homo sapiens
  misc_feature: GYAE6OF02FE0MS.21.60.F05.1.454.CMB.1.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (453)..(459): a, c, t, g, unknown or other
  misc_feature (453)..(459): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgacaaatgagcagcctagaaaaccgnggacacggccgtntattactgtgctagacctagtggctcgtccgattggttgaacgttccgaccccgtgggggcccggggaaccctggtccaccgtctcctcggcctccaccaagggccccatccggtccttcccccgtggccgcccctgcctcccaggacgccacctcgagacgcacagccggccctggggctgcctggtcaacggtctaccttccctgttcctctactgacgcgggctggcaaggccgcatacgnnnnnnn

SEQ ID NO: 109922 - DNA, 438 bp, Homo sapiens
  misc_feature: GYAE6OF02G669O.21.60.F05.1.454.CMB.1.raw
  modified_base (325)..(325): a, c, t, g, unknown or other
  misc_feature (325)..(325): n is a, c, g, or t
  modified_base (426)..(438): a, c, t, g, unknown or other
  misc_feature (426)..(438): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaacctggtcaccgtctcctcggcctccaccaagggcccatcggtctcccctggccnccctgctccaggacgcacctcgagagcacgagccggccctgggctgcctggtcaaggctacttccctcgtctctactgagcgggctggcaaggcgcatagnnnnnnnnnnnnn

SEQ ID NO: 109923 - DNA, 455 bp, Homo sapiens
  misc_feature: GYAE6OF02I6QBV.21.60.F05.1.454.CMB.1.raw
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
  modified_base (327)..(328): a, c, t, g, unknown or other
  misc_feature (327)..(328): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (432)..(455): a, c, t, g, unknown or other
  misc_feature (432)..(455): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaacctggtcaccgtctcctcggcctccaccaaggcccatcggtctccccgngccnccnncncagcncacncgagcncacgcgccgccgtggctcgccgtgtacgaaggacctacttccctcgtctctacgtgacggcggtctcggacgacggcgacagtacgnnnnnnnnnnnnnnnnnnnnnnnn

SEQ ID NO: 109924 - DNA, 433 bp, Homo sapiens
  misc_feature: GYAE6OF02FGVDO.21.60.F05.1.454.CMB.1.raw
  modified_base (194)..(194): a, c, t, g, unknown or other
  misc_feature (194)..(194): n is a, c, g, or t
  modified_base (427)..(433): a, c, t, g, unknown or other
  misc_feature (427)..(433): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgacccctggggccggggaaccctggtcaccgtctcctcggcctccaccaagggcccatcggtcttccccctggccgccctgctccaggagcacctccgagagcacagcggccctgggctgcctggtcaaggctacttcccgagcgacgactgagcgggctggcaaggcgcatagnnnnnnn

SEQ ID NO: 109925 - DNA, 461 bp, Homo sapiens
  misc_feature: GYAE6OF02GEZ2X.21.60.F05.1.454.CMB.1.raw
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (446)..(461): a, c, t, g, unknown or other
  misc_feature (446)..(461): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcatccgactggttgaagttcgacccctgggggcccggggaaccctggtcaccgtctcctcggcctccaccaagggcccatcggtcttccccctggccgccctgctccaggancacctccgagcncacncgccgccgtggctcgcgtcgacgaacggtaccttaccttccctcgtctctacgtgacggcggtcgtcggacgaggccgacagtagnnnnnnnnnnnnnnnn

SEQ ID NO: 109926 - DNA, 436 bp, Homo sapiens
  misc_feature: GYAE6OF02JDGGV.21.60.F05.1.454.CMB.1.raw
  modified_base (429)..(436): a, c, t, g, unknown or other
  misc_feature (429)..(436): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaagggcccatcggtcttccccctggcgccctgctccaggagcacctccgagagcacagcggccctggggctgcctggtcaaggactacgttccctcgtctctactgagcgggctggcaaggcgcatagnnnnnnnn

SEQ ID NO: 109927 - DNA, 432 bp, Homo sapiens
  misc_feature: GYAE6OF02FK7SO.21.60.F05.1.454.CMB.1.raw
  modified_base (428)..(432): a, c, t, g, unknown or other
  misc_feature (428)..(432): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttccgacccctgggggccggggaaccctggtcaccgtctcctcggcctccaccaagggcccatcggtcttccccctggcgccctgctccaggagcacctccgagagcacagcggccctgggctgcctggtcaaggctacttccctcgtctctactgagcgggctggcaaggcgcatagnnnnn

SEQ ID NO: 109928 - DNA, 429 bp, Homo sapiens
  misc_feature: GYAE6OF02F5Z7L.21.60.F05.1.454.CMB.1.raw
  modified_base (426)..(429): a, c, t, g, unknown or other
  misc_feature (426)..(429): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccaagggcccatcggtcttccccctggcgccctgctccaggagcacctccgagagcacagcggccctgggctgcctggtcaaggctacttccctcgtctctactgagcgggctggcaggcgcatagnnnn

SEQ ID NO: 109929 - DNA, 433 bp, Homo sapiens
  misc_feature: GYAE6OF02HZNRT.21.60.F05.1.454.CMB.1.raw
  modified_base (338)..(338): a, c, t, g, unknown or other
  misc_feature (338)..(338): n is a, c, g, or t
  modified_base (425)..(433): a, c, t, g, unknown or other
  misc_feature (425)..(433): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccaagggcccatcggtctcccctggcgcctgctccaggncacctccgagagcacagcggccctgggctgcctggtcaaggactacttccctcgtctctactgacgcgggctggcaaggcgcatagnnnnnnnnn

SEQ ID NO: 109930 - DNA, 445 bp, Homo sapiens
  misc_feature: GYAE6OF02GRUIB.21.60.F05.1.454.CMB.1.raw
  modified_base (426)..(426): a, c, t, g, unknown or other
  misc_feature (426)..(426): n is a, c, g, or t
  modified_base (432)..(445): a, c, t, g, unknown or other
  misc_feature (432)..(445): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccgggaaccctggtcaccgtctcctcggcctccaccaagggcccatcggtccttccccctggccgccctgcctccaggacgcacctccgagagcacagcgccctgggctgcctggtcaaggactacttccctcgtcctctactgacgcgggctggcaaggcncatagnnnnnnnnnnnnnn

SEQ ID NO: 109931 - DNA, 450 bp, Homo sapiens
  misc_feature: GYAE6OF02HFMPJ.21.60.F05.1.454.CMB.1.raw
  modified_base (196)..(196): a, c, t, g, unknown or other
  misc_feature (196)..(196): n is a, c, g, or t
  modified_base (323)..(323): a, c, t, g, unknown or other
  misc_feature (323)..(323): n is a, c, g, or t
  modified_base (437)..(450): a, c, t, g, unknown or other
  misc_feature (437)..(450): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaaccgnggacacggccgtctattactgtgctagacctagtggctcgtccgactggttgaagttcgacccctgggggcccggggaacctggtcaccgtctcctcggcctccacaagggcccatcggtctccccnggccgccctgctccaggcgcacctccgagagcacagccgccctgggctgcctggtacaaaggacctacttcccctacgtctactactgagcgggctgggcaagggcgacatagnnnnnnnnnnnnnn

SEQ ID NO: 109932 - DNA, 427 bp, Homo sapiens
  misc_feature: GYAE6OF02F0KJK.21.60.F05.1.454.CMB.1.raw
  modified_base (425)..(427): a, c, t, g, unknown or other
  misc_feature (425)..(427): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaagggcccatcggtcttccccctggcgccctgctccaggagcacctccgagagcacagcggccctgggctgcctggtcaaggactacttccctcgtctctactgagcggctggcaggcgcatagnnn

SEQ ID NO: 109933 - DNA, 446 bp, Homo sapiens
  misc_feature: GYAE6OF02ICZQT.21.60.F05.1.454.CMB.1.raw
  modified_base (193)..(193): a, c, t, g, unknown or other
  misc_feature (193)..(193): n is a, c, g, or t
  modified_base (428)..(428): a, c, t, g, unknown or other
  misc_feature (428)..(428): n is a, c, g, or t
  modified_base (433)..(446): a, c, t, g, unknown or other
  misc_feature (433)..(446): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaggcaggttcaccatctccagagatgattcaaagaacacggcgtatctgcaaatgagcagcctgaaaaccgnggacacggccgtctattactgtgctagacctagtggctcgtccgactggttgagttcgacccccgtgggggcccggggaaccctggtcacccgtctccctcggcctccaccaagggcccatccggtcttccccctggccgcccctgctccaggagccacctccgagagcacagcggccctgggctgcctgcaaggactacttccctcgtctctactcgagcgggctggcaaggcnatagnnnnnnnnnnnnnn

SEQ ID NO: 109934 - DNA, 458 bp, Homo sapiens
  misc_feature: GYAE6OF02HZZNW.21.60.F05.1.454.CMB.1.raw
  modified_base (352)..(352): a, c, t, g, unknown or other
  misc_feature (352)..(352): n is a, c, g, or t
  modified_base (441)..(441): a, c, t, g, unknown or other
  misc_feature (441)..(441): n is a, c, g, or t
  modified_base (446)..(458): a, c, t, g, unknown or other
  misc_feature (446)..(458): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaccgaggacacggccgtgtattattgtggtagacaaaagagtggatgtggtggtagctgtgaccatgatgctcttgatatctgggggccaggggacaatggtcaccgtctcttcagcctccaccaaggcccatcggtcttccccctggcgccctgcctccaggngcacctccgagagcacacgccggcccgtgggctcgcctgggtcaagggccttacttcccgtgtctctactgacgcgggctggacaggcncatgnnnnnnnnnnnnn

SEQ ID NO: 109935 - DNA, 608 bp, Homo sapiens
  misc_feature: GYAE6OF02JGQWQ.21.60.F05.1.454.CMB.1.raw
  modified_base (196)..(196): a, c, t, g, unknown or other
  misc_feature (196)..(196): n is a, c, g, or t
  modified_base (326)..(326): a, c, t, g, unknown or other
  misc_feature (326)..(326): n is a, c, g, or t
  modified_base (348)..(348): a, c, t, g, unknown or other
  misc_feature (348)..(348): n is a, c, g, or t
  modified_base (487)..(487): a, c, t, g, unknown or other
  misc_feature (487)..(487): n is a, c, g, or t
  modified_base (495)..(495): a, c, t, g, unknown or other
  misc_feature (495)..(495): n is a, c, g, or t
tcagtcgtcgctcgcacgaccggtgctcgatttagtacgtcatcagggaaagggctggagtgggttggccgtattgggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagaccttagtcgctcgtccgacgtggttgaacgttccgacccgtggggccgggaaccctggtccaccgtctcctcgcctccacaaggccatcggtccttccccgnggccgccctgcctccgaggacnccacctccgagacgcacgagccggccctgggcctcgccgttggtaccgaaacgggtaccttaccgttcccgtcgtaccttccgtaacgtggacggccgggtaccttgggaccgaaacgggtcccgacgtaagttacggngtacgcgngcgtgtgtcgtcgcgacgacgacgcgcgtcgcgtcgacgacgacgcgcgtccgtcgcgtcgtcgtaccgtccgtccgtccgtcgtacgtacgtacgacgtacgtacgacgacg

SEQ ID NO: 109936 - DNA, 443 bp, Homo sapiens
  misc_feature: GYAE6OF02F5SU7.21.60.F05.1.454.CMB.1.raw
  modified_base (194)..(194): a, c, t, g, unknown or other
  misc_feature (194)..(194): n is a, c, g, or t
  modified_base (437)..(443): a, c, t, g, unknown or other
  misc_feature (437)..(443): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttccgaccccgtgggggcccggggaaccctggtcaccgtctcctcggcctccaccaagggcccatcggtccttccccctggccgcccctgcctccaggacgccaccctccgagagcacagccggccctgggctgcctggtcaaggctacttccctcgtctctactgagcgggctggcaggcgcatagnnnnnnn

SEQ ID NO: 109937 - DNA, 438 bp, Homo sapiens
  misc_feature: GYAE6OF02IERZ1.21.60.F05.1.454.CMB.1.raw
  modified_base (343)..(343): a, c, t, g, unknown or other
  misc_feature (343)..(343): n is a, c, g, or t
  modified_base (430)..(438): a, c, t, g, unknown or other
  misc_feature (430)..(438): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccaagggcccatcggtctcccccctggccgccctgcctccaggngcacctccgagagcacagcggccctggggctgcctggtcaaggactactcccgagcgacgactgagcgggctggcaaggcgcatagnnnnnnnnn

SEQ ID NO: 109938 - DNA, 431 bp, Homo sapiens
  misc_feature: GYAE6OF02F39TX.21.60.F05.1.454.CMB.1.raw
  modified_base (342)..(342): a, c, t, g, unknown or other
  misc_feature (342)..(342): n is a, c, g, or t
  modified_base (426)..(431): a, c, t, g, unknown or other
  misc_feature (426)..(431): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccaagggcccatcggtcttccccctggcgccctgctccaggancacctccgagagcacagcggccctgggctgcctggtcaaggctacttccctcgtctctactgagcggctggcaaggcgcatagnnnnnn

SEQ ID NO: 109939 - DNA, 440 bp, Homo sapiens
  misc_feature: GYAE6OF02G0S37.21.60.F05.1.454.CMB.1.raw
  modified_base (355)..(355): a, c, t, g, unknown or other
  misc_feature (355)..(355): n is a, c, g, or t
  modified_base (429)..(440): a, c, t, g, unknown or other
  misc_feature (429)..(440): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaagggcccatcggtcttccccctggccgcccctgcctccaggagcacctccgagngcacagcggccctgggctgcctggtcaaggctacttccctcgtctctactgagcgggctggcaaggcgcatagnnnnnnnnnnnn

SEQ ID NO: 109940 - DNA, 431 bp, Homo sapiens
  misc_feature: GYAE6OF02I0SVG.21.60.F05.1.454.CMB.1.raw
  modified_base (425)..(431): a, c, t, g, unknown or other
  misc_feature (425)..(431): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaagggcccatcggtcttccccctggcgccctgctccaggagcacctccgagagcacagcggccctgggctgcctggtcaaggactactccctcgtctctactgagcgggctggcaggcgcatagnnnnnnn

SEQ ID NO: 109941 - DNA, 433 bp, Homo sapiens
  misc_feature: GYAE6OF02GDHL2.21.60.F05.1.454.CMB.1.raw
  modified_base (429)..(433): a, c, t, g, unknown or other
  misc_feature (429)..(433): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccgtggaaccctggtcaccgtctcctcggcctccaccaagggcccatcggtcttccccctggcgcccctgctccaggacgcacctccgagagcacagcggccctgggctgcctggtcaaggactacttccctcgtctctactgagcgggctggcaaggcgcatagnnnnn

SEQ ID NO: 109942 - DNA, 436 bp, Homo sapiens
  misc_feature: GYAE6OF02I7DD6.21.60.F05.1.454.CMB.1.raw
  modified_base (214)..(214): a, c, t, g, unknown or other
  misc_feature (214)..(214): n is a, c, g, or t
  modified_base (393)..(393): a, c, t, g, unknown or other
  misc_feature (393)..(393): n is a, c, g, or t
  modified_base (421)..(421): a, c, t, g, unknown or other
  misc_feature (421)..(421): n is a, c, g, or t
  modified_base (427)..(436): a, c, t, g, unknown or other
  misc_feature (427)..(436): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattacngtgctagacctagtggctcgtccgactggttgaagttcgacccctggggccggggaaccctggtcaccgtctcctcggcctccaccaagggcccatcggtcttccccctggcgccctgctccaggagcacctccgagagcacagcggccctgggctgcctggtcaaggactacttcccncgtctctactgagcgggctggcaaggcncatagnnnnnnnnnn

SEQ ID NO: 109943 - DNA, 433 bp, Homo sapiens
  misc_feature: GYAE6OF02FH85L.21.60.F05.1.454.CMB.1.raw
  modified_base (193)..(193): a, c, t, g, unknown or other
  misc_feature (193)..(193): n is a, c, g, or t
  modified_base (425)..(433): a, c, t, g, unknown or other
  misc_feature (425)..(433): n is a, c, g, or t
tcagtcgtcgctcgcacgaccggtgctcgatttagtacgtcatcagggaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgatggttgaagttcgacccctgggggccggggaaccctggtcaccgtctcctcggcctccaccaagggcccatcggcttccccctggcgccctgctccaggagcacctccgagagcacagcggccctgggctgcctggtcaaggacacttcccgagccgacgactgagcgggctggcaaggcgcatagnnnnnnnnn

SEQ ID NO: 109944 - DNA, 435 bp, Homo sapiens
  misc_feature: GYAE6OF02IYHQG.21.60.F05.1.454.CMB.1.raw
  modified_base (342)..(342): a, c, t, g, unknown or other
  misc_feature (342)..(342): n is a, c, g, or t
  modified_base (426)..(435): a, c, t, g, unknown or other
  misc_feature (426)..(435): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccaagggcccatcggtcttccccctggcgccctgctccaggancacctccgagagcacagcgccctgggctgcctggtcaaggctacttccctcgtctctactgagcgggctggcaaggcgcatagnnnnnnnnnn

SEQ ID NO: 109945 - DNA, 437 bp, Homo sapiens
  misc_feature: GYAE6OF02GZOFN.21.60.F05.1.454.CMB.1.raw
  modified_base (430)..(437): a, c, t, g, unknown or other
  misc_feature (430)..(437): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccagggcccatcggtcttccccctggcgccctcgctccaggacgcacctccgagacgcacagccggcccgtgggctgcctggtcaaggactacttccctcgtctctactgagcgggctggcaaggcgcatgnnnnnnnn

SEQ ID NO: 109946 - DNA, 441 bp, Homo sapiens
  misc_feature: GYAE6OF02HG5K7.21.60.F05.1.454.CMB.1.raw
  modified_base (430)..(441): a, c, t, g, unknown or other
  misc_feature (430)..(441): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaagggcccatccggtcttccccctggccgcccctgcctccaggagccacctccgagagcacagcggccctgggctgcctggtcaaggctactcctcgtctctactgagcgggctggcaaggcgcatacgnnnnnnnnnnnn

SEQ ID NO: 109947 - DNA, 430 bp, Homo sapiens
  misc_feature: GYAE6OF02IOMDH.21.60.F05.1.454.CMB.1.raw
  modified_base (424)..(430): a, c, t, g, unknown or other
  misc_feature (424)..(430): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaagggcccatcggtctccccctggcgcctgctccaggagcacctccgagagcacagcggccctggggctgcctggtcaaggactacttcccgagcgacgactgagcgggctggcaggcgcatgnnnnnnn

SEQ ID NO: 109948 - DNA, 594 bp, Homo sapiens
  misc_feature: GYAE6OF02JZ0RP.21.60.F05.1.454.CMB.1.raw
  modified_base (236)..(236): a, c, t, g, unknown or other
  misc_feature (236)..(236): n is a, c, g, or t
  modified_base (561)..(561): a, c, t, g, unknown or other
  misc_feature (561)..(561): n is a, c, g, or t
  modified_base (564)..(594): a, c, t, g, unknown or other
  misc_feature (564)..(594): n is a, c, g, or t
tcagtcgtcgctcgcacgaccggtgctcgatttagtacgtcatcagggaaagggacgtggagtgggttggccgtattggaagcaaaactaacaattacgcgacaacatatgctgcgtcggtgaaaggcgaggttcaccatctccagagatgattcaaagaacacggcgtatctgcaaatgagcagcctagaaaaccgaggacacgtccgtctattactgtgctagacctagtcggntcgtccgatgggttgaaggttccgaccccctggggggcccggggaaccctgggtccaccggtcctccgtcggccctccgaaccgtaacggggcccccacgttccgttcccgtttccccccccgggggtccccgtccccgtggccccttacccgacggggtaccggcccaaccccgttcccggaaacggtcggccaaccgacggccccgggccccctgggggccctcggtccctgggtaccgaaacgggaccttacctttccccgtcgtccttacctaccgttggacggccgggtcgttcgggcaacgggtccgacgtacctaggnacnnnnnnnnnnnnnnnnnnnnnnnnnnnnnnn

SEQ ID NO: 109949 - DNA, 436 bp, Homo sapiens
  misc_feature: GYAE6OF02GLC79.21.60.F05.1.454.CMB.1.raw
  modified_base (194)..(194): a, c, t, g, unknown or other
  misc_feature (194)..(194): n is a, c, g, or t
  modified_base (429)..(436): a, c, t, g, unknown or other
  misc_feature (429)..(436): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgacccctgggggccgggaaccctggtcaccgtctcctcggcctccaccaagggcccatcggtcttccccctggcgccctgctccaggagccacctccgagacgcacagcggccctggggctgcctggtcaaggctacttccctcgtctctactgagcgggctggcaaggcgcatagnnnnnnnn

SEQ ID NO: 109950 - DNA, 436 bp, Homo sapiens
  misc_feature: GYAE6OF02FU1AD.21.60.F05.1.454.CMB.1.raw
  modified_base (427)..(436): a, c, t, g, unknown or other
  misc_feature (427)..(436): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccaagggcccatcggtcttccccctggcgccctgctccaggagcacctccgagagcacagcggccctgggctgcctggtcaaggctacttccctcgtctctactgagcgggctggcaaggcgcatagnnnnnnnnnn

SEQ ID NO: 109951 - DNA, 432 bp, Homo sapiens
  misc_feature: GYAE6OF02IOT9J.21.60.F05.1.454.CMB.1.raw
  modified_base (338)..(338): a, c, t, g, unknown or other
  misc_feature (338)..(338): n is a, c, g, or t
  modified_base (417)..(417): a, c, t, g, unknown or other
  misc_feature (417)..(417): n is a, c, g, or t
  modified_base (423)..(432): a, c, t, g, unknown or other
  misc_feature (423)..(432): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtcgactggttgaagttcgaccccgtggggccggggaaccctggtcaccgtctcctcggcctccaccaaggcccatcggtctccccctgcgccctgctccaggcncacctccgagacgcacacgcggccctgggctcgcctggtcaaggctactccctcgtctctactgagcggctggcaggcncatagnnnnnnnnnn

SEQ ID NO: 109952 - DNA, 623 bp, Homo sapiens
  misc_feature: GYAE6OF02J0X3P.21.60.F05.1.454.CMB.1.raw
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (595)..(595): a, c, t, g, unknown or other
  misc_feature (595)..(595): n is a, c, g, or t
  modified_base (597)..(598): a, c, t, g, unknown or other
  misc_feature (597)..(598): n is a, c, g, or t
  modified_base (600)..(600): a, c, t, g, unknown or other
  misc_feature (600)..(600): n is a, c, g, or t
  modified_base (602)..(610): a, c, t, g, unknown or other
  misc_feature (602)..(610): n is a, c, g, or t
  modified_base (612)..(614): a, c, t, g, unknown or other
  misc_feature (612)..(614): n is a, c, g, or t
  modified_base (617)..(623): a, c, t, g, unknown or other
  misc_feature (617)..(623): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaaagttcgaccccgtgggggccggggaaccctgggtcaccgtctccgtcggcctccacccgaacgggccccaagtccggtaccctttccccccgtgggcccgtcccctggcccttaccgacgggacgccacccgtccgagacgccacgtacggccggccccgtgggggcccttaggcccgttcggggtcaaacggggtacctttaacccgtttccccgtccggtttaccttacccgttaaccgtttcgggtaaccgggtcccggggtcgttaccggggaccgtaaacgggggccgtaccgacgtttaaacgggcgtcgacgcgcgcgcgcgcncngcgcgcncncgcngnncncnnnnnnnnncnnncgnnnnnnn

SEQ ID NO: 109953 - DNA, 442 bp, Homo sapiens
  misc_feature: GYAE6OF02HX27D.21.60.F05.1.454.CMB.1.raw
  modified_base (424)..(424): a, c, t, g, unknown or other
  misc_feature (424)..(424): n is a, c, g, or t
  modified_base (430)..(442): a, c, t, g, unknown or other
  misc_feature (430)..(442): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccaagggcccatcggtcttccccctggccgccctgctccaggacgcacctccgagacgcacgagcggccctgggctgcctggtcaaggactactccctcgtctctactgagcgggctggcaggcncatagnnnnnnnnnnnnn

SEQ ID NO: 109954 - DNA, 560 bp, Homo sapiens
  misc_feature: GYAE6OF02J3QVO.21.60.F05.1.454.CMB.1.raw
  modified_base (195)..(195): a, c, t, g, unknown or other
  misc_feature (195)..(195): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
  modified_base (509)..(511): a, c, t, g, unknown or other
  misc_feature (509)..(511): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(525): a, c, t, g, unknown or other
  misc_feature (524)..(525): n is a, c, g, or t
  modified_base (527)..(528): a, c, t, g, unknown or other
  misc_feature (527)..(528): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (536)..(540): a, c, t, g, unknown or other
  misc_feature (536)..(540): n is a, c, g, or t
  modified_base (542)..(545): a, c, t, g, unknown or other
  misc_feature (542)..(545): n is a, c, g, or t
  modified_base (547)..(549): a, c, t, g, unknown or other
  misc_feature (547)..(549): n is a, c, g, or t
  modified_base (551)..(556): a, c, t, g, unknown or other
  misc_feature (551)..(556): n is a, c, g, or t
  modified_base (558)..(560): a, c, t, g, unknown or other
  misc_feature (558)..(560): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattacaaagacacggcgtatctgcaaatgagcagcctagaaaaccgngacacggcgtctattactgtgctagacctagtcggcctcgtccgacgttgggttacgaacgttcccggaccccggtcgggggcccggggaaccctggtccaccgttctccgtcggccctcgaccgaacgggcccagtccgtccttccccgnggccnccctgctccgaggacnccaccgtcgagcgaccacgacggccggcctgggccttcgccgttggacctaaacggtccttaccgttcccgtcgtccttcgtacgtcgacggggtccggtacgtacggaccgaaacggggtccctaagtagtacgngcgncnnngcncgcncncncnncnncncncncnnnnncnnnncnnncnnnnnncnnn

SEQ ID NO: 109955 - DNA, 551 bp, Homo sapiens
  misc_feature: GYAE6OF02JKU3T.21.60.F05.1.454.CMB.1.raw
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
  modified_base (504)..(506): a, c, t, g, unknown or other
  misc_feature (504)..(506): n is a, c, g, or t
  modified_base (509)..(513): a, c, t, g, unknown or other
  misc_feature (509)..(513): n is a, c, g, or t
  modified_base (515)..(518): a, c, t, g, unknown or other
  misc_feature (515)..(518): n is a, c, g, or t
  modified_base (520)..(520): a, c, t, g, unknown or other
  misc_feature (520)..(520): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (532)..(534): a, c, t, g, unknown or other
  misc_feature (532)..(534): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (541)..(541): a, c, t, g, unknown or other
  misc_feature (541)..(541): n is a, c, g, or t
  modified_base (544)..(545): a, c, t, g, unknown or other
  misc_feature (544)..(545): n is a, c, g, or t
  modified_base (547)..(547): a, c, t, g, unknown or other
  misc_feature (547)..(547): n is a, c, g, or t
  modified_base (549)..(550): a, c, t, g, unknown or other
  misc_feature (549)..(550): n is a, c, g, or t
tcagtcgtcgctcgcacgaccggtgctcgattttagtacgtcatcagggaaagggtcgtgggagtgggttggccgtattggaagcgaaaactaacaattacgcgacaacatatcgctgcgtccggtgaaaggcaggttcaccatctccagagatgattcaaagaacacggcgtatctgcaaatgagcagcctagaaaaccgaggacacggccgtctattactgtgctagacctaggtggctcgtcgacttggttgaagttccgaacccgtggggcccgggaaccttggtcaccgtctccgtcggcctccgaccgaacggcccagtcggtccttccccgtggccgcccgtgctccgaggacgccgaccgtccgagacgcgacgacgcggcccgtgggccttggccgttgggtaccaacggtccttaccgtttccccgtacggtccttccgtacgtggaccggtcgggctggaccgaagggcgcgagtaggcagntgngcgtangnnncgnnnnncnnnngngtgtgngngngnnngngngcncgnncncnnc

SEQ ID NO: 109956 - DNA, 437 bp, Homo sapiens
  misc_feature: GYAE6OF02FH4KJ.21.60.F05.1.454.CMB.1.raw
  modified_base (194)..(194): a, c, t, g, unknown or other
  misc_feature (194)..(194): n is a, c, g, or t
  modified_base (355)..(355): a, c, t, g, unknown or other
  misc_feature (355)..(355): n is a, c, g, or t
  modified_base (429)..(437): a, c, t, g, unknown or other
  misc_feature (429)..(437): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttccgacccctgggggccggggaaccctggtcaccgtctcctcggcctccaccaagggccccatcggtcttccccctggcgccctgctccaggagcacctccgagngcacagcggccctgggctgcctggtcaaggctacttccctcgtctctactgagcgggctggcaaggcgcatagnnnnnnnnn

SEQ ID NO: 109957 - DNA, 433 bp, Homo sapiens
  misc_feature: GYAE6OF02GDDIH.21.60.F05.1.454.CMB.1.raw
  modified_base (194)..(194): a, c, t, g, unknown or other
  misc_feature (194)..(194): n is a, c, g, or t
  modified_base (427)..(433): a, c, t, g, unknown or other
  misc_feature (427)..(433): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgaccccctgggggccggggaaccctggtcaccgtctcctcggcctccaccaggcccatcggtcttcccctggcgccctgctccaggagcacctccgagacgcacagcggccctgggctgcctggtcaaggactacttccctcgtctctactgagcgggctggcaaggcgcatagnnnnnnn

SEQ ID NO: 109958 - DNA, 432 bp, Homo sapiens
  misc_feature: GYAE6OF02FHRWT.21.60.F05.1.454.CMB.1.raw
  modified_base (194)..(194): a, c, t, g, unknown or other
  misc_feature (194)..(194): n is a, c, g, or t
  modified_base (328)..(328): a, c, t, g, unknown or other
  misc_feature (328)..(328): n is a, c, g, or t
  modified_base (421)..(421): a, c, t, g, unknown or other
  misc_feature (421)..(421): n is a, c, g, or t
  modified_base (427)..(432): a, c, t, g, unknown or other
  misc_feature (427)..(432): n is a, c, g, or t
tcagtcgtcgctcgcacgaccggtgctcgatttagtacgtcatcagggaaagggctggagtgggttggccgtattggaagcaaaactaacaattacgagacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttccgacccctgggggccggggaaccctggtcaccgtctcctcggcctccaccaagggcccatcgtcttccccctggcnccctgctccaggagcacctccgagagcacagccggccctgggctgcctggtcaaggctactccctcgtctctactgagcgggctggcaaggcncatagnnnnnn

SEQ ID NO: 109959 - DNA, 438 bp, Homo sapiens
  misc_feature: GYAE6OF02IFN58.21.60.F05.1.454.CMB.1.raw
  modified_base (194)..(194): a, c, t, g, unknown or other
  misc_feature (194)..(194): n is a, c, g, or t
  modified_base (428)..(438): a, c, t, g, unknown or other
  misc_feature (428)..(438): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgacccctggggccggggaaccctggtcaccgtctcctcggcctccaccaagggcccatcggtccttccccctggcgccctgctccaggcgcacctccgagacgcacagccggccctgggctgcctggtcaaggctacttccctcgtctctactgagcgggctggcaggcgcatagnnnnnnnnnnn

SEQ ID NO: 109960 - DNA, 445 bp, Homo sapiens
  misc_feature: GYAE6OF02GCV31.21.60.F05.1.454.CMB.1.raw
  modified_base (194)..(194): a, c, t, g, unknown or other
  misc_feature (194)..(194): n is a, c, g, or t
  modified_base (432)..(445): a, c, t, g, unknown or other
  misc_feature (432)..(445): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttccgacccctggggccggggaacccctggtcaccgtctcctcggcctccaccaagggcccatcggtcttccccctggccgccctgcctccaggagcacctccgagagcacacgcggccctgggctgcctggtcaaggctacttccctcgtctctactgacgcgggctggcaaggcgcatagnnnnnnnnnnnnnn

SEQ ID NO: 109961 - DNA, 435 bp, Homo sapiens
  misc_feature: GYAE6OF02F5UJE.21.60.F05.1.454.CMB.1.raw
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (356)..(356): a, c, t, g, unknown or other
  misc_feature (356)..(356): n is a, c, g, or t
  modified_base (431)..(435): a, c, t, g, unknown or other
  misc_feature (431)..(435): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggcccggggaaccctggtcaccgtctcctcggcctccaccaagggcccatcggtcttcccccnggccnccctgcctccaggagccacctccgagngcacagcggccctgggctgcctggtcaaggctacttccctcgtctctactgacgcgggctggcaaggcgcatagnnnnn

SEQ ID NO: 109962 - DNA, 434 bp, Homo sapiens
  misc_feature: GYAE6OF02IYP0G.21.60.F05.1.454.CMB.1.raw
  modified_base (194)..(194): a, c, t, g, unknown or other
  misc_feature (194)..(194): n is a, c, g, or t
  modified_base (319)..(319): a, c, t, g, unknown or other
  misc_feature (319)..(319): n is a, c, g, or t
  modified_base (382)..(382): a, c, t, g, unknown or other
  misc_feature (382)..(382): n is a, c, g, or t
  modified_base (408)..(408): a, c, t, g, unknown or other
  misc_feature (408)..(408): n is a, c, g, or t
  modified_base (416)..(434): a, c, t, g, unknown or other
  misc_feature (416)..(434): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgacccctggggccgggaacctggtcacgtctcctcgctccaccaaggcccatcggtctcccctggcnccctgctccaggagcactccgagagcacagcgccctgggctgcctggtcaaggctacttcccncgtctctctgagcgggctggcaaggngccatagnnnnnnnnnnnnnnnnnnn

SEQ ID NO: 109963 - DNA, 585 bp, Homo sapiens
  misc_feature: GYAE6OF02JZQJE.21.60.F05.1.454.CMB.1.raw
  modified_base (342)..(342): a, c, t, g, unknown or other
  misc_feature (342)..(342): n is a, c, g, or t
  modified_base (383)..(383): a, c, t, g, unknown or other
  misc_feature (383)..(383): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
  modified_base (553)..(554): a, c, t, g, unknown or other
  misc_feature (553)..(554): n is a, c, g, or t
  modified_base (558)..(570): a, c, t, g, unknown or other
  misc_feature (558)..(570): n is a, c, g, or t
  modified_base (572)..(585): a, c, t, g, unknown or other
  misc_feature (572)..(585): n is a, c, g, or t
tcagtcgtcgctcgcacgaccggtgctcgatttagtacgtcatcagggaaagggcgtggagtgggttggccggtattggaagcaaaactaacaattacgcgacaacatatgctgcgtcggtgaaaggcaggttcaccatctccagagatgattcaaagaacacggcgtatctgcaaatgagcagcctgaaaaccgaggactacggccgtctattactgtgctagacctagtggctcgtccgactggttgaaggttcgaccccgtgggggcccggggaaccctgggtcaccggtctccgtccggcctccaccgaacgggccccagtccgtcctttccccccgnggccgtccccgtgcctccgacgggtacgccacctccgacgngccaccagccgggccctgggggcccttggccccgttggggtaccaaacggggacctttacccgttcccccgtttacgtcccgttcctaaccgttggaacgggtccgggtccgtcggggccgaaacggggccgaccgaacgttacggacgcgacgcncngngcgngcacgnngcgnnnnnnnnnnnnngnnnnnnnnnnnnnn

SEQ ID NO: 109964 - DNA, 439 bp, Homo sapiens
  misc_feature: GYAE6OF02GA40S.21.60.F05.1.454.CMB.1.raw
  modified_base (194)..(194): a, c, t, g, unknown or other
  misc_feature (194)..(194): n is a, c, g, or t
  modified_base (325)..(325): a, c, t, g, unknown or other
  misc_feature (325)..(325): n is a, c, g, or t
  modified_base (431)..(439): a, c, t, g, unknown or other
  misc_feature (431)..(439): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttccgacccctgggggccggggaaccctggtcaccgtctcctcggcctccaccaagggcccatcggtcttcccccnggcgcccctgcctcaaggagccacctccgagagcacagcggccctgggctgcctggtcaaggactacttccctgtcctctactgagcggctggcaaggcgcatagnnnnnnnnn

SEQ ID NO: 109965 - DNA, 443 bp, Homo sapiens
  misc_feature: GYAE6OF02H009P.21.60.F05.1.454.CMB.1.raw
  modified_base (343)..(343): a, c, t, g, unknown or other
  misc_feature (343)..(343): n is a, c, g, or t
  modified_base (433)..(443): a, c, t, g, unknown or other
  misc_feature (433)..(443): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccaagggcccatcggtcttcccccctggccgccctgctccaggngcacctccgagagcacagcggccctgggctgcctggtcaaggactacttccctcgtctcctacgtgacgcgggctggcaaggcgcatagnnnnnnnnnnn

SEQ ID NO: 109966 - DNA, 466 bp, Homo sapiens
  misc_feature: GYAE6OF02G0PMJ.21.60.F05.1.454.CMB.1.raw
  modified_base (194)..(194): a, c, t, g, unknown or other
  misc_feature (194)..(194): n is a, c, g, or t
  modified_base (214)..(214): a, c, t, g, unknown or other
  misc_feature (214)..(214): n is a, c, g, or t
  modified_base (353)..(353): a, c, t, g, unknown or other
  misc_feature (353)..(353): n is a, c, g, or t
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
  modified_base (452)..(466): a, c, t, g, unknown or other
  misc_feature (452)..(466): n is a, c, g, or t
tcagtcgtcgctcgcacgaccggtgctcgatttagtacgtcatcagggaaagggctggagtgggttggacgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattacngtgctagacctagtggctcgtccgactggttgaagttccgaccccgtgggggccggggaaccctggtccaccgtctcctcggcctccaccaagggcccagtcggtccttcccccgtggccgccccgtgcctccgacggngccaccgtccgagacgcacgacgccggccctgggcctgcctggtcaacggctaccttcctcgtctctactgacgcgggctggcgaaggcganatagnannnnnnnnnnnnnnn

SEQ ID NO: 109967 - DNA, 582 bp, Homo sapiens
  misc_feature: GYAE6OF02IDB0S.21.60.F05.1.454.CMB.1.raw
  modified_base (530)..(530): a, c, t, g, unknown or other
  misc_feature (530)..(530): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (550)..(550): a, c, t, g, unknown or other
  misc_feature (550)..(550): n is a, c, g, or t
  modified_base (553)..(553): a, c, t, g, unknown or other
  misc_feature (553)..(553): n is a, c, g, or t
  modified_base (557)..(558): a, c, t, g, unknown or other
  misc_feature (557)..(558): n is a, c, g, or t
  modified_base (560)..(567): a, c, t, g, unknown or other
  misc_feature (560)..(567): n is a, c, g, or t
  modified_base (569)..(582): a, c, t, g, unknown or other
  misc_feature (569)..(582): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtgggggccggggaaccctggtcaccgtctccgtcggcctccaccaagggcccatccggtcttccccctggccgccctgcctccaggacgccacctccgagacgccacgacggccggcccgtcggggcctcggcccgttgggtaccgaaacggggtaccttacccgtttaccccggaaggtcccggaaccggtaaccgttcgggaacgggtccgggggtacctacgggggaccgaaaacgggggcccgacgtaaacgttaacggcgtcgcgngcgcgcgcgcgncncgcganacncgcnncnnnnnnnngnnnnnnnnnnnnnn

SEQ ID NO: 109968 - DNA, 443 bp, Homo sapiens
  misc_feature: GYAE6OF02G8SQI.21.60.F05.1.454.CMB.1.raw
  modified_base (323)..(323): a, c, t, g, unknown or other
  misc_feature (323)..(323): n is a, c, g, or t
  modified_base (343)..(343): a, c, t, g, unknown or other
  misc_feature (343)..(343): n is a, c, g, or t
  modified_base (429)..(443): a, c, t, g, unknown or other
  misc_feature (429)..(443): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccagggcccatcggtcttcccccnggccgccctgctccaggacncacctcgagagcacagcggccctgggctgcctggtcaaggctacttccctcgtctctactgagcgggctcggcaaggcgcagtagnnnnnnnnnnnnnnn

SEQ ID NO: 109969 - DNA, 438 bp, Homo sapiens
  misc_feature: GYAE6OF02GCQVY.21.60.F05.1.454.CMB.1.raw
  modified_base (429)..(438): a, c, t, g, unknown or other
  misc_feature (429)..(438): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccaagggcccatcggtcttccccctggcgccctgcctccaggagcacctccgagagcacagcggccctgggctgcctggtcaaggactacttccctcgtctctactgagcgggctggcaaggcgcatagnnnnnnnnnn

SEQ ID NO: 109970 - DNA, 711 bp, Homo sapiens
  misc_feature: GYAE6OF02J3ULG.21.60.F05.1.454.CMB.1.raw
  modified_base (615)..(615): a, c, t, g, unknown or other
  misc_feature (615)..(615): n is a, c, g, or t
  modified_base (630)..(630): a, c, t, g, unknown or other
  misc_feature (630)..(630): n is a, c, g, or t
  modified_base (640)..(640): a, c, t, g, unknown or other
  misc_feature (640)..(640): n is a, c, g, or t
  modified_base (658)..(658): a, c, t, g, unknown or other
  misc_feature (658)..(658): n is a, c, g, or t
  modified_base (673)..(673): a, c, t, g, unknown or other
  misc_feature (673)..(673): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaagcaggttcaccatctcagagatgattacaaagacacggcgtatctagacaaatcgacgacacgaccgtaagaaaacccggaggaccgaccggtccttacttagttactcgtagtacctaacgtactaggtcgtccgttcgtaccgtacgttcggttacgtaaccggttcccggaccccgggtggggtacccgggtaacctcggtcctacccgttccgtacccgtccggaccctaccggaaccggtaccggtccctacggttcccggttccccgtccccgtcggcccgtccgtcgccgtaccggacggtaccgacccaccggtacggacgccgtaccggaccgcgggtcccggtccggtgggtcccgttcggaccgttacgggtaacccgaaacggtaccctacccggttaccgggaccgtaccggtaccggtacggtcgggccgggtaccgggtgtaccgggaagacccgggttacgaactaggtcgggaccngacgcgcgcgacgcncgcgcgcgcncgtcgacgcgcacactcncgcgcgtacgacgcncgtctacgacgtcctagcgtcgtcgcgtcgcgtcgtcg

SEQ ID NO: 109971 - DNA, 608 bp, Homo sapiens
  misc_feature: GYAE6OF02JBHVW.21.60.F05.1.454.CMB.1.raw
  modified_base (196)..(196): a, c, t, g, unknown or other
  misc_feature (196)..(196): n is a, c, g, or t
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
tcagtcgtcgctcgcacgaccggtgctcgatttagtacgtcatcagggaaagggctggagtgggttggccgtattgggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctagttactgtgctagaccttagtggctccgtccgactggtgaagttccgacccgtggggcccgggaacctggcaccgtctcctcggcctccaccgaggccatcggtcctccccgtggccgccgtgcctccaggtcgccaccgtccgagtacgcgtacacggccggcccgtggggcctcgacccttgggacgaacgggtcctaaccgtttccccgtacggttacccttacgtaccgtacggacggggtcccggggtacttccgggacgaaacgggtcccgacgttaagttacgggngtcgngtgtagtcgtgcggagacgacgcgacgcgcgcgcgcgtcgcgcgcgcgtcgcgtcgtcgtcgtacgtccgtcctcgtcgacgtcgcgcgcgcgtcgtcg

SEQ ID NO: 109972 - DNA, 565 bp, Homo sapiens
  misc_feature: GYAE6OF02J1UP4.21.60.F05.1.454.CMB.1.raw
  modified_base (330)..(330): a, c, t, g, unknown or other
  misc_feature (330)..(330): n is a, c, g, or t
  modified_base (525)..(525): a, c, t, g, unknown or other
  misc_feature (525)..(525): n is a, c, g, or t
  modified_base (529)..(532): a, c, t, g, unknown or other
  misc_feature (529)..(532): n is a, c, g, or t
  modified_base (534)..(565): a, c, t, g, unknown or other
  misc_feature (534)..(565): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacgccgtctattactgtgctagacctagtggctcgtccgactggttgaagttcgacccctgggggccggggaaccctgggtccaccgtctcctcggcctccaccaacgggcccactccggtccttcccccgnggccgtcccctgccgtccaggacgcccacctcccggaagcgccaacacggtccggccccgtggggccttcggcccttgggtacccaaacgggtccttaacccgttttccccgcggtttccctaccgttaacttcgggaacgggtcggggtccgtcggggcccgtaaacggggtcccgaccgtacgtaacggccgngcgnnnngnnnnnnnnnnnnnnnnnnnnnnnnnnnnnnnn

SEQ ID NO: 109973 - DNA, 504 bp, Homo sapiens
  misc_feature: GYAE6OF02JJ2K4.21.60.F05.1.454.CMB.1.raw
  modified_base (195)..(195): a, c, t, g, unknown or other
  misc_feature (195)..(195): n is a, c, g, or t
  modified_base (295)..(295): a, c, t, g, unknown or other
  misc_feature (295)..(295): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (465)..(504): a, c, t, g, unknown or other
  misc_feature (465)..(504): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctatactgtgctagacctagtggctcgtccgactggttgaagttccgacccgtggggccggggaccctgtccaccgtctcctcggccnctacccgaccaaggccccattcccggtcctcccccgtggaccgcccctgccgtccaggacnccacgtccganacgacacgcgccggcctgggctggcctggacaggtcctaccgttcctcgtcctcgtacgtcggacgtcggcgtaggaccgtacggcgtacagttacgnnnnnnnnnnnnnnnnnnnnnnnnnnnnnnnnnnnnnnnn

SEQ ID NO: 109974 - DNA, 660 bp, Homo sapiens
  misc_feature: GYAE6OF02FPQXE.21.60.F05.1.454.CMB.1.raw
  modified_base (205)..(205): a, c, t, g, unknown or other
  misc_feature (205)..(205): n is a, c, g, or t
  modified_base (364)..(364): a, c, t, g, unknown or other
  misc_feature (364)..(364): n is a, c, g, or t
  modified_base (538)..(538): a, c, t, g, unknown or other
  misc_feature (538)..(538): n is a, c, g, or t
tcagtcgtcgctcgcacgaccggtgctcgatttagtacgtcatcaagggaaagggacgtcggaacgtgggttcggcccgtagttggaaagccaaaactaacaattacgcgacaacatactgctgcgtcggtgaaaggcaggttctaccatctccagagatgattcaaagacacggcgtatctgcaatgagcagcctgaaaaccgnggacgacggccgtactattacgtgtgcttaggaccgtagtggctcggtccgacttggttagaacgtttccggaccccgttgggggaccggggaaccctggtccgtaccgtcctccgtcggtccctccaaccgaacgggccccagtccggtcttccccgnggccgccctggcctccgaggagccaccgtccgagagccgacaggccgcctagggtctgccgtaggtacgaacgggtaccttaccgtttccccgtcggttccttaccgtaccgtacggacggtacgggtccgtacgggtacgaacgggcggacgtaagtacgtcgacgtacggancgtatcgacgtctacggtcacgtcgagacgacgacggtcgtacgtactagtcgacgacgacgacgacggtacgtaacgtacgtacgtacgtacgtacgtacgacgacgacggtacgtcgacg

SEQ ID NO: 109975 - DNA, 475 bp, Homo sapiens
  misc_feature: GYAE6OF02H2S77.21.60.F05.1.454.CMB.1.raw
  modified_base (195)..(195): a, c, t, g, unknown or other
  misc_feature (195)..(195): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (434)..(434): a, c, t, g, unknown or other
  misc_feature (434)..(434): n is a, c, g, or t
  modified_base (456)..(475): a, c, t, g, unknown or other
  misc_feature (456)..(475): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacaccggccgtctattactgtgctagacctagtggctcgtccgacttggttgaagttccgaccccgtgggggccggggaccctggtcaccgtctcctcggcctccaccgaagggccccagtccggtccttcccccgtggccgccctgcctccaggacnccacctccggancgccacgacgccggcccgtggggcctcgccgtcggtcaacggtcctacgttccctacgtctctacgngcggcggctgcaggcgcagagnnnnnnnnnnnnnnnnnnnn

SEQ ID NO: 109976 - DNA, 440 bp, Homo sapiens
  misc_feature: GYAE6OF02JKGRG.21.60.F05.1.454.CMB.1.raw
  modified_base (194)..(194): a, c, t, g, unknown or other
  misc_feature (194)..(194): n is a, c, g, or t
  modified_base (337)..(337): a, c, t, g, unknown or other
  misc_feature (337)..(337): n is a, c, g, or t
  modified_base (421)..(440): a, c, t, g, unknown or other
  misc_feature (421)..(440): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgaccctggggccggggaaccctggtcacgtctcctcgcctccaccaaggcccatcggtcttcccctggcgccctgctccaggacncacctcgagagcacagcggccctgggctgcctggtcaaggctacttccctcgtctctactgagcgggctggcacggcgcatagnnnnnnnnnnnnnnnnnnnn

SEQ ID NO: 109977 - DNA, 448 bp, Homo sapiens
  misc_feature: GYAE6OF02JD2VA.21.60.F05.1.454.CMB.1.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
  modified_base (433)..(435): a, c, t, g, unknown or other
  misc_feature (433)..(435): n is a, c, g, or t
  modified_base (437)..(448): a, c, t, g, unknown or other
  misc_feature (437)..(448): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaaagaacacggcgtatctgcaaatgagcagcctagaaaaccgnggacacggccgtntattactgtgctagacctagtggctcgccgactggttgaagttccgacccgtgggggcccgggaacctggtcaccgtctcctcggcctccaccaggcccatcggtccttcccctggccgccctgctccaggcncacctccgagagcacngccggcctgggctgcctggtcaaggcctacctccgtcgtctctactgacggcggctcgggcaagggccagatagnnngnnnnnnnnnnnn

SEQ ID NO: 109978 - DNA, 446 bp, Homo sapiens
  misc_feature: GYAE6OF02H555F.21.60.F05.1.454.CMB.1.raw
  modified_base (431)..(446): a, c, t, g, unknown or other
  misc_feature (431)..(446): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtgggggccggggaaccctggtcaccgtctcctcggcctccaccagggcccatcggtctccccctggcgccctgctccaggcgcacctccgagagcacagcggccctgggctgcctggtcaaggactacgttcccgagcgacgctgaggcgggctggcaagggcgacataggnnnnnnnnnnnnnnnn

SEQ ID NO: 109979 - DNA, 505 bp, Homo sapiens
  misc_feature: GYAE6OF02GXJOT.21.60.F05.1.454.CMB.1.raw
  modified_base (195)..(195): a, c, t, g, unknown or other
  misc_feature (195)..(195): n is a, c, g, or t
  modified_base (490)..(505): a, c, t, g, unknown or other
  misc_feature (490)..(505): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgactggttgaagttcgaccccgtgggggccggggaaccctggtcaccgtctcctcggcctccaccaagggcccatccggtccttccccctggccgcccctgcctccaggacgccaccgtcccgagacgccacgacgccggccccgtggggcctcggcccttgggtaccaaacgggaccttaccgttcccccgtcgttccttccttaccgtcggacggccggggtcctggggccgaaacgggccgacagtagnnnnnnnnnnnnnnnn

SEQ ID NO: 109980 - DNA, 455 bp, Homo sapiens
  misc_feature: GYAE6OF02JFYWN.21.60.F05.1.454.CMB.1.raw
  modified_base (194)..(194): a, c, t, g, unknown or other
  misc_feature (194)..(194): n is a, c, g, or t
  modified_base (424)..(424): a, c, t, g, unknown or other
  misc_feature (424)..(424): n is a, c, g, or t
  modified_base (430)..(455): a, c, t, g, unknown or other
  misc_feature (430)..(455): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgatggttgaagttcgaccccgtggggccggggaaccctggtcaccgtctcctcggcctccaccaggcccatcggtctcccctggccgccctgctccaggacgcacctccgagcgcacgagccggcccgtgggcctgcctggtcaaggactaccttccctcgtctctacgtgagcgggctggcaggcncatagnnnnnnnnnnnnnnnnnnnnnnnnnn

SEQ ID NO: 109981 - DNA, 456 bp, Homo sapiens
  misc_feature: GYAE6OF02JR7WO.21.60.F05.1.454.CMB.1.raw
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
  modified_base (434)..(434): a, c, t, g, unknown or other
  misc_feature (434)..(434): n is a, c, g, or t
  modified_base (441)..(444): a, c, t, g, unknown or other
  misc_feature (441)..(444): n is a, c, g, or t
  modified_base (446)..(456): a, c, t, g, unknown or other
  misc_feature (446)..(456): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccgggacctggtcaccgtctcgtccgcctccaccgaacgggcccatcggttccttcccccgtggccnccctgctccaggngccacctccgagcgcacagccggccgtgggcctgcctggacaaggacctacttccctgtcctactcgtgacggcggctgggccaaggccnagtagcnnnncnnnnnnnnnnn

SEQ ID NO: 109982 - DNA, 436 bp, Homo sapiens
  misc_feature: GYAE6OF02I32L2.21.60.F05.1.454.CMB.1.raw
  modified_base (196)..(196): a, c, t, g, unknown or other
  misc_feature (196)..(196): n is a, c, g, or t
  modified_base (428)..(436): a, c, t, g, unknown or other
  misc_feature (428)..(436): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgacaaatgagcagccctgaaaaccgnggacacggccgtctattactgtgctagacctagtggctcgtccgactggttgaagttccgaccccgtggggccgggaaccctggtcaccgctcctcggcctccaccagggcccatcggtcttccccctggccgccctgctccaggcgcacctccgagagcacagccggccctgggctgcctggtcaggctacttccctcgtctctactgagcggctggcaaggcgcagtagnnnnnnnnn

SEQ ID NO: 109983 - DNA, 502 bp, Homo sapiens
  misc_feature: GYAE6OF02HP1UZ.21.60.F05.1.454.CMB.1.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (473)..(502): a, c, t, g, unknown or other
  misc_feature (473)..(502): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaaagaacacggcgtatctgcaaaatgagcagcctagaaaaccgnggacaccgggtccgtctattacngtgcctagacctagtggctcgccgactggttgaagttcgacccccgtgggggcccggggaacctggtcaccgtctccgtcgcctccacgacggcccatcggtctcccctgccgcctgctccgagacgcacctccgagacgcacacggtcggccctggggctcggcctcgggtcaaacgggtactaccgttcccgtcgttcctcttacctggtaggccgggtcgtcgggccgaaacgggcgacgacgtaacggnnnnnnnnnnnnnnnnnnnnnnnnnnnnnn

SEQ ID NO: 109984 - DNA, 703 bp, Homo sapiens
  misc_feature: GYAE6OF02FF0QH.21.60.F05.1.454.CMB.1.raw
  modified_base (218)..(218): a, c, t, g, unknown or other
  misc_feature (218)..(218): n is a, c, g, or t
  modified_base (389)..(389): a, c, t, g, unknown or other
  misc_feature (389)..(389): n is a, c, g, or t
  modified_base (476)..(476): a, c, t, g, unknown or other
  misc_feature (476)..(476): n is a, c, g, or t
  modified_base (604)..(604): a, c, t, g, unknown or other
  misc_feature (604)..(604): n is a, c, g, or t
  modified_base (619)..(619): a, c, t, g, unknown or other
  misc_feature (619)..(619): n is a, c, g, or t
  modified_base (657)..(657): a, c, t, g, unknown or other
  misc_feature (657)..(657): n is a, c, g, or t
  modified_base (661)..(661): a, c, t, g, unknown or other
  misc_feature (661)..(661): n is a, c, g, or t
  modified_base (666)..(666): a, c, t, g, unknown or other
  misc_feature (666)..(666): n is a, c, g, or t
  modified_base (668)..(703): a, c, t, g, unknown or other
  misc_feature (668)..(703): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctaccagagactgattacaaaaggaaccacgggtctatcgtgacaaaagtgacgcctaacggcctaaaggaaaaacccggngggtaccaaccgggtcccttattaacgtttaccgtcggtacgtaccgtaaccggtaaccgtggttcggtcccgttaccggtccgtaaggtttcgggtttaacggaacggtttcccccgggacccccgggtttaggggggggaacccccggtaaaccccttggggtaccccncccggttccccttaccgccgggtaccccctaaccccggaaccggaaccggggtccccctaggtttccccggtccccctttccccggnggcccctccgttagacccgtacgaacggggcctacccaccggttacggaacggcacccgaacggccggtccccggtccggtgggaccttcggaccgtttacggacaaaaccgtccttaccgttcccgngttacctccggttanccgggacggccggtcacggaacacgggcctagtaacgncgancgttnannnnnnnnnnnnnnnnnnnnnnnnnnnnnnnnnnnn

SEQ ID NO: 109985 - DNA, 463 bp, Homo sapiens
  misc_feature: GYAE6OF02JIXH4.21.60.F05.1.454.CMB.1.raw
  modified_base (425)..(425): a, c, t, g, unknown or other
  misc_feature (425)..(425): n is a, c, g, or t
  modified_base (449)..(463): a, c, t, g, unknown or other
  misc_feature (449)..(463): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtgctcgtccgactggttgaagttccgaccccgtgggggcccggggaaccctggtccaccgtctcctcggcctccaccgaagggccccagtccggtccttccccccgtgggccgcccctgcctccgaggacgccaccgtccgagacgcacgacgccggcctgggctgcctggcaaggcctactccctcgtctctactgngcgggtctggacgacggcgcatgnnnnnnnnnnnnnnn

SEQ ID NO: 109986 - DNA, 439 bp, Homo sapiens
  misc_feature: GYAE6OF02GCZW1.21.60.F05.1.454.CMB.1.raw
  modified_base (324)..(324): a, c, t, g, unknown or other
  misc_feature (324)..(324): n is a, c, g, or t
  modified_base (363)..(363): a, c, t, g, unknown or other
  misc_feature (363)..(363): n is a, c, g, or t
  modified_base (426)..(426): a, c, t, g, unknown or other
  misc_feature (426)..(426): n is a, c, g, or t
  modified_base (431)..(439): a, c, t, g, unknown or other
  misc_feature (431)..(439): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttccgaccctggggccggggaaccctggtccaccgtctcctcggcctccaccaggcccatccggtccttcccccnggccgcccctgcctccaggacgccacctccgagcgcacngccggccctgggctgcctggtcaaggctacttccctgtctctactgacgcgggctggcaggcncatgnnnnnnnnn

SEQ ID NO: 109987 - DNA, 441 bp, Homo sapiens
  misc_feature: GYAE6OF02HZDRC.21.60.F05.1.454.CMB.1.raw
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (426)..(426): a, c, t, g, unknown or other
  misc_feature (426)..(426): n is a, c, g, or t
  modified_base (431)..(441): a, c, t, g, unknown or other
  misc_feature (431)..(441): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaaagaacacggcgtatctgcaaaatgagcagcctgaaaaaccgaggacacggccgtctaattactgtgctagcctagtggctcgtccgactggttagaagttccgaccccgtgggggaccggggaaccctggtcaccgtctcctcggcctccaccaaggcccatcggtctcccctggcgccctgctccaggncacctcgagngcanagcggccctgggcctgcctggtcaaggactacttccctgtctctactgagcgggctggcgaaggcgnatagnnnnnnnnnnn

SEQ ID NO: 109988 - DNA, 467 bp, Homo sapiens
  misc_feature: GYAE6OF02GB2TX.21.60.F05.1.454.CMB.1.raw
  modified_base (349)..(349): a, c, t, g, unknown or other
  misc_feature (349)..(349): n is a, c, g, or t
  modified_base (448)..(467): a, c, t, g, unknown or other
  misc_feature (448)..(467): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgattggttgaagttccgaccccgtgggggcccgggaaccctggtcaccgtctcctcggcctccaccaagggcccatcgtccttccccctggccgccctgcctccgaggacnccacctccgagagccacgacgccggccctggggcctgccctggtacaaggtctaccttcccctcgtctctactgagcgggctgggcaagggcacatagnnnnnnnnnnnnnnnnnnnn

SEQ ID NO: 109989 - DNA, 461 bp, Homo sapiens
  misc_feature: GYAE6OF02HENP8.21.60.F05.1.454.CMB.1.raw
  modified_base (195)..(195): a, c, t, g, unknown or other
  misc_feature (195)..(195): n is a, c, g, or t
  modified_base (331)..(331): a, c, t, g, unknown or other
  misc_feature (331)..(331): n is a, c, g, or t
  modified_base (421)..(421): a, c, t, g, unknown or other
  misc_feature (421)..(421): n is a, c, g, or t
  modified_base (441)..(461): a, c, t, g, unknown or other
  misc_feature (441)..(461): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgactggttgaagttccgaccccgtgggggccggggaaccctggtcaccgtctcctcggcctccacaagggcccatccggtcttcccctggccnccctgcctccgaggacgccacctccgagacgcaacgagccggccctgggctggcctggcaaggactactccctcgtctctactgagcggntgggacaaggcgcagtacgnnnnnnnnnnnnnnnnnnnnn

SEQ ID NO: 109990 - DNA, 486 bp, Homo sapiens
  misc_feature: GYAE6OF02ICAGX.21.60.F05.1.454.CMB.1.raw
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
  modified_base (317)..(317): a, c, t, g, unknown or other
  misc_feature (317)..(317): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
  modified_base (418)..(419): a, c, t, g, unknown or other
  misc_feature (418)..(419): n is a, c, g, or t
  modified_base (422)..(423): a, c, t, g, unknown or other
  misc_feature (422)..(423): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
  modified_base (451)..(455): a, c, t, g, unknown or other
  misc_feature (451)..(455): n is a, c, g, or t
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaggcaggttcacatctccagagatgattcaaagaacacggcgtatctgcaaatgagcagcctagaaaaccgnggacacggccgtctattacngtgctagactagtggctcgtcgacgtggttgaacgttcgacccgtggggccggggaacctggtcaccgtctccgtcggcctcacaagggcccatcgtctccccnggccgccctgctccgagcgccacctcgagtacgcacagcggcctgggctgctgcaagctactcctcgtctctactgagcgntggctaaggcntatagntgnncgnngntacgngactgcngcngagtcacgncnnnnncacgcncgcgtcgcncgcncgctcncngngc

SEQ ID NO: 109991 - DNA, 543 bp, Homo sapiens
  misc_feature: GYAE6OF02IJ3LV.21.60.F05.1.454.CMB.1.raw
  modified_base (200)..(200): a, c, t, g, unknown or other
  misc_feature (200)..(200): n is a, c, g, or t
  modified_base (335)..(335): a, c, t, g, unknown or other
  misc_feature (335)..(335): n is a, c, g, or t
  modified_base (490)..(491): a, c, t, g, unknown or other
  misc_feature (490)..(491): n is a, c, g, or t
  modified_base (493)..(493): a, c, t, g, unknown or other
  misc_feature (493)..(493): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (506)..(509): a, c, t, g, unknown or other
  misc_feature (506)..(509): n is a, c, g, or t
  modified_base (512)..(512): a, c, t, g, unknown or other
  misc_feature (512)..(512): n is a, c, g, or t
  modified_base (514)..(515): a, c, t, g, unknown or other
  misc_feature (514)..(515): n is a, c, g, or t
  modified_base (517)..(521): a, c, t, g, unknown or other
  misc_feature (517)..(521): n is a, c, g, or t
  modified_base (523)..(524): a, c, t, g, unknown or other
  misc_feature (523)..(524): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (531)..(543): a, c, t, g, unknown or other
  misc_feature (531)..(543): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaaagaacacggcgtatctgaccaaaatgagcagcctagaaaaaccgnggacacggccgtctattacgtgtgctagacctagtggctcgtcgactggttagaacgttcgaccccgtgggggaccgggacctggtacaccgtctccgtcggcctccgacgaacggccagtccggtccttcccgnggccgtccctgcctcgaggcgcctaccgtcgagacgacgacgcggccgtccgtgggctcggtccgtggtacgaacggtaccttaccgttcccttcgttccgtacctacgtcggacgggtccggtcgtacggaccgaacggccgacgtaacgtagnngnagtcngcncgncnnnncgngnngnnnnngnngancngnnnnnnnnnnnnn

SEQ ID NO: 109992 - DNA, 491 bp, Homo sapiens
  misc_feature: GYAE6OF02H9RO5.21.60.F05.1.454.CMB.1.raw
  modified_base (472)..(472): a, c, t, g, unknown or other
  misc_feature (472)..(472): n is a, c, g, or t
  modified_base (477)..(491): a, c, t, g, unknown or other
  misc_feature (477)..(491): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgacaaatgagcagcctagaaaaccgaggacacggccgtactattactgtgctagacctagtggctcgccgtacttgttgaagttccgaccccgtgggggcccgggacctggtccaccgtctcccgtcggcctccaccgaagggcccagtccggtcttccccccgtggcccgtccctcgcctaccgaggacgccaccctccggagcgcacgacgccggccccgtggggcctggccctgggtaccaaggtaccttacctttccccgcgttcctctacgtcgacggcgggcctggcaaggccganatagnnnnnnnnnnnnnnn

SEQ ID NO: 109993 - DNA, 506 bp, Homo sapiens
  misc_feature: GYAE6OF02IGB6N.21.60.F05.1.454.CMB.1.raw
  modified_base (209)..(209): a, c, t, g, unknown or other
  misc_feature (209)..(209): n is a, c, g, or t
  modified_base (392)..(392): a, c, t, g, unknown or other
  misc_feature (392)..(392): n is a, c, g, or t
  modified_base (480)..(506): a, c, t, g, unknown or other
  misc_feature (480)..(506): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggaccacggccgtntattactgtgctagacctagtggctcgtcgacttgtgaagttccgaccccgtgggggccgggaaccctcggtcaccgtctccgtcggccctccaccgaagggcccagtccggtccttcccccctggccgcccctcgctccgaggcgccacctcccgagacgccacgacgccggcccgtgggcncgtccgtgtaccgaacgggaccttacccttcccctacgtccttcctacgtcgacggtccgggcgtcggaccgtaagggccgcatacgnnnnnnnnnnnnnnnnnnnnnnnnnnn

SEQ ID NO: 109994 - DNA, 521 bp, Homo sapiens
  misc_feature: GYAE6OF02JYFS0.21.60.F05.1.454.CMB.1.raw
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
  modified_base (355)..(355): a, c, t, g, unknown or other
  misc_feature (355)..(355): n is a, c, g, or t
  modified_base (489)..(521): a, c, t, g, unknown or other
  misc_feature (489)..(521): n is a, c, g, or t
tcagtcgtcgctcgcacgaccggtgctcgatttagtacgtcatcagggaaagggcgtggagtgggttggccgtattggaagcaaactaacaattacgcgacaacatatgctgcgtcggtgaaaggcaggttcaccatctccagagatgattcaaagaacacggcgtatctgcaaatgagcagcctagaaaaccgaggacacggtccgtactattactgtgctagacctagtggctcgtccgactggttagaagttccgaccctggggccggggaaccctggtcaccgtctcctcggcctccacacggcccagtcgccttccccgngcgccctgcctccaggcnccactccgagcncgacagccggccctggggactcggaccttcggtaacaaacggccttacctttcccctaggttccctaccttaccggttgacgggacccgggttcgtacgggacctaaaggggccaccgtaagtagccgatgacnnnnnnnnnnnnnnnnnnnnnnnnnnnnnnnnn

SEQ ID NO: 109995 - DNA, 488 bp, Homo sapiens
  misc_feature: GYAE6OF02GNP34.21.60.F05.1.454.CMB.1.raw
  modified_base (198)..(198): a, c, t, g, unknown or other
  misc_feature (198)..(198): n is a, c, g, or t
  modified_base (337)..(337): a, c, t, g, unknown or other
  misc_feature (337)..(337): n is a, c, g, or t
  modified_base (376)..(376): a, c, t, g, unknown or other
  misc_feature (376)..(376): n is a, c, g, or t
  modified_base (423)..(423): a, c, t, g, unknown or other
  misc_feature (423)..(423): n is a, c, g, or t
  modified_base (450)..(456): a, c, t, g, unknown or other
  misc_feature (450)..(456): n is a, c, g, or t
  modified_base (458)..(488): a, c, t, g, unknown or other
  misc_feature (458)..(488): n is a, c, g, or t
tcagtcgtcgctcgcacgaccggtgctcgattttagtacgtcatcagggaaagggctggagtgggttggccgtattggaagcaaaactaacaattacgcgacaacatatgctgcgtcggtgaaaggcaggttcaccatctcctagagatgatttcaaagaacacggcgtatactgcaaatgagcagcctgaaaaccgnggacacggccgtctattactgtgctagacctaggtcgctcgtccgactggttgaagttccgaccccgtgggggcccgggaaccctggtccaccgtctcctcggcctccaccaagggccccagtccggtccttcccccgnggccgcccctggcctccgaggcgccacctcgagcgcacngccggcctgggctcgcctggtcaacggctacgttccctgtctctacngacggcggctggcgaaggcgacatagnnnnnnncnnnnnnnnnnnnnnnnnnnnnnnnnnnnnnn

SEQ ID NO: 109996 - DNA, 483 bp, Homo sapiens
  misc_feature: GYAE6OF02JN7AP.21.60.F05.1.454.CMB.1.raw
  modified_base (289)..(289): a, c, t, g, unknown or other
  misc_feature (289)..(289): n is a, c, g, or t
  modified_base (325)..(325): a, c, t, g, unknown or other
  misc_feature (325)..(325): n is a, c, g, or t
  modified_base (403)..(403): a, c, t, g, unknown or other
  misc_feature (403)..(403): n is a, c, g, or t
  modified_base (447)..(483): a, c, t, g, unknown or other
  misc_feature (447)..(483): n is a, c, g, or t
tcagtcgtcgctcgcacgaccggtgctcgatttagtacgtcatcagggaaaggggctggagtgggttggccgtattggaagtcaaaactaacaattacgcgacaacatatgctgcgtcggtgaaaggcaggttcaccaatctccagagatgattcaaagaacacggcgtatctgcaaatgagcaggcctaggaaaaccgaggacacggccgtctattactgtgctagacctagtggctcgtccgactggttgaagttcgaccctggggccgggaacctggtcaccgtcncctcgcctcacagggcccatcggtctcccctggccnccctgactccgaggacgcacctcgagacgcacgaggccggcccgtgggcctggaccctgggtcaaggcttacttcccncgtctctacgtgacggccgggctgggcaacgggtcgacatagcnnnnnnnnnnnnnnnnnnnnnnnnnnnnnnnnnnnnn

SEQ ID NO: 109997 - DNA, 644 bp, Homo sapiens
  misc_feature: GYAE6OF02HHPVM.21.60.F05.1.454.CMB.1.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (598)..(598): a, c, t, g, unknown or other
  misc_feature (598)..(598): n is a, c, g, or t
  modified_base (603)..(605): a, c, t, g, unknown or other
  misc_feature (603)..(605): n is a, c, g, or t
  modified_base (609)..(610): a, c, t, g, unknown or other
  misc_feature (609)..(610): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (618)..(619): a, c, t, g, unknown or other
  misc_feature (618)..(619): n is a, c, g, or t
  modified_base (621)..(621): a, c, t, g, unknown or other
  misc_feature (621)..(621): n is a, c, g, or t
  modified_base (623)..(637): a, c, t, g, unknown or other
  misc_feature (623)..(637): n is a, c, g, or t
  modified_base (639)..(644): a, c, t, g, unknown or other
  misc_feature (639)..(644): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaaagaacacggcgtatctgacaaaatgagcagcctagaaaaccgnggacacggccgtntattactgtgctagacctagtcggctcgtccgacttggttagaacgttccgaccccgtggggggacccgggtaaccctggtacaccggttctcccgtcggccctccgaccgaacgggtcccacgttccggttcccttccccccgtggcccgtccccgtggtccctaccgaacgggtacgacccgtacccgtaccggaggaccgaccacgaccgggtcccgggccccgttggggccttccggtcccggttacggggttaacccaaaacggggttacccctttaccccgtttacccccgttcgttcccttaccgttaccggttgggaccggtaccgggtccgtacgggtaccggaaacgggccgtaacgaacgttacggactgacgcgncgcgnnncacnncncncncnncncnnnnnnnnnnnnnnncnnnnnn

SEQ ID NO: 109998 - DNA, 477 bp, Homo sapiens
  misc_feature: GYAE6OF02JLBA5.21.60.F05.1.454.CMB.1.raw
  modified_base (194)..(194): a, c, t, g, unknown or other
  misc_feature (194)..(194): n is a, c, g, or t
  modified_base (321)..(321): a, c, t, g, unknown or other
  misc_feature (321)..(321): n is a, c, g, or t
  modified_base (401)..(401): a, c, t, g, unknown or other
  misc_feature (401)..(401): n is a, c, g, or t
  modified_base (432)..(432): a, c, t, g, unknown or other
  misc_feature (432)..(432): n is a, c, g, or t
  modified_base (439)..(477): a, c, t, g, unknown or other
  misc_feature (439)..(477): n is a, c, g, or t
tcagtcgtcgctcgcacgaccggtgctcgatttagtacgtcatcaggggaaagggctggagtgggttggccgtattggaagcaaactaacaattacgcgacaacatatgctgcgtcggtgaaaggcaggttcaccatctccagagatgattcaaagaacacggcgtatctgcaaatgagcagcctgaaaaccgnggacacgggccgtctattactgtgctagacctagtggctcgtccgactggttgaagttcgacccctggggccgggaccctggtcacgtctcctcggcctcacaagggcccatccggtcttcccccgnggcgccctgctccgaggacgccacctcggagacgcacaggccggaccctgggacctgccctggtcaacggctacttcccngtcctctactgacgcggactggacaacggcnatgacgnnnnnnnnnnnnnnnnnnnnnnnnnnnnnnnnnnnnnnn

SEQ ID NO: 109999 - DNA, 545 bp, Homo sapiens
  misc_feature: GYAE6OF02GI7J6.21.60.F05.1.454.CMB.1.raw
  modified_base (179)..(179): a, c, t, g, unknown or other
  misc_feature (179)..(179): n is a, c, g, or t
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (337)..(337): a, c, t, g, unknown or other
  misc_feature (337)..(337): n is a, c, g, or t
  modified_base (357)..(357): a, c, t, g, unknown or other
  misc_feature (357)..(357): n is a, c, g, or t
  modified_base (479)..(479): a, c, t, g, unknown or other
  misc_feature (479)..(479): n is a, c, g, or t
  modified_base (504)..(504): a, c, t, g, unknown or other
  misc_feature (504)..(504): n is a, c, g, or t
  modified_base (506)..(507): a, c, t, g, unknown or other
  misc_feature (506)..(507): n is a, c, g, or t
  modified_base (509)..(510): a, c, t, g, unknown or other
  misc_feature (509)..(510): n is a, c, g, or t
  modified_base (513)..(545): a, c, t, g, unknown or other
  misc_feature (513)..(545): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgancagcctgaaaaaccgnggacacggccgtntaattactgtgctagacctagtggctcgccgactggttgaagttccgacccctgggggacccggggaccctggtccaccgtctcctcggcctccacgtacggccctagtccggtccttccccgtggccnccctgcctcccgaaggtacnccctacctccggaacgacggtcccaacgtaccggcccgggtaccccgtggggcctcggtcccggtcgggtaccgaaaacgggtcctaccgttcccgtcgttcctcgtacgtgaccggcgggntcggcgtaacggccgacaataggcngnngnnctnnnnnnnnnnnnnnnnnnnnnnnnnnnnnnnnn

SEQ ID NO: 110000 - DNA, 448 bp, Homo sapiens
  misc_feature: GYAE6OF02GP2NU.21.60.F05.1.454.CMB.1.raw
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
  modified_base (361)..(361): a, c, t, g, unknown or other
  misc_feature (361)..(361): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (419)..(419): a, c, t, g, unknown or other
  misc_feature (419)..(419): n is a, c, g, or t
  modified_base (431)..(448): a, c, t, g, unknown or other
  misc_feature (431)..(448): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctatactgtgctagacctagtggctcgtccgactggttgaagttcgacccctgggggccggggaacctggccaccgtctcctcggcctccaccaacgggcccatccggtccttcccccgtggccgccctgctccaggncacctccganagcacngcggccctgggctgcctggcaaggactactcccngtcctntactgagcgggctcgganaaggcgcaatgnnnnnnnnnnnnnnnnnn

SEQ ID NO: 110001 - DNA, 448 bp, Homo sapiens
  misc_feature: GYAE6OF02F5DOJ.21.60.F05.1.454.CMB.1.raw
  modified_base (120)..(120): a, c, t, g, unknown or other
  misc_feature (120)..(120): n is a, c, g, or t
  modified_base (207)..(207): a, c, t, g, unknown or other
  misc_feature (207)..(207): n is a, c, g, or t
  modified_base (214)..(214): a, c, t, g, unknown or other
  misc_feature (214)..(214): n is a, c, g, or t
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (408)..(408): a, c, t, g, unknown or other
  misc_feature (408)..(408): n is a, c, g, or t
  modified_base (414)..(416): a, c, t, g, unknown or other
  misc_feature (414)..(416): n is a, c, g, or t
  modified_base (418)..(448): a, c, t, g, unknown or other
  misc_feature (418)..(448): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtnaaaggcaggtttcaccatctccagagatgattcaaagaacacggcgtatctgcaaatgagcagcctgaaaaccgggacacggccgtntattacngtgctagacctagtggctcgtccgaactggttgaagttcgacccctgggggccgggaacctggtcaccgtctcctcggcctcaccaggcccatcggtctcccctgcgccngctccagancacctcgagagcacngcggcctgggctgcctggtcaaggctacttcccngtcnctactgagcggctggcaaggcncatagnnncnnnnnnnnnnnnnnnnnnnnnnnnnnnnnnn

SEQ ID NO: 110002 - DNA, 643 bp, Homo sapiens
  misc_feature: GYAE6OF02F70I6.21.60.F05.1.454.CMB.1.raw
  modified_base (199)..(199): a, c, t, g, unknown or other
  misc_feature (199)..(199): n is a, c, g, or t
  modified_base (370)..(370): a, c, t, g, unknown or other
  misc_feature (370)..(370): n is a, c, g, or t
  modified_base (541)..(541): a, c, t, g, unknown or other
  misc_feature (541)..(541): n is a, c, g, or t
  modified_base (547)..(547): a, c, t, g, unknown or other
  misc_feature (547)..(547): n is a, c, g, or t
  modified_base (572)..(572): a, c, t, g, unknown or other
  misc_feature (572)..(572): n is a, c, g, or t
  modified_base (586)..(586): a, c, t, g, unknown or other
  misc_feature (586)..(586): n is a, c, g, or t
  modified_base (597)..(597): a, c, t, g, unknown or other
  misc_feature (597)..(597): n is a, c, g, or t
  modified_base (639)..(639): a, c, t, g, unknown or other
  misc_feature (639)..(639): n is a, c, g, or t
tcagtcgtcgctcgcacgaccggtgctcgatttagtacgtcatcagggaaagggcgtggagtgggttggccgtattggaagcaaaacctaacaattacgcgacaacatatgctgcgtcggtgaaaggcaggttcaccatctccagagatgagttcaaagaacacggtcgtatctgctaaatgagcagcctgaaaaccgnggacacggccgtctattactgtggctagacctagtggctcggtcccgacgtggttagaacgttccgaccccgtgggggccgggaaccctggtccaccggtctccgtcggcctccaccgaacgggcccagtccggtccttccccgtggccgcccgtgccgtaccgagggacnccaccgtccggagcgcacaggtccggcccgtggggacctcggcccttagggtacccaaacgggtaccttaccgtttccccgtcggttacctaccgttaacggtcgacgggtccgggaccgttacgggaccgtaaacgggcccggaccaacgtaacggcgtacgcacggtcncgtacncgactacacggtcacgctgacgtanacgcgacgtacgtnacgtctacgtntcgtgacgcgtcgacgtacggtacgcgtacgacgacgtacgngtcg

SEQ ID NO: 110003 - DNA, 483 bp, Homo sapiens
  misc_feature: GYAE6OF02GGZQB.21.60.F05.1.454.CMB.1.raw
  modified_base (196)..(196): a, c, t, g, unknown or other
  misc_feature (196)..(196): n is a, c, g, or t
  modified_base (248)..(248): a, c, t, g, unknown or other
  misc_feature (248)..(248): n is a, c, g, or t
  modified_base (330)..(330): a, c, t, g, unknown or other
  misc_feature (330)..(330): n is a, c, g, or t
  modified_base (386)..(386): a, c, t, g, unknown or other
  misc_feature (386)..(386): n is a, c, g, or t
  modified_base (432)..(432): a, c, t, g, unknown or other
  misc_feature (432)..(432): n is a, c, g, or t
  modified_base (452)..(452): a, c, t, g, unknown or other
  misc_feature (452)..(452): n is a, c, g, or t
  modified_base (456)..(457): a, c, t, g, unknown or other
  misc_feature (456)..(457): n is a, c, g, or t
  modified_base (459)..(483): a, c, t, g, unknown or other
  misc_feature (459)..(483): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgacaaatgagcagcctagaaaaccgnggacacggccgtctattactgtgctagacctagtggctcgtccgatgggttnaagttccgaccccgtgggggcccgggaaccctggccaccgtctcctcggcctcaccgaagggcccagtccgtccttccccgnggccgcccctggcctcccgaggacgccaccgtccgagacgcacgcggccggcccgngggtactcgcctgggtacaaggtaccttacctccctcgtctctagnggaggcggtctggacaggcntagnncnnnnnnnnnnnnnnnnnnnnnnnnn

SEQ ID NO: 110004 - DNA, 475 bp, Homo sapiens
  misc_feature: GYAE6OF02GR3RE.21.60.F05.1.454.CMB.1.raw
  modified_base (350)..(350): a, c, t, g, unknown or other
  misc_feature (350)..(350): n is a, c, g, or t
  modified_base (460)..(462): a, c, t, g, unknown or other
  misc_feature (460)..(462): n is a, c, g, or t
  modified_base (464)..(475): a, c, t, g, unknown or other
  misc_feature (464)..(475): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagttcgacccgtgggggccggggaaccctggtcaccgtctcctcggcctccaccaacgggcccatcggtccttcccccctggccgccctgcctccgaggacncacctccgagacgccacgagccggcccgtggggctcggcccgtggtacaaggaccttaccttcccgtcgtcctcgtacgtgacggccgggctcggcaagggcgctagagnnncnnnnnnnnnnnn

SEQ ID NO: 110005 - DNA, 540 bp, Homo sapiens
  misc_feature: GYAE6OF02FSVTF.21.60.F05.1.454.CMB.1.raw
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (453)..(453): a, c, t, g, unknown or other
  misc_feature (453)..(453): n is a, c, g, or t
  modified_base (499)..(499): a, c, t, g, unknown or other
  misc_feature (499)..(499): n is a, c, g, or t
  modified_base (501)..(502): a, c, t, g, unknown or other
  misc_feature (501)..(502): n is a, c, g, or t
  modified_base (504)..(507): a, c, t, g, unknown or other
  misc_feature (504)..(507): n is a, c, g, or t
  modified_base (509)..(540): a, c, t, g, unknown or other
  misc_feature (509)..(540): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctcccagagatgattcaaagaacacggcgtatctgcaaatgagcagcctagaaaacccgaggacacggccgtctattactgtgctagacctagtggctccgtccgactggttgagttccgacccctgggggcccgggaccctggtccaccgtcctccgtccggcctcccacgacggcccagtccggtccttcccccgnggccgccctgcctccgaggacnccacccgtccgagacncacaggcccggtcccgtgggcctcgcccgtcggtaccgaacgggtacctttccgttacccccgtcgttccctccttacgngtaccggggtccggggtcgtcgggacgacggccgtacgtagtagcncnngnnnncnnnnnnnnnnnnnnnnnnnnnnnnnnnnnnnn

SEQ ID NO: 110006 - DNA, 695 bp, Homo sapiens
  misc_feature: GYAE6OF02JUBLR.21.60.F05.1.454.CMB.1.raw
  modified_base (215)..(215): a, c, t, g, unknown or other
  misc_feature (215)..(215): n is a, c, g, or t
  modified_base (387)..(387): a, c, t, g, unknown or other
  misc_feature (387)..(387): n is a, c, g, or t
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
  modified_base (493)..(493): a, c, t, g, unknown or other
  misc_feature (493)..(493): n is a, c, g, or t
  modified_base (563)..(563): a, c, t, g, unknown or other
  misc_feature (563)..(563): n is a, c, g, or t
  modified_base (623)..(623): a, c, t, g, unknown or other
  misc_feature (623)..(623): n is a, c, g, or t
  modified_base (636)..(636): a, c, t, g, unknown or other
  misc_feature (636)..(636): n is a, c, g, or t
tcagtcgtcgctcgcacgaccggtgctcgatttagtacgtcatcagggaaagggcgtgggagtcggttggccgtattggaagcgaaacgtaactaattacgcgacaacatatgctgacgtcgtgaaggcaggttcacatctccagagatgtagtttcaaagtacacggtcgttaagtctgacaaattggacgacgtagccctaaggaaaaccggnggacctaccgggtccgggttacttaagttaccgtggtcggcgttaacggacccttaggtcggccttcggtccgtactggttgaacgttcgacccgtggggccgggtaacctggtaccaccggttctaccgtcggcctcctacggacgggtcccagtcggtcccttccccggnggcccgtcccgtgtccgtccgagggtcnccggtacctcgtagcncgtacgaggccggtcctgggtactcggaccgttggtaccgaaggtaccttacccgttcccgnggttaccctacgtcctacggccgtacgggccgtaggaccgtaacggccggtacaacggttaacgacgttnacgttcgacgtcacgtagccgacttagacgttgagttacgcgtaacgtcgtacgtcggtntagttaacccggnggagtacggtcgagtcgaagtacttgacgttactagtacgttccgtaggtcgacgtcgg

SEQ ID NO: 110007 - DNA, 604 bp, Homo sapiens
  misc_feature: GYAE6OF02GCGXD.21.60.F05.1.454.CMB.1.raw
  modified_base (192)..(192): a, c, t, g, unknown or other
  misc_feature (192)..(192): n is a, c, g, or t
  modified_base (212)..(212): a, c, t, g, unknown or other
  misc_feature (212)..(212): n is a, c, g, or t
  modified_base (377)..(377): a, c, t, g, unknown or other
  misc_feature (377)..(377): n is a, c, g, or t
  modified_base (572)..(572): a, c, t, g, unknown or other
  misc_feature (572)..(572): n is a, c, g, or t
  modified_base (575)..(604): a, c, t, g, unknown or other
  misc_feature (575)..(604): n is a, c, g, or t
tcagtcgtcgctcgcacgaccggtgctcgatttagtacgtcatcagggaagggctggagtgggttggccgtattggaagcaaactaacaattacgcgacaacatatgctgcgtcggtgaaaggcaggttcaccatctccagagatgattcaaagaacacggcgtatctgcaaatgagcagcctgaaaaccgnggacacggccgtctattacngtgcttacgaccttagtcggtcctcggtccgtacttgggttcgaaaggtttcccgaaccccgttgggggggcccggggtaaccccgtgggtcccaccggttcctccgtcccgggtccctcccgtacccgaacgggccccagttcccgggtccccttttcccccgngggtcccgccccctaggcccttccgaaacggcgccctaccgtcccggagaacgccctaaccgacgccgggtcccctgggggcctcggtcccgttcgggtaccaagggtaccctccgtttaccccgtccgttcttcccgtaactcgggacggtcgggtccgtcggaccgaacgggtccgacgtaagcggtcagcgnacnnnnnnnnnnnnnnnnnnnnnnnnnnnnnn

SEQ ID NO: 110008 - DNA, 499 bp, Homo sapiens
  misc_feature: GYAE6OF02IGXU7.21.60.F05.1.454.CMB.1.raw
  modified_base (371)..(371): a, c, t, g, unknown or other
  misc_feature (371)..(371): n is a, c, g, or t
  modified_base (472)..(472): a, c, t, g, unknown or other
  misc_feature (472)..(472): n is a, c, g, or t
  modified_base (475)..(499): a, c, t, g, unknown or other
  misc_feature (475)..(499): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtactattacctgtgctagacctagtgctcgtccgctggttgaagtcgacccccgtgggggccggggaaccctggtcacccgtctcccgtcggccctccaccgaacgggccccagtccggtccttccccccgtggccgccctggcctcgagcgccacctccgagacnccacgacgccggcccgtgggctcgccgtggtacgaaggcctaccgttccctcgtcctcgtactcggagccgggcgtagggccgtaagggccgataacgtgncgnnnnnnnnnnnnnnnnnnnnnnnnn

SEQ ID NO: 110009 - DNA, 652 bp, Homo sapiens
  misc_feature: GYAE6OF02I62AY.21.60.F05.1.454.CMB.1.raw
  modified_base (321)..(321): a, c, t, g, unknown or other
  misc_feature (321)..(321): n is a, c, g, or t
  modified_base (584)..(584): a, c, t, g, unknown or other
  misc_feature (584)..(584): n is a, c, g, or t
  modified_base (594)..(594): a, c, t, g, unknown or other
  misc_feature (594)..(594): n is a, c, g, or t
  modified_base (602)..(603): a, c, t, g, unknown or other
  misc_feature (602)..(603): n is a, c, g, or t
  modified_base (606)..(606): a, c, t, g, unknown or other
  misc_feature (606)..(606): n is a, c, g, or t
  modified_base (608)..(609): a, c, t, g, unknown or other
  misc_feature (608)..(609): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (618)..(619): a, c, t, g, unknown or other
  misc_feature (618)..(619): n is a, c, g, or t
  modified_base (621)..(621): a, c, t, g, unknown or other
  misc_feature (621)..(621): n is a, c, g, or t
  modified_base (627)..(627): a, c, t, g, unknown or other
  misc_feature (627)..(627): n is a, c, g, or t
  modified_base (629)..(630): a, c, t, g, unknown or other
  misc_feature (629)..(630): n is a, c, g, or t
  modified_base (633)..(633): a, c, t, g, unknown or other
  misc_feature (633)..(633): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
  modified_base (642)..(643): a, c, t, g, unknown or other
  misc_feature (642)..(643): n is a, c, g, or t
  modified_base (646)..(647): a, c, t, g, unknown or other
  misc_feature (646)..(647): n is a, c, g, or t
  modified_base (649)..(649): a, c, t, g, unknown or other
  misc_feature (649)..(649): n is a, c, g, or t
  modified_base (652)..(652): a, c, t, g, unknown or other
  misc_feature (652)..(652): n is a, c, g, or t
tcagtcgtcgctcgcacgaccggtgctcgatttagtacgtcatcagggaaagggctggagtgggttgccgtattggaagcaaaactaacaattacgcgacaacatatgctgcgtcggtgaaaggcaggttcaccatctccagacgatgattcaaagaacacggtcgtatcgtgacctaaatgacgcaacggtcctaggaaaaacccggagggaccaccgggcccgtcgtaattaccgtggttgacctagacctaggtgggcctccggtccgacttgggttacaagtccgacccgtcggggtccgggggacccgtcggtccncgtaccgtcctacccggtcctacccacccgaacggcccgaacgtcccggttaccctttccccgtccggccggttacccgtccggtactcccgacgggacgtacccgacccgtccgaccggtaacgcctaccgacggacccggcccggtcgggtacgtcgacccgttgtaccggtaacggtacttacccttccgttacccgtcttacccttaccggtagtacggtcccgggggctacggggtaccgaacgggcttacgacgtanacgtgacctncgattgcnncangnncgngngtcnngntctgcngnngtnacncncgtnncanngncan

SEQ ID NO: 110010 - DNA, 485 bp, Homo sapiens
  misc_feature: GYAE6OF02G505O.21.60.F05.1.454.CMB.1.raw
  modified_base (195)..(195): a, c, t, g, unknown or other
  misc_feature (195)..(195): n is a, c, g, or t
  modified_base (431)..(431): a, c, t, g, unknown or other
  misc_feature (431)..(431): n is a, c, g, or t
  modified_base (450)..(453): a, c, t, g, unknown or other
  misc_feature (450)..(453): n is a, c, g, or t
  modified_base (455)..(456): a, c, t, g, unknown or other
  misc_feature (455)..(456): n is a, c, g, or t
  modified_base (458)..(458): a, c, t, g, unknown or other
  misc_feature (458)..(458): n is a, c, g, or t
  modified_base (463)..(485): a, c, t, g, unknown or other
  misc_feature (463)..(485): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgactggttgaagttccgaccccgtgggggcccggggaacccctggtccaccgtctccctcggcctccaccaagggccccatcggtccttccccctgggccgccctgcctccaggagcaccctcgagagcacgagcggcccgtgggctggcctggtcaaggtactaccgttcccgagcgacgactgagccgggntggcaagggcgcagtagcnnnncnncngcagnnnnnnnnnnnnnnnnnnnnnnn

SEQ ID NO: 110011 - DNA, 607 bp, Homo sapiens
  misc_feature: GYAE6OF02FSTBE.21.60.F05.1.454.CMB.1.raw
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (536)..(536): a, c, t, g, unknown or other
  misc_feature (536)..(536): n is a, c, g, or t
  modified_base (547)..(547): a, c, t, g, unknown or other
  misc_feature (547)..(547): n is a, c, g, or t
  modified_base (555)..(555): a, c, t, g, unknown or other
  misc_feature (555)..(555): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (573)..(573): a, c, t, g, unknown or other
  misc_feature (573)..(573): n is a, c, g, or t
  modified_base (578)..(578): a, c, t, g, unknown or other
  misc_feature (578)..(578): n is a, c, g, or t
  modified_base (581)..(581): a, c, t, g, unknown or other
  misc_feature (581)..(581): n is a, c, g, or t
  modified_base (584)..(584): a, c, t, g, unknown or other
  misc_feature (584)..(584): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (593)..(593): a, c, t, g, unknown or other
  misc_feature (593)..(593): n is a, c, g, or t
  modified_base (601)..(601): a, c, t, g, unknown or other
  misc_feature (601)..(601): n is a, c, g, or t
  modified_base (605)..(606): a, c, t, g, unknown or other
  misc_feature (605)..(606): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtntattacgtgtgctagacctaggtggctcgtccgacttggttgaacgttccgaccccgtggggggcccggggaaccctggtaccaccgtcctccgtccggccttccgaaccgaacgggccccagttccgggtcctttccccccgtgggcccgtcccgtcggcctccgaagggacgcccaacccgtccggaagacggaccacgacggccggcccgtggggccttcggcctgggtacgaaacgggtaccttaccgtttcccgtcgttccttaccttacgtggacggtcgggtactcgggacgaaacgggccgacgtaagtacgcngntgcngcacgcgtacngtcagctntgtacngngcgagacgcncgacncgngcncgananagngcgcagancgcnnc

SEQ ID NO: 110012 - DNA, 566 bp, Homo sapiens
  misc_feature: GYAE6OF02JGFNI.21.60.F05.1.454.CMB.1.raw
  modified_base (326)..(326): a, c, t, g, unknown or other
  misc_feature (326)..(326): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
  modified_base (517)..(517): a, c, t, g, unknown or other
  misc_feature (517)..(517): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
  modified_base (533)..(533): a, c, t, g, unknown or other
  misc_feature (533)..(533): n is a, c, g, or t
  modified_base (539)..(539): a, c, t, g, unknown or other
  misc_feature (539)..(539): n is a, c, g, or t
  modified_base (541)..(542): a, c, t, g, unknown or other
  misc_feature (541)..(542): n is a, c, g, or t
  modified_base (548)..(548): a, c, t, g, unknown or other
  misc_feature (548)..(548): n is a, c, g, or t
  modified_base (556)..(556): a, c, t, g, unknown or other
  misc_feature (556)..(556): n is a, c, g, or t
  modified_base (560)..(560): a, c, t, g, unknown or other
  misc_feature (560)..(560): n is a, c, g, or t
  modified_base (564)..(564): a, c, t, g, unknown or other
  misc_feature (564)..(564): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttccgacccgtggggcccgggaaccctggtcaccgtctccgtcggcctccaccaggcccagtccggtccttccccgnggccgtcccctgccctccgaggacgccacccgtcgacgacgccaacgcgccggcccgtgggcctcggcctgggtacaacgggtacttaccgttcccgtcgtcctacgtacgtggacggccggggtctcgggacgaacgggcgtaccaagttacggcacgtcacgcncacncnctcncacnctacgcgtcgnacgtcgcngcgncgcnctacgngnnacgtancgtacgcncgcncacntc

SEQ ID NO: 110013 - DNA, 454 bp, Homo sapiens
  misc_feature: GYAE6OF02GA88D.21.60.F05.1.454.CMB.1.raw
  modified_base (194)..(194): a, c, t, g, unknown or other
  misc_feature (194)..(194): n is a, c, g, or t
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
  modified_base (431)..(454): a, c, t, g, unknown or other
  misc_feature (431)..(454): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgatggttgaagttccgaccccgtgggggccggggaacccctggtcaccgtctcctcggcctccaccaagggcccatcggtcttccccctggcgccctgctccaggncacctccgagagcacngcggccctgggctgcctggtcaaggactactccctcgtctcctctgacgcgggctggcaaggcgcagtacgnnnnnnnnnnnnnnnnnnnnnnnn

SEQ ID NO: 110014 - DNA, 493 bp, Homo sapiens
  misc_feature: GYAE6OF02I9UFE.21.60.F05.1.454.CMB.1.raw
  modified_base (472)..(493): a, c, t, g, unknown or other
  misc_feature (472)..(493): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtggggcccggggaaccctggtccaccgtctcctccggcctccaccaacgggcccagtccggtccttccccccgtggccgcccctcgcctcccaggcgccacctcccggagacgcacgacgccggcccgtggggctcggccgtggtacaacggtaccttaccgttcccgagccgacgactcggagcgggcgtgggcaacgggcgtacagtacgnnnnnnnnnnnnnnnnnnnnnn

SEQ ID NO: 110015 - DNA, 538 bp, Homo sapiens
  misc_feature: GYAE6OF02JK129.21.60.F05.1.454.CMB.1.raw
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (280)..(280): a, c, t, g, unknown or other
  misc_feature (280)..(280): n is a, c, g, or t
  modified_base (441)..(441): a, c, t, g, unknown or other
  misc_feature (441)..(441): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
  modified_base (504)..(538): a, c, t, g, unknown or other
  misc_feature (504)..(538): n is a, c, g, or t
tcagtcgtcgctcgcacgaccggtgctcgatttagtacgtcatcagggaaagggctggagtgggttggccgtattggaagcaaactaacaattacgcgacaacatatgctgcgtcggtgaaaggcaggttcaccatctccagagatgattcaaagaacacggcgtatctgcaaatgagcagcctgaaaaccgaggacacggccgtctattacngtnctagacctatggctcgtccgactggttgaacgttcgacccctgggggccggggaccctgggtcnccgtctcctcggcctccgaccaagggccccatccggtctccccctggccgccctgcctccaggacgcacctcccgagcgaccacagccggcccttggggcttcggcccttgggtccaaacggggccttaccgtttccccgttaccggttcctcgttaccgnggtaccgggccgggtcctcggggactaacggggcccgtacgaacgtaggccngactggntacnnnnnnnnnnnnnnnnnnnnnnnnnnnnnnnnnnn

SEQ ID NO: 110016 - DNA, 445 bp, Homo sapiens
  misc_feature: GYAE6OF02GZVUD.21.60.F05.1.454.CMB.1.raw
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (433)..(445): a, c, t, g, unknown or other
  misc_feature (433)..(445): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgatggttgaagttcgacccctgggggccggggaacctggtcaccgtctcctcggcctccaccaggcccatcggtcttccccctggccgccctgctccgaggcgcacctccgagacgcacgagccggccctggggctcggcctggtcaacggctaccgttccctcgtctctactgacgcggcnggcaaggcncatgnnnnnnnnnnnnn

SEQ ID NO: 110017 - DNA, 502 bp, Homo sapiens
  misc_feature: GYAE6OF02IJ68K.21.60.F05.1.454.CMB.1.raw
  modified_base (249)..(249): a, c, t, g, unknown or other
  misc_feature (249)..(249): n is a, c, g, or t
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (462)..(464): a, c, t, g, unknown or other
  misc_feature (462)..(464): n is a, c, g, or t
  modified_base (466)..(468): a, c, t, g, unknown or other
  misc_feature (466)..(468): n is a, c, g, or t
  modified_base (470)..(474): a, c, t, g, unknown or other
  misc_feature (470)..(474): n is a, c, g, or t
  modified_base (476)..(476): a, c, t, g, unknown or other
  misc_feature (476)..(476): n is a, c, g, or t
  modified_base (478)..(481): a, c, t, g, unknown or other
  misc_feature (478)..(481): n is a, c, g, or t
  modified_base (483)..(493): a, c, t, g, unknown or other
  misc_feature (483)..(493): n is a, c, g, or t
  modified_base (495)..(495): a, c, t, g, unknown or other
  misc_feature (495)..(495): n is a, c, g, or t
  modified_base (497)..(502): a, c, t, g, unknown or other
  misc_feature (497)..(502): n is a, c, g, or t
tcagtcgtcgctcgcacgaccggtgctcgatttagtacgtcatcagggaaagggctggagtgggttgaccgtattggaagcaaaactaacaattacgcgacaacatatgctgcgtcggtgaaaggcaggttcaccatctccagagatgattcaaaagaacacggcgtatctgacaaatgagcagcctagaaaaccgaggacacggccgtctattactgtgctagacctagtcggctcgtcgactggttnaacgttcgacccgtgggggccgggaacctggtcaccgtctccgtcgcctccacgaggccatcgtctccccgngccncctgctcgagcncaccncgngacgcacagcgccgtggctcgcctggcaacggtacctaccttccctcgtctaccgtacgtcggacgtccgggcgtacggaccgaaacgggtccgacgtaagtaggctgcacgngngnnngnnncnnnnncncnnnncnnnnnnnnnnncncnnnnnn

SEQ ID NO: 110018 - DNA, 490 bp, Homo sapiens
  misc_feature: GYAE6OF02FVAJV.21.60.F05.1.454.CMB.1.raw
  modified_base (345)..(345): a, c, t, g, unknown or other
  misc_feature (345)..(345): n is a, c, g, or t
  modified_base (441)..(441): a, c, t, g, unknown or other
  misc_feature (441)..(441): n is a, c, g, or t
  modified_base (466)..(490): a, c, t, g, unknown or other
  misc_feature (466)..(490): n is a, c, g, or t
tcagtcgtcgctcgcacgaccggtgctcgatttagtacgtcatcagggaaatggctggagtgggttggccgtattggaagcaaaactaacaattacgcgacaacatatgctgcgtcggtgaaaggcaggttcaccatctccagagatgattcaaagacacggcgtatctgcaaatgagcagcctagaaaaccgaggacacggccgtctattactgtgctagacctagtggtcttgtccgacttggttgaagttccgaccccgtgggggcccgggaaccctggtcaccgtctcctcggcctccaccagggcccatcggtccttccccgtgcgcctgcctccgaggngccaccgtccgagacgcacacggccggccctggggctcgaccgtcggtacgaacggtacctacttcccctacggtcttcctacgtgacggtcgggngttcgggacacggcgcctagtacgnnnnnnnnnnnnnnnnnnnnnnnnn

SEQ ID NO: 110019 - DNA, 552 bp, Homo sapiens
  misc_feature: GYAE6OF02F4KI3.21.60.F05.1.454.CMB.1.raw
  modified_base (214)..(214): a, c, t, g, unknown or other
  misc_feature (214)..(214): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (378)..(378): a, c, t, g, unknown or other
  misc_feature (378)..(378): n is a, c, g, or t
  modified_base (487)..(487): a, c, t, g, unknown or other
  misc_feature (487)..(487): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (514)..(515): a, c, t, g, unknown or other
  misc_feature (514)..(515): n is a, c, g, or t
  modified_base (518)..(518): a, c, t, g, unknown or other
  misc_feature (518)..(518): n is a, c, g, or t
  modified_base (521)..(552): a, c, t, g, unknown or other
  misc_feature (521)..(552): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattacaaagaacacggcgtatctgacaaatgagcagtccctagaaaaccgaggaccaccggccgtnttaattactgtgctagacctagtggcctcgtccgattggttgaacgttccgaccccgtgggggacccgggtacctggtccacgttcctccgtcggccctccacgacggccctagtccggtcccttccccgnggcccncctgcctccgaggcgccaccgcgagcnccacgtacggcccggcccgtggggtcctcggtcccgttgggtaaccgaacggttaccttaccccgttccccttaccggtccttaacgtccggacggtcgggccggtcgngggaaccgtagggccgagtacnggntnngcngtnnnnnnnnnnnnnnnnnnnnnnnnnnnnnnnn

SEQ ID NO: 110020 - DNA, 683 bp, Homo sapiens
  misc_feature: GYAE6OF02HE4K1.21.60.F05.1.454.CMB.1.raw
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
  modified_base (589)..(589): a, c, t, g, unknown or other
  misc_feature (589)..(589): n is a, c, g, or t
  modified_base (600)..(600): a, c, t, g, unknown or other
  misc_feature (600)..(600): n is a, c, g, or t
  modified_base (610)..(610): a, c, t, g, unknown or other
  misc_feature (610)..(610): n is a, c, g, or t
  modified_base (613)..(613): a, c, t, g, unknown or other
  misc_feature (613)..(613): n is a, c, g, or t
  modified_base (621)..(621): a, c, t, g, unknown or other
  misc_feature (621)..(621): n is a, c, g, or t
  modified_base (625)..(625): a, c, t, g, unknown or other
  misc_feature (625)..(625): n is a, c, g, or t
tcagtcgtcgctcgcacgaccggtgctcgatttagtacgtcatcagggaaagggctggagtgggttggccgtattggaagcaaactaacaattacgcgacaacatatgctgcgtggtgaaaggcaggttcacatctccagagatgattcaaagaacacggtacgtatcgtgcaaaagtgagcaacgtcctagaaaaccggnggaacaccgggccgtacgtattactaggttcgactagacctaggtcgcttaccgtaccgtactggtgaacgttccgaccccgtgggggaccggaacctggtaccnccgttcnccgtcggtccctccaaccggaacggtcccagttacccggtccctttacccccggaggcccgtaccctcggtcctaccgaggtacacccgtacccgtcggaaggacaccgtaacgcgggccggttacccgtagggtccctacggaccgttacgggacgtaaaagacccgtttacctttccccgacggtttccacggttaccgtcgggaacgggtccggaccggtgggaacccgtaagggaccgaaccgttagtaagcgtaccagtacacgctcacgnacgtagcgacncgtcaacgtnacncgacgcgngtanatcgtacgtacgtacgactacgtacgacgtagtacgacgtatacgtacgtactacgta

SEQ ID NO: 110021 - DNA, 465 bp, Homo sapiens
  misc_feature: GYAE6OF02GWJTX.21.60.F05.1.454.CMB.1.raw
  modified_base (195)..(195): a, c, t, g, unknown or other
  misc_feature (195)..(195): n is a, c, g, or t
  modified_base (448)..(465): a, c, t, g, unknown or other
  misc_feature (448)..(465): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgactggttgaagttccgaccccgtgggggcccggggaaccctggtccaccgtctcctcggccctccaccaacgggcccatccggtccttcccccgtggccgccctgcctccaggacgccacctccgagagcacaggccggccctgggctcgcctggtcaaggactaccttccctcgtctctactgacgcgggctggacgaggcgcatagnnnnnnnnnnnnnnnnnn

SEQ ID NO: 110022 - DNA, 693 bp, Homo sapiens
  misc_feature: GYAE6OF02HU1TD.21.60.F05.1.454.CMB.1.raw
  modified_base (144)..(144): a, c, t, g, unknown or other
  misc_feature (144)..(144): n is a, c, g, or t
  modified_base (593)..(593): a, c, t, g, unknown or other
  misc_feature (593)..(593): n is a, c, g, or t
  modified_base (606)..(606): a, c, t, g, unknown or other
  misc_feature (606)..(606): n is a, c, g, or t
  modified_base (626)..(626): a, c, t, g, unknown or other
  misc_feature (626)..(626): n is a, c, g, or t
tcagtcgtcgctcgcacgaccggtgctcgatttagtacgtcatcagggaaagggctggagtgggttggccgtatttggaagcaaaactaacaattacgcgacaacatatgctgcgtcgtgaaagcaggttccacatctccaganatgattacaaagaaccacggcgtatctgacaatgagacagacctacggaaaaccgacggacaccggccgttatacgttacgtgtagacttacgacctagtggacctcggttccgacgttggtttagaacggtttccgacccggtgggggacccgggaccgtacggtcctaccggtcctaccgtcccgccctaccgaccggacggtacccacgttacccggttcccgttacccccgtggtccccgtcccgtacgtcccgaccgtacggtccgaacccaccgttaccgacggaccgacgaccgtacggccggtaccgtcggtacgtccgaccggttcgaccgtaacgtaccttccgttcccgtacgttccgtacgtaccgtggacggtaccggtacgtggtacccgaaggacccgtacgaacgtagctagctagcgtatcgacgtcgaagngtcacgtgtaacncgagtccgagtcgaacgtancgtacgtacacgtacgtcgtactacgtacgaagtactacgtacgtaccgtacgtacgtacgacgaag

SEQ ID NO: 110023 - DNA, 474 bp, Homo sapiens
  misc_feature: GYAE6OF02JIL5Z.21.60.F05.1.454.CMB.1.raw
  modified_base (194)..(194): a, c, t, g, unknown or other
  misc_feature (194)..(194): n is a, c, g, or t
  modified_base (316)..(316): a, c, t, g, unknown or other
  misc_feature (316)..(316): n is a, c, g, or t
  modified_base (438)..(440): a, c, t, g, unknown or other
  misc_feature (438)..(440): n is a, c, g, or t
  modified_base (442)..(474): a, c, t, g, unknown or other
  misc_feature (442)..(474): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttccgacccgtgggggcccggggaacctggtcaccgtctctcgcctcacaggccatcggtctccccngcgcctgctcagagcacctcgagcgcacacgcggccctgggctgcctgggtcaagggtctacttcccgtcgtcctcgtacctggacgccgggtcgtgggcctaaagggccgtacagtacggnnngnnnnnnnnnnnnnnnnnnnnnnnnnnnnnnnnn

SEQ ID NO: 110024 - DNA, 526 bp, Homo sapiens
  misc_feature: GYAE6OF02GFUPG.21.60.F05.1.454.CMB.1.raw
  modified_base (195)..(195): a, c, t, g, unknown or other
  misc_feature (195)..(195): n is a, c, g, or t
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
  modified_base (487)..(488): a, c, t, g, unknown or other
  misc_feature (487)..(488): n is a, c, g, or t
  modified_base (490)..(494): a, c, t, g, unknown or other
  misc_feature (490)..(494): n is a, c, g, or t
  modified_base (496)..(499): a, c, t, g, unknown or other
  misc_feature (496)..(499): n is a, c, g, or t
  modified_base (501)..(526): a, c, t, g, unknown or other
  misc_feature (501)..(526): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctatactgtgctagacctagtggctcgtccgacttggttgaacgttccgaccccgtggggggacccggggaaccctggtccaccgtctccctcggcctccaccgaacggcccagtccggtccttccccgnggccgccctgcctccgaggacnccacccgtcgagacgcaccgaggcccggcccgtggggccttcgggccctgggtaccgaacggtaccttacccttccccgtcgtcctaccgtacgtggacggtcgggtctggacgacgggcgacagtgnnannnnncnnnncnnnnnnnnnnnnnnnnnnnnnnnnnn

SEQ ID NO: 110025 - DNA, 525 bp, Homo sapiens
  misc_feature: GYAE6OF02IN71O.21.60.F05.1.454.CMB.1.raw
  modified_base (164)..(164): a, c, t, g, unknown or other
  misc_feature (164)..(164): n is a, c, g, or t
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (378)..(378): a, c, t, g, unknown or other
  misc_feature (378)..(378): n is a, c, g, or t
  modified_base (478)..(478): a, c, t, g, unknown or other
  misc_feature (478)..(478): n is a, c, g, or t
  modified_base (482)..(484): a, c, t, g, unknown or other
  misc_feature (482)..(484): n is a, c, g, or t
  modified_base (486)..(492): a, c, t, g, unknown or other
  misc_feature (486)..(492): n is a, c, g, or t
  modified_base (494)..(497): a, c, t, g, unknown or other
  misc_feature (494)..(497): n is a, c, g, or t
  modified_base (499)..(500): a, c, t, g, unknown or other
  misc_feature (499)..(500): n is a, c, g, or t
  modified_base (502)..(516): a, c, t, g, unknown or other
  misc_feature (502)..(516): n is a, c, g, or t
  modified_base (518)..(518): a, c, t, g, unknown or other
  misc_feature (518)..(518): n is a, c, g, or t
  modified_base (520)..(521): a, c, t, g, unknown or other
  misc_feature (520)..(521): n is a, c, g, or t
  modified_base (523)..(525): a, c, t, g, unknown or other
  misc_feature (523)..(525): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggngtatctgacaaatgagcagcctagaaaaccgnggacacggccgtctattactgtnctagcctagtggctcgtcgactggttgaacgttcgaccccgtggggccgggacctggtcaccgtctccgtcggcctccacgacggccctatccggtccttccccgtgccgtcccctgctccgaggcgccaccgtcgagcgcacgacgccggcctgggcncgtccgtaggtaccaaggtaccttacttcccgtcgtaccttacgttacgtcggaacgggtccggtcgtacgggcgaaacgggtcccaagtaagtacgtcncgannngnnnnnnngnnnngnngnnnnnnnnnnnnnnncncnncnnn

SEQ ID NO: 110026 - DNA, 507 bp, Homo sapiens
  misc_feature: GYAE6OF02FWFQZ.21.60.F05.1.454.CMB.1.raw
  modified_base (143)..(143): a, c, t, g, unknown or other
  misc_feature (143)..(143): n is a, c, g, or t
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (401)..(401): a, c, t, g, unknown or other
  misc_feature (401)..(401): n is a, c, g, or t
  modified_base (430)..(432): a, c, t, g, unknown or other
  misc_feature (430)..(432): n is a, c, g, or t
  modified_base (435)..(435): a, c, t, g, unknown or other
  misc_feature (435)..(435): n is a, c, g, or t
  modified_base (437)..(438): a, c, t, g, unknown or other
  misc_feature (437)..(438): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
  modified_base (456)..(458): a, c, t, g, unknown or other
  misc_feature (456)..(458): n is a, c, g, or t
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
  modified_base (477)..(477): a, c, t, g, unknown or other
  misc_feature (477)..(477): n is a, c, g, or t
  modified_base (487)..(487): a, c, t, g, unknown or other
  misc_feature (487)..(487): n is a, c, g, or t
  modified_base (495)..(495): a, c, t, g, unknown or other
  misc_feature (495)..(495): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
tcagtcgtcgctcgcacgaccggtgctcgatttagtacgtcatcagggaaagggctggagtgggttgaccgtattggaagcaaaactaacaattacgcgacaacatatgctgcgtcggtgaaaggcaggttcaccatctcagngatgattcaaagaacacggcgtaatctgcaaatggagcagcctgaaaaccgnggacacggccgtntattactgtgctagactagtgctcgtaccgatggttagaacgttcgacccgtgggggccgggaacctggcacgtcctctcggcctcacgaaggccatcgtctcccctggcgcctgctccgagagcaccgtcgagancacngacggcctggctggacctgggtacaaggctaacgttcccgcgtctactaccgnacggcggtctggacgtaggcgacagtagnnnagncnncgncngtcngtacncgannngnacggtacntcgagtacnactcgtacgncgtcgtanacgtacacgntn

SEQ ID NO: 110027 - DNA, 478 bp, Homo sapiens
  misc_feature: GYAE6OF02GAAEI.21.60.F05.1.454.CMB.1.raw
  modified_base (444)..(444): a, c, t, g, unknown or other
  misc_feature (444)..(444): n is a, c, g, or t
  modified_base (450)..(478): a, c, t, g, unknown or other
  misc_feature (450)..(478): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcgggtgaaaggcaggttcaccatctcccagagatgattcaaagaacacggcgtatctgcaaatgagcagcctgaaaaccgaggacacggccgtctattactgtgctagacctagtggctcgtccgactggttgaagttcgaccctgggggcccgggaacctggtcaccgtctcctcggcctccaccaagggcccagtcggtccttccccctggcgccctgctccaggcgcacctccgagacgcacagccggccctagggcctcgccgtgggtacaagggtcctacttcccctcgtcctctacctgacgcgggcgtggcgtaaaggccgntatgannnnnnnnnnnnnnnnnnnnnnnnnnnnn

SEQ ID NO: 110028 - DNA, 664 bp, Homo sapiens
  misc_feature: GYAE6OF02HNMS5.21.60.F05.1.454.CMB.1.raw
  modified_base (195)..(195): a, c, t, g, unknown or other
  misc_feature (195)..(195): n is a, c, g, or t
  modified_base (256)..(256): a, c, t, g, unknown or other
  misc_feature (256)..(256): n is a, c, g, or t
  modified_base (317)..(317): a, c, t, g, unknown or other
  misc_feature (317)..(317): n is a, c, g, or t
  modified_base (538)..(538): a, c, t, g, unknown or other
  misc_feature (538)..(538): n is a, c, g, or t
  modified_base (549)..(549): a, c, t, g, unknown or other
  misc_feature (549)..(549): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtactaattactgtgactaacgacctagtggctcgtaccgacttagggttnaaagtttccgacccccgtggggggacccgggggtaaccctggtaccacccggtccgtcccncggcctaccaacccgaagggccccacgtccggttcccttacccccgtgggcctccccgtacgccttacccgaggtaccgacacccgtccgaagagccaacgcgaccggcccttgggggacctcggcccttgggtacaacggaccttaccttccctcggttcctactaacgtcggacggccgggtctacgggtaccgaaacgggtccgacctaatacggganacgagcgagcncacgactcacgacgacgacgacgtacgacgagacgacgacgtacgtagtacgacgtacgtacgtaactacgacgtacgttacgtacgacgtacgtaccgtacgtacgacgtgacg

SEQ ID NO: 110029 - DNA, 764 bp, Homo sapiens
  misc_feature: GYAE6OF02HYJQZ.21.60.F05.1.454.CMB.1.raw
  modified_base (195)..(195): a, c, t, g, unknown or other
  misc_feature (195)..(195): n is a, c, g, or t
  modified_base (527)..(527): a, c, t, g, unknown or other
  misc_feature (527)..(527): n is a, c, g, or t
  modified_base (648)..(648): a, c, t, g, unknown or other
  misc_feature (648)..(648): n is a, c, g, or t
  modified_base (659)..(659): a, c, t, g, unknown or other
  misc_feature (659)..(659): n is a, c, g, or t
  modified_base (680)..(680): a, c, t, g, unknown or other
  misc_feature (680)..(680): n is a, c, g, or t
  modified_base (687)..(687): a, c, t, g, unknown or other
  misc_feature (687)..(687): n is a, c, g, or t
  modified_base (718)..(718): a, c, t, g, unknown or other
  misc_feature (718)..(718): n is a, c, g, or t
tcagtcgtcgctcgcacgaccggtgctcgatttagtacgtcatcagggaagggctggagtgggttggccgtattggaagcaaaactaacaattacgcgacaacatatgctgcgtcggtgaaaggcaggttcacagtctccagagatgattacaaagacacggctatactgacaatgagcacgcctagaaaaccgnggaccaccgggcctactattactaggcgacttaggaacccttaggtccggtccttcggtacccgtaagttcggggttaagtaacccggtttacccgggacccccgttagggggggtaccccgggtacccgttagggtcccctaaaccccggtttccgtacccgggttacccggacccttaaccccgaaccgtaaaccggggtccccttaacgtccgggttaccccttccccccggttagggaccccttccccgtagtaccgtacccggtaaaggaccgttaccccgtacccgtaccggaacgacgaccgacgttaaccggccgggtacccgnggggtacctttaccggccgtacgtaaacgaacccggttaaccgttacccgttcccgtcttccgtaactacgggtcggaacgggccgggtatccgggaaacgtacggacacgtaactggacnctagaccgtanacgtagaccgacagacgttanaccgtancagtactcgacgacgttgatagtacgacganagcaccgatacgagtacgacgacgtacgtacgacgacctacgtacg

SEQ ID NO: 110030 - DNA, 563 bp, Homo sapiens
  misc_feature: GYAE6OF02JCDJJ.21.60.F05.1.454.CMB.1.raw
  modified_base (121)..(121): a, c, t, g, unknown or other
  misc_feature (121)..(121): n is a, c, g, or t
  modified_base (147)..(147): a, c, t, g, unknown or other
  misc_feature (147)..(147): n is a, c, g, or t
  modified_base (196)..(196): a, c, t, g, unknown or other
  misc_feature (196)..(196): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
  modified_base (521)..(524): a, c, t, g, unknown or other
  misc_feature (521)..(524): n is a, c, g, or t
  modified_base (526)..(526): a, c, t, g, unknown or other
  misc_feature (526)..(526): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (537)..(538): a, c, t, g, unknown or other
  misc_feature (537)..(538): n is a, c, g, or t
  modified_base (540)..(542): a, c, t, g, unknown or other
  misc_feature (540)..(542): n is a, c, g, or t
  modified_base (547)..(547): a, c, t, g, unknown or other
  misc_feature (547)..(547): n is a, c, g, or t
  modified_base (550)..(558): a, c, t, g, unknown or other
  misc_feature (550)..(558): n is a, c, g, or t
  modified_base (560)..(560): a, c, t, g, unknown or other
  misc_feature (560)..(560): n is a, c, g, or t
  modified_base (562)..(563): a, c, t, g, unknown or other
  misc_feature (562)..(563): n is a, c, g, or t
tcagtcgtcgctcgcacgaccggtgctcgattttagtacgtcatcagggaaagggctggagtgggttggccgtattggaagcaaaactaacaattacgcgacaacatatgctgcgtcggtnaaaggcaggttcaccatctcaccganatgattcaaagaacacggcgtatctgacaatgagcagcctagaaaccgnggacacggcctctattactgtgctagacctagtggcttcgtcgacttggttacgaacgttccgacccgtgggggacccggggacctggccaccgtctcctccggcctccaccgaaggcccagttccggtccttccccgnggccnccctgcctcgacggacgccaccgtcgagcacacgcggccgtccgtggctcggccgtggtaccgaaggtaccttacccgtttccctacgttccgtaccttacccggtaggtaccggcggtaccgttaggaaccccggaacgggtcgaccttaagtaacggntnacgctggacctncgangcnnnncngcncncncncnncnnncgtgntannnnnnnnncntnn

SEQ ID NO: 110031 - DNA, 681 bp, Homo sapiens
  misc_feature: GYAE6OF02I5DX5.21.60.F05.1.454.CMB.1.raw
  modified_base (167)..(167): a, c, t, g, unknown or other
  misc_feature (167)..(167): n is a, c, g, or t
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
  modified_base (619)..(619): a, c, t, g, unknown or other
  misc_feature (619)..(619): n is a, c, g, or t
tcagtcgtcgctcgcacgaccggtgctcgatttagtacgtcatcagggaaagggctggagtgggttggccgtattggaagcaaactaacaattacgcgacaacatatgctgcgtcggtgaaaggcaggttcaccatctccagagatgattcaaagaacacggcgtanctgacaaatgagcagcctagaaaaccgnggacacggccgtntattactgtgctagacctaggtggctcgtccgacttggttagaacggttccgaccccggtagggggcccggggtaaccgtggtccaccgtctccgtccggcctccaccgaacgggccagtccgttccttccccgtgggcccgtcccgtgtcctccgaggtccnccgacccgtcggagacgcacgngccggtcccgtaggggcctcggtcccgtacgggtacgtaaacggtaccttacccgtttccccgttaccggttaccttaccgttaccggtacggtaccgggtccggggtcgttaaccggggaccgggtaaaccggggtccgaaccgtaggtacggctaggatccgtatacgacgtagtcctcgtccacgtcgtactcgtacgtacgtacgtcgtcgtcgactactcncgtacgtacgtacgtacctacgtacgtacgtacgtacgacgtactcgtcgtaccgtacgtac

SEQ ID NO: 110032 - DNA, 649 bp, Homo sapiens
  misc_feature: GYAE6OF02H3NTR.21.60.F05.1.454.CMB.1.raw
  modified_base (182)..(182): a, c, t, g, unknown or other
  misc_feature (182)..(182): n is a, c, g, or t
  modified_base (205)..(205): a, c, t, g, unknown or other
  misc_feature (205)..(205): n is a, c, g, or t
  modified_base (395)..(395): a, c, t, g, unknown or other
  misc_feature (395)..(395): n is a, c, g, or t
  modified_base (412)..(412): a, c, t, g, unknown or other
  misc_feature (412)..(412): n is a, c, g, or t
  modified_base (497)..(497): a, c, t, g, unknown or other
  misc_feature (497)..(497): n is a, c, g, or t
  modified_base (543)..(543): a, c, t, g, unknown or other
  misc_feature (543)..(543): n is a, c, g, or t
  modified_base (552)..(552): a, c, t, g, unknown or other
  misc_feature (552)..(552): n is a, c, g, or t
  modified_base (557)..(557): a, c, t, g, unknown or other
  misc_feature (557)..(557): n is a, c, g, or t
  modified_base (561)..(561): a, c, t, g, unknown or other
  misc_feature (561)..(561): n is a, c, g, or t
  modified_base (568)..(568): a, c, t, g, unknown or other
  misc_feature (568)..(568): n is a, c, g, or t
  modified_base (571)..(571): a, c, t, g, unknown or other
  misc_feature (571)..(571): n is a, c, g, or t
  modified_base (577)..(577): a, c, t, g, unknown or other
  misc_feature (577)..(577): n is a, c, g, or t
  modified_base (583)..(583): a, c, t, g, unknown or other
  misc_feature (583)..(583): n is a, c, g, or t
  modified_base (587)..(587): a, c, t, g, unknown or other
  misc_feature (587)..(587): n is a, c, g, or t
  modified_base (590)..(590): a, c, t, g, unknown or other
  misc_feature (590)..(590): n is a, c, g, or t
  modified_base (595)..(595): a, c, t, g, unknown or other
  misc_feature (595)..(595): n is a, c, g, or t
  modified_base (611)..(611): a, c, t, g, unknown or other
  misc_feature (611)..(611): n is a, c, g, or t
  modified_base (615)..(615): a, c, t, g, unknown or other
  misc_feature (615)..(615): n is a, c, g, or t
tcagtcgtcgctcgcacgaccggtgctcgatttagtacgtcatcagggaagggctgagtgggttggccgtattggagcaaactacaattacgcgacaacatatgctgcgtcggtgaaggcaggttcaaccgtatctaccacgagatgacttccaaagtaacgacggtccgtatcttgacaangagcacgcctagaaaccgagganaccgtaccgtactatactggtcgactaacgacctaggtcggtactcgtaccgatacggttagacgttcgacccccgtgggggacccggtaaccgtcggtacacccgttcgtccgtcgtcccgttacgaacccaacgggccctaagtccgttaccttccccggtaggccgccctaggaccttcgacggacncctacgtaccgagacgnaacgcgcggttaccgcgggactcctcggtaggaccgtaaggacctttaccgttcccaacgtttcgtccgtaaccgtcgggtaacncggggtccgacgtaaccgtaggtaaccgcctttaaagtcgcggaancgattaagntcggnacgngacttancgnttacgnacgttnacgngancgtcncgtatagtacgtgacncgtntacgtacgtacgacgtagacgacgtacgtagtcg

SEQ ID NO: 110033 - DNA, 732 bp, Homo sapiens
  misc_feature: GYAE6OF02HT4T8.21.60.F05.1.454.CMB.1.raw
  modified_base (213)..(213): a, c, t, g, unknown or other
  misc_feature (213)..(213): n is a, c, g, or t
  modified_base (450)..(450): a, c, t, g, unknown or other
  misc_feature (450)..(450): n is a, c, g, or t
  modified_base (500)..(500): a, c, t, g, unknown or other
  misc_feature (500)..(500): n is a, c, g, or t
  modified_base (648)..(648): a, c, t, g, unknown or other
  misc_feature (648)..(648): n is a, c, g, or t
  modified_base (652)..(652): a, c, t, g, unknown or other
  misc_feature (652)..(652): n is a, c, g, or t
  modified_base (657)..(657): a, c, t, g, unknown or other
  misc_feature (657)..(657): n is a, c, g, or t
  modified_base (668)..(668): a, c, t, g, unknown or other
  misc_feature (668)..(668): n is a, c, g, or t
  modified_base (675)..(675): a, c, t, g, unknown or other
  misc_feature (675)..(675): n is a, c, g, or t
  modified_base (682)..(682): a, c, t, g, unknown or other
  misc_feature (682)..(682): n is a, c, g, or t
  modified_base (685)..(685): a, c, t, g, unknown or other
  misc_feature (685)..(685): n is a, c, g, or t
  modified_base (688)..(688): a, c, t, g, unknown or other
  misc_feature (688)..(688): n is a, c, g, or t
  modified_base (691)..(692): a, c, t, g, unknown or other
  misc_feature (691)..(692): n is a, c, g, or t
  modified_base (698)..(698): a, c, t, g, unknown or other
  misc_feature (698)..(698): n is a, c, g, or t
  modified_base (714)..(714): a, c, t, g, unknown or other
  misc_feature (714)..(714): n is a, c, g, or t
  modified_base (728)..(728): a, c, t, g, unknown or other
  misc_feature (728)..(728): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtggtagaaaggcaggttcaccatctccagagatgattacaaaagaacacggtactatctagaacaaatggaagccacgtaccgtaacggaaaaccggnggaccaccgggttacccgttattagtttaactggtactaccgtaacgtaacccgttaggttcgggaccttaccgggtacccggttaacgttaggggtttacgaaaccgggtttccccggacccccgggtacggggggggtaaccccgggtacccttgggtacccgtacccgttcctcccggtacccggcctaacccgaccggtacgggaccctagttcccggttacccctccccggnggtcccgtcccctggtaccctccgaaggacgcctacccgtacgaacgacncacggtccggccgtccgtacgggtactccggtaccgtaggtaacaacccggttacccttttcccgttaccccgtgttaacccgtcgtaccgggtgggtaaccggggtccggtaccggtacggacggtaacggccgtactaaggtacgnacgncgtangactcagcagngcgtacngtaccanacncgncgnngtagcngtacgcgtgagcgcgntagacgagagagtnagac

SEQ ID NO: 110034 - DNA, 554 bp, Homo sapiens
  misc_feature: GYAE6OF02H3QZV.21.60.F05.1.454.CMB.1.raw
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
  modified_base (416)..(416): a, c, t, g, unknown or other
  misc_feature (416)..(416): n is a, c, g, or t
  modified_base (482)..(482): a, c, t, g, unknown or other
  misc_feature (482)..(482): n is a, c, g, or t
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
  modified_base (515)..(515): a, c, t, g, unknown or other
  misc_feature (515)..(515): n is a, c, g, or t
  modified_base (518)..(554): a, c, t, g, unknown or other
  misc_feature (518)..(554): n is a, c, g, or t
tcagtcgtcgctcgcacgaccggtgctcgatttagtacgtcatcagggaaagggctggagtgggttggccgtattggaagcaaaactacaattacgcgacaacatatgctgcgtcggtgaaaggcaggttcaccatcctccagacgatgattacaaaagaacacggcgtatctgtacaaatgaagcaacgcctaacgaaaaccgaggacaccggccgttactaattcgtgtcgcgtagaccgtaggtcggtctcggtccgtagttggtagtaacggttcgacccccgggtgggggacccggtacctggtccaccgtctcgtcgccctcacgacgggcccagtccgtccttccccggtacccnccgtnccncgtacggncccgtacctacgagacgtccacggccgtacggtcccgngggacctgccgttagccgaaggtacccttcgttccccgttcgtactcctaacgtgggctacccggngttaccggacggtaaccgccgtntaangggtcnagnnnnnnnnnnnnnnnnnnnnnnnnnnnnnnnnnnnnn

SEQ ID NO: 110035 - DNA, 696 bp, Homo sapiens
  misc_feature: GYAE6OF02JRV7U.21.60.F05.1.454.CMB.1.raw
  modified_base (134)..(134): a, c, t, g, unknown or other
  misc_feature (134)..(134): n is a, c, g, or t
  modified_base (617)..(617): a, c, t, g, unknown or other
  misc_feature (617)..(617): n is a, c, g, or t
  modified_base (628)..(628): a, c, t, g, unknown or other
  misc_feature (628)..(628): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (650)..(650): a, c, t, g, unknown or other
  misc_feature (650)..(650): n is a, c, g, or t
  modified_base (654)..(654): a, c, t, g, unknown or other
  misc_feature (654)..(654): n is a, c, g, or t
  modified_base (659)..(659): a, c, t, g, unknown or other
  misc_feature (659)..(659): n is a, c, g, or t
  modified_base (663)..(663): a, c, t, g, unknown or other
  misc_feature (663)..(663): n is a, c, g, or t
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
  modified_base (670)..(671): a, c, t, g, unknown or other
  misc_feature (670)..(671): n is a, c, g, or t
  modified_base (673)..(673): a, c, t, g, unknown or other
  misc_feature (673)..(673): n is a, c, g, or t
  modified_base (676)..(676): a, c, t, g, unknown or other
  misc_feature (676)..(676): n is a, c, g, or t
  modified_base (678)..(679): a, c, t, g, unknown or other
  misc_feature (678)..(679): n is a, c, g, or t
  modified_base (681)..(681): a, c, t, g, unknown or other
  misc_feature (681)..(681): n is a, c, g, or t
  modified_base (683)..(684): a, c, t, g, unknown or other
  misc_feature (683)..(684): n is a, c, g, or t
  modified_base (689)..(689): a, c, t, g, unknown or other
  misc_feature (689)..(689): n is a, c, g, or t
  modified_base (691)..(691): a, c, t, g, unknown or other
  misc_feature (691)..(691): n is a, c, g, or t
  modified_base (693)..(694): a, c, t, g, unknown or other
  misc_feature (693)..(694): n is a, c, g, or t
tcagtcgtcgctcgcacgaccggtgctcgatttagtacgtcatcagggaaagggctggagtgggttggccgtattggaagcaaactaacaattacgcgacaacatatgctgcgtcggtgaaaggcaggttcacntcgtcagagatgacttcgaaacgaacacggcgtactctgacaatgacgcagcctagaaaaccgtggaccacggtcctctaacttacgtgtacgcgtacggtaccttacggtcgtccgtcgtaccgtacgtgggtttacgaacggtttcccgggaccccggtcggggggtacccgggtaacctttcgggtaccaccggttcctcccggttcgtaccctaccggtaaccggtaacggccctacggttcccggttaccctttccccggcggtaacccgtccgtacgtaccgttccggaacggcgaacccgtccgttaacggcgaaacttccgaacgtaccggtccggccgttacggggccttacggtccggtttaaacgggacggaaaacgtttaccggttaccgtttacccggggaaccgacggtaaaccgcggtaacgggaccgggtcggacgttacgggaccgaacggttcccgagttaacgnggcacgtgacncagcncncgcgacgcgcacgcncgcncgcgngacncncncgnngngcncnncncnncgcgngncnngc

SEQ ID NO: 110036 - DNA, 523 bp, Homo sapiens
  misc_feature: GYAE6OF02H6FMW.21.60.F05.1.454.CMB.1.raw
  modified_base (481)..(483): a, c, t, g, unknown or other
  misc_feature (481)..(483): n is a, c, g, or t
  modified_base (487)..(523): a, c, t, g, unknown or other
  misc_feature (487)..(523): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtcggtgaaaggcaggttcaccatctccagagatgattcaaaagaacacggcgtatctgcaaatgagcagcctagaaaaccgaggacacggccgtctattactgtgctagacctagtggctcgtccgactggttagaagttccgaccccctggggggacccggggaaccctggtccacccgtctccctcggcctcccaccaacgggccccagtccggtccttcccccctggcccgcccctgctccgaggacgccaccctccgagagcacgagccggcccgtgggcctggcctgggtaccaaggaccttaccttccctcgttcctccgtactggacggcgggcgtggaccgaagggccgacaagtacnnncgannnnnnnnnnnnnnnnnnnnnnnnnnnnnnnnnnnnn

SEQ ID NO: 110037 - DNA, 477 bp, Homo sapiens
  misc_feature: GYAE6OF02G5SZH.21.60.F05.1.454.CMB.1.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (230)..(230): a, c, t, g, unknown or other
  misc_feature (230)..(230): n is a, c, g, or t
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
  modified_base (316)..(316): a, c, t, g, unknown or other
  misc_feature (316)..(316): n is a, c, g, or t
  modified_base (330)..(330): a, c, t, g, unknown or other
  misc_feature (330)..(330): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
  modified_base (443)..(445): a, c, t, g, unknown or other
  misc_feature (443)..(445): n is a, c, g, or t
  modified_base (447)..(477): a, c, t, g, unknown or other
  misc_feature (447)..(477): n is a, c, g, or t
tcagtcgtcgctcgcacgaccggtgctcgatttagtacgtcatcagggaaagggcgtggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtntattactgtgctagcctaggngctcgtccagtgtgagttccgacccgtgggggccgggaacctggtcaccgtctccncgcctccaccgacgccntccgtcctccccnggccctcgctccgngcnccacctcgagcncacgacgccgcccgtggctgccgtggcaacggtcttaccttccctcgtccttctacgtagcggtacgggcgtcgggacgacgggtcaacgtnacgngnnngnnnnnnnnnnnnnnnnnnnnnnnnnnnnnnn

SEQ ID NO: 110038 - DNA, 633 bp, Homo sapiens
  misc_feature: GYAE6OF02F8AYV.21.60.F05.1.454.CMB.1.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (343)..(343): a, c, t, g, unknown or other
  misc_feature (343)..(343): n is a, c, g, or t
  modified_base (365)..(365): a, c, t, g, unknown or other
  misc_feature (365)..(365): n is a, c, g, or t
  modified_base (525)..(525): a, c, t, g, unknown or other
  misc_feature (525)..(525): n is a, c, g, or t
  modified_base (545)..(545): a, c, t, g, unknown or other
  misc_feature (545)..(545): n is a, c, g, or t
  modified_base (552)..(552): a, c, t, g, unknown or other
  misc_feature (552)..(552): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattacaaagaacacggcgtatctgacaaatgagcagcctagaaaaccgngacacggcgtntattactgtgctagacctaggtcgctcgtccgatggtagaacgttccgaccccgtggggggacccgggtaacctggtacctaccgtctccgtccggccctaccgaccgaacggcccagttccggtccttccccgnggcctcctcgctaccgaggacnccgaccgtccgaagcgaccacgacgtccggcccgtggggtcctcggtccgtaggtaccgaacggtaccttaccgttcccgtcgttacctcgttaccgtcgggacggtccgggtacgtacgggtaccggaacggtccggtacgtaaggttcggacgtgacnggactcgactagtcgcgtangctcgcncgcgtcgtgtcagtcgtacgtctcgtacgtacgtacgtgtacgtcgtacgacgtacgtcgtactacgtacgtacgtagtcg

SEQ ID NO: 110039 - DNA, 683 bp, Homo sapiens
  misc_feature: GYAE6OF02IWDQH.21.60.F05.1.454.CMB.1.raw
  modified_base (615)..(615): a, c, t, g, unknown or other
  misc_feature (615)..(615): n is a, c, g, or t
  modified_base (618)..(618): a, c, t, g, unknown or other
  misc_feature (618)..(618): n is a, c, g, or t
  modified_base (626)..(626): a, c, t, g, unknown or other
  misc_feature (626)..(626): n is a, c, g, or t
  modified_base (628)..(628): a, c, t, g, unknown or other
  misc_feature (628)..(628): n is a, c, g, or t
  modified_base (644)..(644): a, c, t, g, unknown or other
  misc_feature (644)..(644): n is a, c, g, or t
  modified_base (648)..(649): a, c, t, g, unknown or other
  misc_feature (648)..(649): n is a, c, g, or t
  modified_base (652)..(652): a, c, t, g, unknown or other
  misc_feature (652)..(652): n is a, c, g, or t
  modified_base (654)..(654): a, c, t, g, unknown or other
  misc_feature (654)..(654): n is a, c, g, or t
  modified_base (657)..(657): a, c, t, g, unknown or other
  misc_feature (657)..(657): n is a, c, g, or t
  modified_base (659)..(660): a, c, t, g, unknown or other
  misc_feature (659)..(660): n is a, c, g, or t
  modified_base (662)..(666): a, c, t, g, unknown or other
  misc_feature (662)..(666): n is a, c, g, or t
  modified_base (668)..(668): a, c, t, g, unknown or other
  misc_feature (668)..(668): n is a, c, g, or t
  modified_base (670)..(671): a, c, t, g, unknown or other
  misc_feature (670)..(671): n is a, c, g, or t
  modified_base (673)..(673): a, c, t, g, unknown or other
  misc_feature (673)..(673): n is a, c, g, or t
  modified_base (676)..(677): a, c, t, g, unknown or other
  misc_feature (676)..(677): n is a, c, g, or t
  modified_base (681)..(681): a, c, t, g, unknown or other
  misc_feature (681)..(681): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaaagaactcggcgtatctgcaaatgagccagtcctagaaaaccgaggacacggccgtactattactgtgctaggacctaggtcggcttccgtccgtacgttcgggttagtaacggtttccggacccccgtggggggaccccggggaacccgttggccgtacccgtccgtccgtcccgggtaccctccccgaaccgaaccggggccccgacgttccgggttccctttccccccggtcgggtcccggtccccgttcggccccgttaccggaacggggtaaccgccgtaccccggttccggaagaccgacctacgaaccggcccggtcccggtgggccgttcgccgtacggtacggaaacggccctttacccgttccccttacgttccttacgttacgttacggacggggtccgggaccgttcggggacccggaacggtccggtccgtaaacggttcggacttancgngcgtcgcncncgcgcgcgcgtacgcncgtnnctncncgngnngnnnnncncnncnganncgcntc

SEQ ID NO: 110040 - DNA, 572 bp, Homo sapiens
  misc_feature: GYAE6OF02GC5YY.21.60.F05.1.454.CMB.1.raw
  modified_base (199)..(199): a, c, t, g, unknown or other
  misc_feature (199)..(199): n is a, c, g, or t
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
  modified_base (533)..(535): a, c, t, g, unknown or other
  misc_feature (533)..(535): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (542)..(545): a, c, t, g, unknown or other
  misc_feature (542)..(545): n is a, c, g, or t
  modified_base (547)..(548): a, c, t, g, unknown or other
  misc_feature (547)..(548): n is a, c, g, or t
  modified_base (550)..(553): a, c, t, g, unknown or other
  misc_feature (550)..(553): n is a, c, g, or t
  modified_base (555)..(557): a, c, t, g, unknown or other
  misc_feature (555)..(557): n is a, c, g, or t
  modified_base (559)..(562): a, c, t, g, unknown or other
  misc_feature (559)..(562): n is a, c, g, or t
  modified_base (564)..(565): a, c, t, g, unknown or other
  misc_feature (564)..(565): n is a, c, g, or t
  modified_base (567)..(571): a, c, t, g, unknown or other
  misc_feature (567)..(571): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtcggtgaaaggcaggttcaccatctccaagagatgattcaaaagaacacggcgtatctgcaaaatgagcagcctagaaaaccgngacacggctctattacngtnctaagacctagtggctcgtaccgatggttagaacgttccgaacccgtggggggacccggggaaccctggtaccaccgtcctaccgtcggccctccaccgaacgggccctattccgggttccttaccccccgtgggaccgtcccctcggtacctaccgagggaccgcctaaccgtaccgaagtacgccaacgcggccggaccgtaggggcctcggcccggtaggtacccgaaagggtaccttacctttcccgtcgttcctactacgtaggacgtcgggctggacaaggccgacaacgtgcatgcagntgcngacnnncancncnnnncnncnnnnannncnnnncnncnnnnnc

SEQ ID NO: 110041 - DNA, 180 bp, Homo sapiens
  misc_feature: GYAE6OF01DQEOQ.18.5.A05.1.454.CMB.1.raw
  modified_base (178)..(180): a, c, t, g, unknown or other
  misc_feature (178)..(180): n is a, c, g, or t
tcagtacgagtatgcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnnn

SEQ ID NO: 110042 - DNA, 182 bp, Homo sapiens
  misc_feature: GYAE6OF01BFZLQ.18.5.A05.1.454.CMB.1.raw
  modified_base (177)..(182): a, c, t, g, unknown or other
  misc_feature (177)..(182): n is a, c, g, or t
tcagtacgagtatgcacgaccggtgctcgatttagatagatagacagggcgaccaagggcccatcggtcttcccctggcaccctcctccaagagcacctctgggcacagcggcctgggctgcctggtcaaggactacttccagtactctatctgagcgggctggcaaggcgcatagnnnnnn

SEQ ID NO: 110043 - DNA, 180 bp, Homo sapiens; identical to SEQ ID NO: 110041
  misc_feature: GYAE6OF01BHIDK.18.5.A05.1.454.CMB.1.raw
  modified_base (178)..(180): a, c, t, g, unknown or other
  misc_feature (178)..(180): n is a, c, g, or t

SEQ ID NO: 110044 - DNA, 471 bp, Homo sapiens
  misc_feature: GYAE6OF01C3LL5.18.5.A05.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (215)..(215): a, c, t, g, unknown or other
  misc_feature (215)..(215): n is a, c, g, or t
  modified_base (217)..(217): a, c, t, g, unknown or other
  misc_feature (217)..(217): n is a, c, g, or t
  modified_base (219)..(219): a, c, t, g, unknown or other
  misc_feature (219)..(219): n is a, c, g, or t
  modified_base (221)..(221): a, c, t, g, unknown or other
  misc_feature (221)..(221): n is a, c, g, or t
  modified_base (223)..(223): a, c, t, g, unknown or other
  misc_feature (223)..(223): n is a, c, g, or t
  modified_base (226)..(228): a, c, t, g, unknown or other
  misc_feature (226)..(228): n is a, c, g, or t
  modified_base (232)..(232): a, c, t, g, unknown or other
  misc_feature (232)..(232): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
  modified_base (320)..(324): a, c, t, g, unknown or other
  misc_feature (320)..(324): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (391)..(391): a, c, t, g, unknown or other
  misc_feature (391)..(391): n is a, c, g, or t
  modified_base (455)..(455): a, c, t, g, unknown or other
  misc_feature (455)..(455): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
tcagtacgagtatgcacgaccggtgctcgatttagatagatagacgaaggggcaccgaagggccatcggtcttcccctggcaccctcctccaacgacgcacctcgtggggcacagcggcctgggctgcctcggtcaaggactacgttccgagtactctactcgtgacgcgggctaggcaaggcgcaattggcanctgctnaganacacacncncnananananatnnngtcngagntatacncgcncgagtntncnctcncncncncncntcgcacgcncncncgcagngngngcngtagtntgagcgacntatatatannnnnanatatacganacgagacgacancgacgtcgtgtacgacgacgacgacgcgcgccgtacgtcgctcnccgtcgccgtcgtccgacgtactactcgtcgtcgtcgtcgtcgtcgacgacgcgagacgcgcgngacgacgcancngngn

SEQ ID NO: 110045 - DNA, 199 bp, Homo sapiens
  misc_feature: GYAE6OF01C4O7U.18.5.A05.1.454.CMB.1.raw
  modified_base (180)..(199): a, c, t, g, unknown or other
  misc_feature (180)..(199): n is a, c, g, or t
tcagtacgagtatgcacgaccggtgctcgatttagatagatagacagggcaccgaagggcccatcggtcttccccctggcaccctcctccaagagcacctctggggcacagcggccctgggctgcctggtcaaggactacttccagtactctatctgagcgggctggcaaggcgcatagnnnnnnnnnnnnnnnnnnnn

SEQ ID NO: 110046 - DNA, 178 bp, Homo sapiens
  misc_feature: GYAE6OF01EUVQG.18.5.A05.1.454.CMB.1.raw
  modified_base (178)..(178): a, c, t, g, unknown or other
  misc_feature (178)..(178): n is a, c, g, or t
tcagtacgagtatgcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagn

SEQ ID NO: 110047 - DNA, 219 bp, Homo sapiens
  misc_feature: GYAE6OF01CFRU4.18.5.A05.1.454.CMB.1.raw
  modified_base (186)..(191): a, c, t, g, unknown or other
  misc_feature (186)..(191): n is a, c, g, or t
  modified_base (193)..(219): a, c, t, g, unknown or other
  misc_feature (193)..(219): n is a, c, g, or t
tcagtacgagtatgcacgaccggtgctcgatttagatagatagacagggcaccgaagggcccatcggtcttccccctggcaccctcctccaacgagcacctctgggggccacgagcggccctggcctgcctggtcaaggactacgttccagtactctatctggagcgggctggcaaggcgcatagnnnnnncnnnnnnnnnnnnnnnnnnnnnnnnnnn

SEQ ID NO: 110048 - DNA, 180 bp, Homo sapiens; identical to SEQ ID NO: 110041
  misc_feature: GYAE6OF01BKL5B.18.5.A05.1.454.CMB.1.raw
  modified_base (178)..(180): a, c, t, g, unknown or other
  misc_feature (178)..(180): n is a, c, g, or t

SEQ ID NO: 110049 - DNA, 183 bp, Homo sapiens
  misc_feature: GYAE6OF01BH564.18.5.A05.1.454.CMB.1.raw
  modified_base (178)..(183): a, c, t, g, unknown or other
  misc_feature (178)..(183): n is a, c, g, or t
tcagtacgagtatgcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnnnnnn

SEQ ID NO: 110050 - DNA, 185 bp, Homo sapiens
  misc_feature: GYAE6OF01ARKRH.18.5.A05.1.454.CMB.1.raw
  modified_base (178)..(185): a, c, t, g, unknown or other
  misc_feature (178)..(185): n is a, c, g, or t
tcagtacgagtatgcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnnnnnnnn

SEQ ID NO: 110051 - DNA, 179 bp, Homo sapiens
  misc_feature: GYAE6OF02GP1UA.18.5.A05.1.454.CMB.1.raw
  modified_base (178)..(179): a, c, t, g, unknown or other
  misc_feature (178)..(179): n is a, c, g, or t
tcagtacgagtatgcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnn

SEQ ID NO: 110052 - DNA, 181 bp, Homo sapiens
  misc_feature: GYAE6OF02IDDWA.18.5.A05.1.454.CMB.1.raw
  modified_base (179)..(181): a, c, t, g, unknown or other
  misc_feature (179)..(181): n is a, c, g, or t
tcagtacgagtatgcacgaccggtgctcgatttagatagatagacagggcaccaagggcccatcggtcttcccctggcaccctcctccaagagcacctctgggggcacagcggccctgggctgcctggtcaaggactacttccagtactctatctgagcgggctggcaaggcgcatagnnn

SEQ ID NO: 110053 - DNA, 199 bp, Homo sapiens
  misc_feature: GYAE6OF02GA420.18.5.A05.1.454.CMB.1.raw
  modified_base (179)..(199): a, c, t, g, unknown or other
  misc_feature (179)..(199): n is a, c, g, or t
tcagtacgagtatgcacgaccggtgctcgatttagatagatagacagggcaccaagggcccatcggtcttccccctggcaccctcctccaagacgcacctctggggcacagcggccctgggctgcctggtcaaggactacttccagtactctatctgagcggctggcaaggcgcatagnnnnnnnnnnnnnnnnnnnnn

SEQ ID NO: 110054 - DNA, 178 bp, Homo sapiens; identical to SEQ ID NO: 110046
  misc_feature: GYAE6OF02IN6KZ.18.5.A05.1.454.CMB.1.raw
  modified_base (178)..(178): a, c, t, g, unknown or other
  misc_feature (178)..(178): n is a, c, g, or t

SEQ ID NO: 110055 - DNA, 182 bp, Homo sapiens
  misc_feature: GYAE6OF02IIA85.18.5.A05.1.454.CMB.1.raw
  modified_base (177)..(182): a, c, t, g, unknown or other
  misc_feature (177)..(182): n is a, c, g, or t
tcagtacgagtatgcacgaccggtgctcgatttagatagatagacagggcaccaagggcccatcggtcttcccctggcacctcctccaagagcacctctggggcacagcggccctgggctgcctggtcaaggactacttccagtactctatctgagcgggctggcaaggcgcatagnnnnnn

SEQ ID NO: 110056 - DNA, 195 bp, Homo sapiens
  misc_feature: GYAE6OF02I7V3C.18.5.A05.1.454.CMB.1.raw
  modified_base (181)..(195): a, c, t, g, unknown or other
  misc_feature (181)..(195): n is a, c, g, or t
tcagtacgagtatgcacgaccggtgctcgatttagatagatagacagggcgaccaagggcccatcggtcttccccgtggcaccctcctccaagagcacctctggggcacagcggcctgggctcgcctggtcaaggactacttccagtactctagtctgagcgggctggcaaggcgcatagnnnnnnnnnnnnnnn

SEQ ID NO: 110057 - DNA, 493 bp, Homo sapiens
  misc_feature: GYAE6OF01EXA8W.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacggatccctgatcgttttcagggtccagctcgtgggctgagcgctacctcaccatctccagcctccagtctgagatgaggctgactattactgtcagacctggggcacgtggttatgttggtttcggcggtagggacaaggctggaccgtccgtaggtcagcccaaggcctccgg

SEQ ID NO: 110058 - DNA, 529 bp, Homo sapiens
  misc_feature: GYAE6OF01DBCFA.10.28.C06.1.454.CMB.1.raw
  modified_base (336)..(336): a, c, t, g, unknown or other
  misc_feature (336)..(336): n is a, c, g, or t
tcagcatagtagtgcacgaccggtgctcgatttagagctcacgtattgggtttgggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagtacccaggcaaagcccccaaactgatgatttatgatgtcagtaatcgaccctcagggtttctgatcgnttctttgcctccaagtctggcaacacggcctccctgaccatctctgggctccagactgaggacgagctgattattactgcagctcacatacaagcgcagcggttgggtgttcggcgggggaccacgacgtgaccgtccgtacggtcacggcccgaaggctacgccccctcggtccacttccgtcgttcccccg

SEQ ID NO: 110059 - DNA, 502 bp, Homo sapiens
  misc_feature: GYAE6OF01BU4Z2.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacggatccctgatcgttttcaggtccagctcgtgggctgagcgctacctcaccatctccagcctccagtctgagatgaggctgactattactgtcagaccgtgggcacgtggttatggttggtttcggcgggtacgggaccaaggctcggacccgttccgtaggtcacggcccaaggcctcccgg

SEQ ID NO: 110060 - DNA, 504 bp, Homo sapiens
  misc_feature: GYAE6OF01EBGT6.10.28.C06.1.454.CMB.1.raw
  modified_base (388)..(388): a, c, t, g, unknown or other
  misc_feature (388)..(388): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctggtacttgatgaaggttacagtgatggcagccacaccgaaggggacggatccctgatcgttttcaggtccagctcgtggggctggagcgctacctcaccatctccagcctccagtcngagatgaggctgactattactgtcagacctggggcacgtggttatgttgggtttcggcgggagggaccaaggtctaggacccgtccgtaggtcgaagccccgaaggccgtacccgg

SEQ ID NO: 110061 - DNA, 506 bp, Homo sapiens
  misc_feature: GYAE6OF01DC8DZ.10.28.C06.1.454.CMB.1.raw
  modified_base (375)..(375): a, c, t, g, unknown or other
  misc_feature (375)..(375): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatagaaggttaacagtgatggcagccacgaccgaaggggacggatcccgtgatcgttttcgaggtccagctcgtgggctgagcgctacctcaccntctccagcctccagtctgaggatggagctgactattactgtcagaccgtggggctagtggttatggttgggtttcggcgggagggaccaggctacggacccgtcgtacggtcagcccgaaggccgtcccgg

SEQ ID NO: 110062 - DNA, 549 bp, Homo sapiens
  misc_feature: GYAE6OF01EICNI.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctcccgtgggagcctcggtcaagctcatctgcactctgagcagtgggcacagcaactacgccatcgcatggcatcagcagcagccagagaacggcctcggtactgatgaagttaacagtgatgcagccacgacgaaggggacggatcccgtgacgttcgttttcgagggtccagctcggtggggctggacgcgcctacctcacctatcctccagccctccagtctggaggatggagtctagtactattactgtcacgtaccgtgggctacgttggttagttggttgggtttacgggcgggtacgggaccgtaaggtccgttacggacccgttaccgtacggtaccaacggccccgtaagggtcccgtaccccgg

SEQ ID NO: 110063 - DNA, 555 bp, Homo sapiens
  misc_feature: GYAE6OF01BX9AM.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctcgcctctgccctcccgtgggacgcctcggtacaagctcatctgcactctgagcaggtggcacagcaaactcgccatcgcatggcatcgagcagcagccagagaacggcctggtactgatgaaggtacagtgatgcagcagacggaaggggacgactcctgtacttcgtttcgagggtccagtcgtcgtgggctgacgcgtctaactcaccatctccgacgtcctcgagttccaggacggtatacggacggtctacggtactaattacgtcgtacgacggaccggtgggacctagttggttagttggttcgggtttcggacgggtacggaccgaaggtcgtacgacccggttacgtacggaccaaggtcccgaagggtccgtaccccgg

SEQ ID NO: 110064 - DNA, 518 bp, Homo sapiens
  misc_feature: GYAE6OF01D06C7.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacaccatcgcatggcatcagcagcagccagagaagggccctcggtacttgatgaaggttaacagtgatggcagccacaccgaaggggacggatccctgatcgttttcagggtcagctcgtgggctgagcgctacctcaccatctccagtcctcagtctgagatggagctagactattactgtacgagaccgtggggcacgttggttattggttggttttcgtggtcgggagggtaccgaaggccgtaggacccgttccgtacgggtaccacggcccgaacgggtcccg

SEQ ID NO: 110065 - DNA, 516 bp, Homo sapiens
  misc_feature: GYAE6OF01EFA0R.10.28.C06.1.454.CMB.1.raw
  modified_base (406)..(406): a, c, t, g, unknown or other
  misc_feature (406)..(406): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggcctcggtacttgatgaaggttaacagtgatggcagccacaccgaaggggacggatccctgatcgttttcaggtcagctcgtgggctgagcgctacctcacatctccagcctccagtctgaggatgagctgactattacngtcagtaccgtggggactacgttggttatggttgggtttcggcgggtacgggtaccaaggtcgtacggacccgttccgtacgggtacacggcccgtaaggccgtacccgg

SEQ ID NO: 110066 - DNA, 505 bp, Homo sapiens
  misc_feature: GYAE6OF01B0OGM.10.28.C06.1.454.CMB.1.raw
  modified_base (403)..(403): a, c, t, g, unknown or other
  misc_feature (403)..(403): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacggatccctgatcgttttcaggtccagctcgtgggctgagcgctacctcaccatctccagcctccagtctgagatgagctgactnttactgtcagaccgtggggctacgtggttatggttcgggttttcgggcgggtagggaccaaggccgtggacccgtcgtaggtcaggcccaagggcctcccgg

SEQ ID NO: 110067 - DNA, 581 bp, Homo sapiens
  misc_feature: GYAE6OF01AZB87.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctggctcaatcgccctctgcctctgccctccctgggagcctcggtcaagctcatctgcactctgagcagtggcacagcaactacgccatcgcatggcatcagcagcagccagaggaacgggccctcggtactgatgaaggttaacagtgatggcagccaacgaccgaaggggacggactcccgtagtacgttcggttttcgacgggtccaggtccgttcggtggggcctggacgccgtacgtaccctccacctactccctaccgacgtccctaccgacgtccgtaggaggactggacggtctacgtacttacgttacgtagtcgacgtacggtcgggactagtggttagtggttcggttacggacgggtacggtacgacggtcgtaccggtaccgttcggtacggtaccgacgtacccgcggtcgtacccccg

SEQ ID NO: 110068 - DNA, 512 bp, Homo sapiens
  misc_feature: GYAE6OF01BSPA5.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatagaaggttaacattgatggcagccacacgaaggggacggatcccgtgatcgttttcgaggtccagctcgtgggctgagcgctacctcacactctccacgcctccagtctgaggatggagctgactattactgtcagaccgtgggcacgttggttatggttcgggtttcggcgggtagggtaccaaggtcgtacggaccgttccgtaggtcacgcccgaagggtctcccgg

SEQ ID NO: 110069 - DNA, 557 bp, Homo sapiens
  misc_feature: GYAE6OF01EIS87.10.28.C06.1.454.CMB.1.raw
tcagcatagtagtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggcctcggtactgatgaagttacagtgatggcagcacgacgaaggggacggatccctgacgttcgttttcgaggtccagctcggtgggctgacgcgctacctcaccatcctccacgtcctaccagtccgtggaggatggacggctgacttagttactgtacgacgtaccgtcggggtactacggttggttacgttgggttcgggtttcgggcgggtaacgggacctaacggtccgtacggtacccgttaccggtacggtaccgaccggtcccgaacggtccggtaccccgg

SEQ ID NO: 110070 - DNA, 521 bp, Homo sapiens
  misc_feature: GYAE6OF01BKC64.10.28.C06.1.454.CMB.1.raw
  modified_base (355)..(355): a, c, t, g, unknown or other
  misc_feature (355)..(355): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggcctcggtactgatgaaggttaacagtgatggcacgccaacgaccgaaggggacggatccctgattcgttttcgaggtccaacgtcgngggctggagcgctacctcaccatctccacgccctcagtcgtgaggatgaggtctgacttattactgtacgagtaccgtgggctacgttggttatggttgggtttcgggtggacgggtacaaggtcgtcggaccgtcgtaggtcacgacccaaggcctccgtccccg

SEQ ID NO: 110071 - DNA, 553 bp, Homo sapiens
  misc_feature: GYAE6OF01EDG91.10.28.C06.1.454.CMB.1.raw
  modified_base (306)..(306): a, c, t, g, unknown or other
  misc_feature (306)..(306): n is a, c, g, or t
  modified_base (334)..(334): a, c, t, g, unknown or other
  misc_feature (334)..(334): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (533)..(533): a, c, t, g, unknown or other
  misc_feature (533)..(533): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggacaaacgcccccaaactgatgatttangatgtcagtaatcgacctgagggtttcngatcgtcttcttcgcctcaagtctgcaacncgcctccngaccatctcgtcggctccagactgacggacgagctgtattattactgcagctacacatacgaacgcggcgaggtcgggttgggtcggttcggggcggggaccacgacgtcggtacccgtcgtacggtcacggcccgaacggctcccgtccccgtcggtccnccgttcgtccggttcccccg

SEQ ID NO: 110072 - DNA, 560 bp, Homo sapiens
  misc_feature: GYAE6OF01AV01J.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggcctcggtacttgatgaaggttaacagtgatggacagccacgaccgaaggggacggactcccgtgtagttcgttttcgacgggtccagctcgtggggctggagcgcctacctcacctatcctccacgtccctccacgtctggaggagtggacggtctgacttattactgtcacggtaccgtggggactacgttggttaagtggtttcgggtttccgggacgggtacgggtaccgaggtcgtacggtacccgttccgtacgggtaccgacggcccgaacgggtcctaccccggg

SEQ ID NO: 110073 - DNA, 581 bp, Homo sapiens
  misc_feature: GYAE6OF01ELEBI.10.28.C06.1.454.CMB.1.raw
  modified_base (369)..(369): a, c, t, g, unknown or other
  misc_feature (369)..(369): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaaggccctcggtactgatgaaggttacagtgatggcagccaacaccgaagggggacggatcccgtgattcgttttcgaggtccagctcgtgggctgagcgctacccncaccatcctccacgcctccagtctgaggatggaggctagtactagttactgtacgacggtaccgtgggactacggttggttagttcgggtttacgggtttccgggacgggtaacgggtaacccgaaacggtccgttaccgggtaaccccggttaccggttaacgggtacccgaacccgggacccccgtaaggggtccccgttaccccccggg

SEQ ID NO: 110074 - DNA, 685 bp, Homo sapiens
  misc_feature: GYAE6OF01CU8HL.10.28.C06.1.454.CMB.1.raw
tcagcatagtagtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatcgccctctgcctctgcctcccgtgggacgcctcggtcaagctcatctgcactctgagcaggtgggcacagcaactcgccatcgcatggcatcagcagcagccagaggaacgggccctcggtactgataggtaaaggttaacgagtgagtggacacgaccaacgaaccggaagggggacggactcccgtagtacgtttcgttttcgacgggtccaggtccgtcggtggggtcgtaggacggtccgtacccttacccgtccaaccctacgtccctaccgacgtcccctaccgtacgtccgtaggaacggtacgtaggtacgggtaccttacggtaacgtttaacgttaaccgttcggtaaccgtaccggtaccggttacggggtaccgtacggtttagggtttaggttgggtttcggggttttaccggggaccggggtaacgggtaaccgtaacgggtccgtacgggtaccccggttacggttacgggtaccgtaccggaccccggtaacggtcccgttacccccggg

SEQ ID NO: 110075 - DNA, 729 bp, Homo sapiens
  misc_feature: GYAE6OF01AQ4KR.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctccctgggagcctcggtcaagctcatctgcactctgagcagtgggcacagcaactcgccatcgcatggcatcagcagcagccagagaagggcacgtcggtacttgatgaaggttaacagtgagtggcagccaacgaccggaagggggacggactcccgtgtacttcggtttttacgacgggtccagtcgtcggtcgggggtctggacggccggtaccttaccccgtaccaacccgtaacttcccgtacccgaccggtcccccttacccgtaacggttccgttacgggaacgggtacgttacgggaacgggtccttacggtaacccgtttaacttttacccgtacgggttacccgtaaccgggtaaccccggttcggggggtacccttaaccggtttggggtttaacgtttcggggttttacggggggtttttaccgggggaccggggttaacgggggtaaccccgtaaacgggtaccccgttacgggtaacccccggttacccggttaacggggtacccgaaccgggtacccccggtaaacggggtcccccgg

SEQ ID NO: 110076 - DNA, 779 bp, Homo sapiens
  misc_feature: GYAE6OF01CXZT5.10.28.C06.1.454.CMB.1.raw
  modified_base (511)..(511): a, c, t, g, unknown or other
  misc_feature (511)..(511): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctcgcctctcgccctcccgtgggacgcctcggtcaagctcatctgccactcgtagacgcgaggtcgggaccaacgacgacctaaaccgtaccggcccaatccggacaagtcggacaacgtacgacggacaacggaccgaacggacccgaaggaacgggaaaccggggtccccgttacgggttaaccgttaggaacgttaagggtaaacggtttaacgaggtagaaggtcggaccgacggacccgaacggaaccggaagggggaccgtacgtcccgtaggttacgtttcggtttacggacggttcctaggtccgtagggtcgggtactacggacgccgtacctaccncctacctactcctaccgacgtcctacgtacggtccgtagggacgtacgtacgggacgtaccgtacgtaacttaacgtttaccggtacggtaccgtaccggtaccggtcggggtaccttacgggtttacgggtttacggtttccggggtttacggggtttacccggggacgggtaaccggggtaaccgtaacggtccggtaaccgggtaccccgttacggtaccggtaccggtacccggacccgggtaccgtcccggttaccccccggg

SEQ ID NO: 110077 - DNA, 546 bp, Homo sapiens
  misc_feature: GYAE6OF01BUJGD.10.28.C06.1.454.CMB.1.raw
  modified_base (305)..(305): a, c, t, g, unknown or other
  misc_feature (305)..(305): n is a, c, g, or t
  modified_base (374)..(374): a, c, t, g, unknown or other
  misc_feature (374)..(374): n is a, c, g, or t
  modified_base (528)..(528): a, c, t, g, unknown or other
  misc_feature (528)..(528): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaacgcccccaaatgatgatttangatgtcagtaatcgaccctgaggggtttctgatcgctttcttgcctcaagtctggcaacgacgcctccngaccatctcgtggctccagactgaggacgaggctagattattactgcagctacacatacgaagcggcgaggtcgggttgggtcggtcgggcggggaccacgacgtcggacccgtcgtacggtcacgcccgaacggcctccgccccgtcggtccnccttccgtcgttaccccc

SEQ ID NO: 110078 - DNA, 682 bp, Homo sapiens
  misc_feature: GYAE6OF01C639O.10.28.C06.1.454.CMB.1.raw
  modified_base (436)..(436): a, c, t, g, unknown or other
  misc_feature (436)..(436): n is a, c, g, or t
tcagcatagtagtgcacgaccggtgctcgatttagagctcacgtattggggtttgggggagagctctggggagtctgcaccatggcttggaccccactcctcttcctcaccctcctcctccactgcacagggtctctctcccagcttgtgctgactcaatccgccctctgcctctcgccctcccgtgggacgcctcgggtcaaacgctcatctgcactctgagcaggtgggcacagacaaactacgccatcgcagtggacatcagcagacgacgccgaaggaacggaacgggcccttacgggttacttgaagtaggtaaaggttaacaggtgagtgggaccagaccgaacgaaccgggaaagggggaccggaactcccgtagtacgtttccggttttacgacggtcagcgtcggtgggctaggacgcgacctaccncacctacgtcctaccacgcctacgacgtcgtagacggtacgtggacgtgtacgaacgtttaagttactcggtacgaacgggtaaccggtggggtaccctaaggtttcgggtttaaggttcggggtttacgggtttacggggaaccggggtaacggggaacccgtaacggtccggttaaccgggtaccccggttaccgtacgggtaccgtacccgggtacccggaaaccggttcccgtacccccggg

SEQ ID NO: 110079 - DNA, 508 bp, Homo sapiens
  misc_feature: GYAE6OF01B1TLQ.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacggatcccgtgatcgttttcagggtccagcgtcgtgggctgagcgctacctcaccatctccagcctccagtctgagatgagctgactattactgtcagaccgtggggctacgttggttagtggttggtttcgggcggtacgggaccaaggtcgtcggaccgtccgtaggtcacgcccgaggtcctcccgg

SEQ ID NO: 110080 - DNA, 809 bp, Homo sapiens
  misc_feature: GYAE6OF01B6OUF.10.28.C06.1.454.CMB.1.raw
tcagcatagtagtgcacgaccggtgctcgatttagagctcacgtattgggtttggggagagctcgtggggagtctgcaccatggcttggaccccactcctcttcctcaccctcctcctccactgcacagggtctctctcccagcttgtgctgactcaatccgccctctcgcctctcgccctccgtgggacgcctcggtcaagctcatctgcactcgtgagcgaggtcggacaacagaccaaccgtacgacctagtcgacagtcggactagtacgacggacaggaccacggaccgaaggaacgggtaaaccggggtccccgttacgggttaaccgtttacggaagttaacggggtaaaaggtttaaaccaggttacgaacggtcgggaccgaaacggaccccgaaaacgggaacccgggggtaaaggggggtaccggtaaccttccccgggttaggttaaccgttttccgggtttttaccggaacggggttacccgtaacggtccggtttacggggtacgggggtccttacgggaacccggtaccccggtaccctttaacccgtaccgtaaccccgtacgttaccccgtaacccgtaccgtaccccgttaccgtacggttcgtacgggtaggtacgtagggaacggtctaacgttactttacgtacgtcggtaacgtacgggaccgttacgggtaccttagggttacgtttggtcgggttacgggttacgggaacggtaacggtaccgtaacggtcgtaccggtccggttacggtacggaccgaaccggtaccgacggtcccgtacccgg

SEQ ID NO: 110081 - DNA, 707 bp, Homo sapiens
  misc_feature: GYAE6OF01DTGBI.10.28.C06.1.454.CMB.1.raw
tcagcatagtagtgcacgaccggtgctcgatttagagctcacgtattggggtttggggagagctctggggagtctgcaccatggcttggaccccactcctcttcctcaccctcctcctccactgcacagggtctctctcccagcttgtgctgactcaatccgccctctgcctctcgccctcccgtggggacgccgtcggtcaagctcatctgcactctgagcaggtggcacagcaactacgccatcgcagtggcatcagcagcacgccgaaggacggaacgggtcccgtacgggttacttggaagtaggtaaacggttaacgagtagaagtcggacacgaccaacggaaccgggaacgggggaccggtactcccgtagtacgtttcggttttacgacgggtcacgtcgttcggtcggggtctaggacgccgtaccgtaccctaccaaccgtacttcctaccgacgtccctaccgtacgtcgtacgggaggtacgtaggtacggtcgttacgtaacttaacgttacgttacggtacgtacggtaccgggtacgggtacgttacggttaggtttacggtttgggttacggggttttaccggggacggggtaaccgggtaacccggtaaggttccggttaccgggtaacccggttaccggtaacgggtacccgaacccgggtacccggtaacgggtcccgtacccccggg

SEQ ID NO: 110082 - DNA, 567 bp, Homo sapiens
  misc_feature: GYAE6OF01ARGQ5.10.28.C06.1.454.CMB.1.raw
  modified_base (333)..(333): a, c, t, g, unknown or other
  misc_feature (333)..(333): n is a, c, g, or t
  modified_base (366)..(366): a, c, t, g, unknown or other
  misc_feature (366)..(366): n is a, c, g, or t
  modified_base (428)..(428): a, c, t, g, unknown or other
  misc_feature (428)..(428): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaatgatgatttatgatgtcagtaatcgaccctcgagggtttcngactcgcttctttcgcctccaagtctggcaacncggcctccctgaccatctcgtgggctccgagacgtgagggacgaggtctagtattacttacngcagctcacatacaagcggcgacggtcgggttgggtggttccggggacgggggtaccacggaccgtcggtacccgtaccgtacggtacacggcccgacggtctccgcccccgtcggtccaccgttcgtccgttcccccg

SEQ ID NO: 110083 - DNA, 804 bp, Homo sapiens
  misc_feature: GYAE6OF01CW1BH.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgccctcccgtggggacgcccgtcggtacaagctcatctgcactcgtgagcaggtcgggacaacgacgaccaaaccgtaccgacctaagtccgaccgtaagtcgggacctaactaccgaacgaccgaacggaccgaacggaccgaaacgggaaccgggaaaccggggtccccgttaacgggttaccgttaggtaagttaacgggtaaaacggtttaaacgaggttacgtaacggtacgggaccaaccggaaccccgaacggaaacccgggggaaacggggggtaaccggtaacgttacccggttaggttacgttttaccggttttaccggacggttaccgtacggtcggttcgggtcgggtcgtaggaccgtccggtacctaccgtacacctacgtaccctccgaccgtacccttacgacgttccgtaggacggtacgtagggtacggtacgtacgtaactttacgttacgtcggtaccgacgtaccggtgggtaccttaggttcggttaggttcggggttcgggtttacggggacggggtaacgggtaaccgtacggtaccgttccggtaacccggttccggtaacggtacccgaacccggacccggtaaccgggtccccgtacccccggg

SEQ ID NO: 110084 - DNA, 644 bp, Homo sapiens
  misc_feature: GYAE6OF01EKVB4.10.28.C06.1.454.CMB.1.raw
  modified_base (187)..(187): a, c, t, g, unknown or other
  misc_feature (187)..(187): n is a, c, g, or t
  modified_base (370)..(370): a, c, t, g, unknown or other
  misc_feature (370)..(370): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctcccgtggggancctcggtcaagctcatctgcactctgagcagtggcacagcaactacgccatcgcagtggcatcagcagcagccagaggaacggccctggtacttgataggaaggttacagtgatggcagaccaacgaccggaaggggtacggatcccgtagtacgtttcgttttcgacgggtccagtcgtcgnggggtctaggacgccgtacctaccctccaacctacttcctacccgaacgtcctacccgagttccgtaaggaggaagttcggagtcctaagacgtttaacttaactcggtaccgtacgtaccggttcggggactacggtttaggttacggttcgggttttcggggtttaccggggacgggtaaaccggggtaaccaacgggttccgtaccggggtaaccccgttaccggtacggttaaccgacccggtaccccgtaacgggtcccgtacccccgg

SEQ ID NO: 110085 - DNA, 664 bp, Homo sapiens
  misc_feature: GYAE6OF01AY2NX.10.28.C06.1.454.CMB.1.raw
tcagcatagtagtgcacgaccggtgctcgatttagagctcacgtattgggtttggggagaggctctggggagtctgcaccatggcttggacccgactcctctcctcacctcctcctccactgcacacggtctctctcccagcttgtgctgactcaatcgcctctgcctctcgcctcccgtgggacgtcctcggtcaagtctcatctagccacgtcgtcgacgcagtcgggcacgagcaactacgccaatcgcagtggcactcacgcacgtcacgtccgaggacgaacgggtccgtcggtactagacgtacggaacggttaacgagtcgagtcggacacgtccgaacgaccggaacggggtaccgtacgtcccgtaggtacgttaccggttttacgacgggtaccgacggtcgtacggtcggggtactacgggtacggtccgtaccgtaccgtaccgacctacgttaccctaccgacgtccttaccgtacgttccgtacggacgtacgtggacgtacgtacgtaacttacgtacgtgtacgtacggtaccggtgggtacgtacgtggttacgtcggttcggttcgggacggtacggtacgacggtccgtacggtacccgttccgtaacggtacccgtaacggtacccgtacggtccgtaccccgg

SEQ ID NO: 110086 - DNA, 683 bp, Homo sapiens
  misc_feature: GYAE6OF01CCKH4.10.28.C06.1.454.CMB.1.raw
tcagcatagtagtgcacgaccggtgctcgatttagagctcacgtattgggtttggggagagctctggggagtctgcaccatggcttggaccccactcctcttccctcaccctcctcctccactgcacagggtctctctcccagcttgtgctgactcaatcgccctctgcctctcgccctcccgtgggacgcctcggtcaagctcatctgcactctgagcagtgggcacagcaactacgccatcgcatggcatcagcagcagccagagaacgggcctacggtacttgactagaaaggttaacagtagaatggacacgacccaacgaaccggaagggggacggacgtcccgtaggtactttcgttttacgacgggtcacgtcgtcggtcggggctagggacgccggtactaccgtccaccgtactccgtccaacgtcccctcgacgtccgttaggaggtacgtggacggtcgtacgtaacttaacgtttaaccgtcggtaaccgtaacggtacccgggttcggggaccttaaccggtttagggtttaacggtttcggggtttaccgggttttcggggaaccggggttaaccgggtaaccgtaacgggtcccgttacgggaccccgttaccggtaacgggttacccgaaccgggtacccccgtaaagggtccccgttacccccggg

SEQ ID NO: 110087 - DNA, 545 bp, Homo sapiens
  misc_feature: GYAE6OF01BZZQ2.10.28.C06.1.454.CMB.1.raw
  modified_base (536)..(536): a, c, t, g, unknown or other
  misc_feature (536)..(536): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaacgcccccaaactgatgatttatgatgtcagtaatcgaccctcaggggtttctgatcgcttcttgcctcaagtctggcaacacggcctcctgaccatctctgggctccagactgaggacgaggctgattattactgcagcgcatattcacggccccaagagggttgtttgggcggcgggactaagggtcgaccgtccgtgggtccacgcccgaaggcctccggccccctcggtccaccttcctccgttcccccncccttcccc

SEQ ID NO: 110088 - DNA, 538 bp, Homo sapiens
  misc_feature: GYAE6OF01CABVH.10.28.C06.1.454.CMB.1.raw
tcagcatagtagtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgatggaaggttaacaggtgatggcagccacgaccgaaggggacggactcccgtgacttcggttttcgagggtccagcgtcgtgggctgacgcgctacctcaccactcctccacgcctccagtctgaggatggaggctagacttattactgtacgagtaccgtgggactacgttggttacgtggttcgggtttacgggcggtacgggaccaaggtcgtacggacccgtccgtacggtcaagcccgaaggccgtcccgg

SEQ ID NO: 110089 - DNA, 553 bp, Homo sapiens
  misc_feature: GYAE6OF01CPRVR.10.28.C06.1.454.CMB.1.raw
  modified_base (246)..(246): a, c, t, g, unknown or other
  misc_feature (246)..(246): n is a, c, g, or t
tcagcatagtagtgcacgaccggtgctcgatttagagctcacgtattggggtttggggggggtctcaggaggcgaccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggaatangatatgtctcctggtaccaacagtacccaggcaaacgcccccaaactgatgatttatgatgtcagtaatcgaccctcgaggggtttctgatcgtcttctttcgcctcaagtctgcaacgcggtccctcctgaccatctctcggctccagactgaggacgaggctgattatactgcagctacacgtataacgaagcgacgaggtcgggttgggtcggttccggggcggggtaccacgacgtcgaccgtcgtacggtccacggcccgaacggctccgcccccgtcgtcctacctccgttcgttcccccc

SEQ ID NO: 110090 - DNA, 610 bp, Homo sapiens
  misc_feature: GYAE6OF01B72E0.10.28.C06.1.454.CMB.1.raw
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaaccaacacgtacccaggaccaaacgccccccaaactgatgatttatgatgtacagtaactccgaccctcgtaggggtttctgatcgtctttcgtttcgcctacctaaggtctgggaccaaaccgaccggtcccctcccgtacgaccctacttccgttccgtcggggcctccgagtacgtaggacgggaacggaggtctaggtaatttacgttactcgcacgcctcaacataacgaggcgcgaggtcgggttgggttcgggtcggggcgggggaccacgacgtcggtaccgtcgtacggccacgcccgacggtccctcggcccccgtcgctcctccgtccgtccccc

SEQ ID NO: 110091 - DNA, 564 bp, Homo sapiens
  misc_feature: GYAE6OF01D2E8A.10.28.C06.1.454.CMB.1.raw
  modified_base (430)..(430): a, c, t, g, unknown or other
  misc_feature (430)..(430): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccagccaccacccaggcaaacgccccaaactccttgttttgaggtcagtaacgcggccctgaggacgtccctgatcggttctctgcctcaagtctggcaacacggcctcctgaccgtctcgtcgggctccgaggctggaggatgaggctgattactactgcagcgnatatcacggcccaagagggttgttgggcggtcggacgtaagggtcgaccgtccgtgggtccacggcccgaaggtccgtcggccccccgtggtccaccgttcctccgttcccccaccccttcccgtccctaaccg

SEQ ID NO: 110092 - DNA, 685 bp, Homo sapiens
  misc_feature: GYAE6OF01DRJAA.10.28.C06.1.454.CMB.1.raw
  modified_base (186)..(186): a, c, t, g, unknown or other
  misc_feature (186)..(186): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggacncctcggtcaagctcatctgcactctgagcagtggcacagcaactcgccatcgcatggcatcagcagcagccagaggaacgggccctcggtacgtgagtaggaacggttaacaggtagagtggacacgccaacgaaccggtaagggggaccggactcccgtaggtacgtttccggttttacgacgggtccacggtcgttcggtcggggtctaggacggccgtacctacccgttaccaccgtacttcccgtaccgaacgtccccttacccgagttccgtagggaacggtagtacgggaacggtccttacgtaactttaacgttacgttacggttaccgacgggtaacccgggttcggggtacttacggttggtttacgttcggggtttcggggttttaccggggaccggggtaaacgggtacccgtaaggtccggttaccgggtaccccgtttaccggtacgggtaccgacggaaccccggtacggtcccgtacccccggg

SEQ ID NO: 110093 - DNA, 563 bp, Homo sapiens
  misc_feature: GYAE6OF01E1V6J.10.28.C06.1.454.CMB.1.raw
tcagcatagtagtgcacgaccggtgctcgatttagagctcacgtattgggtttgggggagagctctgggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatggaaaggttaacagtgatggcagccaacgaccggaagggggacgggactcccgtgagttcgttttcgacgggtccagctcgtggggctggacgcgctacctcacctactcctccgacgccctccgacgtctggaggagtggacggtctagacttagttactcgtacgacggtacccgtggggactacgttggttgttgggttgggtttacggggcgggtacgggtaccgaggccgtacggtacccgtccgtacgggtcacggcccgaggccgtccccgg

SEQ ID NO: 110094 - DNA, 668 bp, Homo sapiens
  misc_feature: GYAE6OF01CP0TP.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgataggaaaggttaacagtagatggacacgccaacgaccggaaagggggacggactcccgtgatttccggttttacgacgggttacccaggtccttacggtacgggggcttaggacggtccggtaccttaccctccgaacccacgttcccctaccgaacgcccttaccgaggtccgtaggaacgggattaggacggtacgtacgtaacttaacttacgtcgtaaccgacggtaccggttcggggactacggtaggtttagttgggtttacggggttttaccggggacgggtaaacggggtaaccctaaaggtcccgttacggaaccccgggttacgttaacggggttaccgaaccggtaaccccgaaagggtcccgttaccccccggg

SEQ ID NO: 110095 - DNA, 640 bp, Homo sapiens
  misc_feature: GYAE6OF01DTS5W.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctcccgtgggagcctcggtcaagctcatctgcactctgagcaggtgggcacagcaactacgccatcgcatggcatcagcagcagccagaggaacgggccctcggtactgagtaggaaggttaacaggtgagtggcacgaccaacgaaccggaagggggacggactcccgtagtacgtttcgttttacgacggtccaggtccgtcggtggggtcgtaggacggccgtacctacccgtaccacctactccctaccgacgtaccctaccgacggtcgtacgggaggtagtacggacggtcgtaacgtacgttaattaccgtaggtacgtaccggtaccggtcggggtaccttaggttggttacgttgggttcgggtttacggggacgggtaacgggaaccgtaggtccgtaccggtacccgttacggtacggtaccgaccggtacccggtacgggtccgtcccccggg

SEQ ID NO: 110096 - DNA, 601 bp, Homo sapiens
  misc_feature: GYAE6OF01DEH39.10.28.C06.1.454.CMB.1.raw
  modified_base (312)..(312): a, c, t, g, unknown or other
  misc_feature (312)..(312): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtcctcctggacagtccatcaccatcctcctgcactcggacccacagttacattaggtaaataatgaatatgtctcctaggtaccaacagtaccaggacaaacgccccaaactgatgtatttangtatgtcagtaactcgacctgtagggttctgatcgtcttcgttcgctacctaagtctggactaaccacggccctcccgtgaaccctatcctcgtcgggcctccgagtacgtggacggacgtaggtactagtaatttacttacgttacgacgtacgctacaacataacgaacggcggcgtagggtcgggttagggtcggttcgggacgggggaccacgtaccgcggtaccgtcgtacggtacgacgccgaacggcgccgtcccccgtgtccaccttcgtcccgttacccc

SEQ ID NO: 110097 - DNA, 798 bp, Homo sapiens
  misc_feature: GYAE6OF01CBO9D.10.28.C06.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagccttcctccgtgtctgggtctcctggacngtccatcaccatctcctgcactggaaccngcagtgacttttgtgcttataactntgtctcgtgtaccagcaccaccaggaccaaaccgcccctaaacttcctttgttttgaggtcaggtaacgccgccctcgaggtacgtccctgtacttcggttctcgtcgcctaccgaagtcgtggaccaaacgtcggtccctttacccgtagaaccctagttcccgtcccggggcccttcccgaaccggtcgtacgggacgggaaccgacgggtccttaccgtaactttaactttaaccgtcggtactaacggtccttaccgtaaacttaacccgttaaccccggaaccccgggtaacgggggtaccctaacccgtttacccggttaccggttaacgggttaacgtttaaccggggttcccgggggtaaccgggggtaaccggggtaaccccggttgggtaaccccgtaccgggttaaccccggttaccccgttaaccgggtacccgaccggtaccccccggaaacgggttccccgtaccccggttcccccccggttaccggttaccccttacccgtttccccggttccccggtttccccccccg

SEQ ID NO: 110098 - DNA, 626 bp, Homo sapiens
  misc_feature: GYAE6OF01DDFAB.10.28.C06.1.454.CMB.1.raw
  modified_base (239)..(239): a, c, t, g, unknown or other
  misc_feature (239)..(239): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtggcacagcaactacgccatcgnatggcatcagcagcagccagagaaggcctggtactgatagaggtaacagtgatggcagccacgaccgaaggggacgggtactcccgtgtacttcggtttttaccgagggtcccaggtcttcggtggggctagacgtccgtacgtaccctcgaccagttcccgttccaacggtccctaccgtaacgtcgttacggaaggtagtcggacgtcgtagacttaacgtttacgtacgtacgtacggaccgttcggggactacggttggtttaacgttgggtttaccgggtttacgggaccggggtaacgggtacccgaaggttcccgtaccggtaacccgttaccggtacgggtacccaacgggtaccccgtaagggtcccgttaccccggg

SEQ ID NO: 110099 - DNA, 551 bp, Homo sapiens
  misc_feature: GYAE6OF01A33VX.10.28.C06.1.454.CMB.1.raw
  modified_base (224)..(224): a, c, t, g, unknown or other
  misc_feature (224)..(224): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacngcaactacgccatcgcgtggcatcagcagcagccagagaacgggccctggtacttgatgaaggttaacagtgatggcagccacgaccgaagggggacggatcccgtgacttcgttttcgacgggtccagtctcgtgggctggacgcgctacctcacctatcctccagcctcacgtctgaggactggacgctgactacttacgtgtcgagtaccgtgggctacgtggttactggttcggtttcggcgggtacgggtaccgaagtcggtacggacccgttccgtacggtaccgtacggtacccgtaacgggtccgtccggtacccccgg

SEQ ID NO: 110100 - DNA, 561 bp, Homo sapiens
  misc_feature: GYAE6OF01C1T32.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagagggcctcggtactgatgaaggttacagtgatggcagccacaccgaagggggacggatcccgtgacgtttcgttttcgacgggtccagtcgtcgtggggctggacgcgtcctacctccaccactcctccacgccctcccgagttctaggaggtagtggacggctagtacttagttactgtccgagaccgtggggactacgttggttagttggttcggtttcgggacgggtacgggtaccctaaggccgtacggtacccggttacgtacggtaccacggacccgaaggtccgtaccccgg

SEQ ID NO: 110101 - DNA, 774 bp, Homo sapiens
  misc_feature: GYAE6OF01D0ZGT.10.28.C06.1.454.CMB.1.raw
  modified_base (183)..(183): a, c, t, g, unknown or other
  misc_feature (183)..(183): n is a, c, g, or t
tcagcatagtagtgcacgaccggtgctcgatttagagctcacgtattgggtttggggagagctcgtggggagtctgcaccatggcttggaccccactcctcttcctcaccctcctcctccactgcacagggtctctctcccagcttgtgctgactcaatcgccctctgcctcgtgccctccgngggacgcctcggtacaagtctcatctgcactctagacgcgaggtcgggaccacgagaccaaaccgtaccgccatcgcagtcggcatcagcaacgccacgaccgaaggaacgggaaccgggtccccgtacgggttaaccgttaggaaggttaacgggtaaacggtttaaaccggaggttacggtacggtaccggacgaaccggacccgaaaccgggaaacccgggtaacggggggaaccggtacgttaccccgtaggttaacgttttccggtttttaacggaaccgggttccgtacgggtccgttcgggtcggggtacgttacggaaccgtccgtacctacccgtaccgacctaacgtcccgtaccgaccgtccgtaccgtacggtccgtaagggaacggttagtacgggaacgtacgtacgaacgtttacgttaaccgtcgtaccgtaaccgggttaccggtagggtaccttagggttaggtttacggttacggggtttcgggttaccggggacgggtaacggtaccgaacggtcctaccgggttaccgtcgtaacgggccaaccgggaccctacggtcccgtaccccggg

SEQ ID NO: 110102 - DNA, 643 bp, Homo sapiens
  misc_feature: GYAE6OF01BQXSR.10.28.C06.1.454.CMB.1.raw
  modified_base (318)..(318): a, c, t, g, unknown or other
  misc_feature (318)..(318): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccagcaccaccagacaaacgccccaactccttgttttgagtcagtacgcggcctnaggacgtcctgatcggttctctcgcctcagtctggcaacgcggcctcctcgaccgtctcgtcgggcctccgaggctaggaggtagtcggagggtctagtaacttactacgtcggcagccgactatacttcgaaccggacccctaaggtaggggttcggtttcggggccgggtacggggtaaccgttaacggggtccgtaacccggttccggtagggtacccgaacggtaccccgaagggtccctacccgggtcccccccgttacgggttccctacccgttcccgttacccggtttacccccccaccccgttcccgtcccgtaacc

SEQ ID NO: 110103 - DNA, 685 bp, Homo sapiens
  misc_feature: GYAE6OF01BEU34.10.28.C06.1.454.CMB.1.raw
tcagcatagtagtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatccgccctctgcctctcgcctcccgtgggacgcctcggtcaagctcatctgcactctgagcaggtggcacagcaactcgccatcgcagtggacatcagcagcacgaccaaggacggaacgggtccccgtacggtacttaggacttaggtaaacggttaacacggtgaagtcggacgtacgaccgaacggaaccggaaacggggggaaccggtacgttacccgtaggtacgtttaccggttttacgaacgggttaccgacgtcgttcggtacggggctggaccgtccgaccttacctacgtaccctattcccgtaccacgtcccttaccgagtccgtaggacgtcgtacgggacgtacgtacgtaacttacgttacgtcggaccgtaacggtccggttagggaccttacggttggttacgtcgggtttcggggttaccgggacgggtaacggttaccgaacggttcggtacccgggtacgtaccgggttacgtaccggaaccgacccggtaggtcccgttaccccggg

SEQ ID NO: 110104 - DNA, 612 bp, Homo sapiens
  misc_feature: GYAE6OF01AJBXX.10.28.C06.1.454.CMB.1.raw
  modified_base (431)..(431): a, c, t, g, unknown or other
  misc_feature (431)..(431): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaatatgaatatgtctcctggtaccaacagtacccaggacaaacgcccccaaaactgatgtatttatgatgtcagtaatcgaccctgtagggttctgatcgtcttcttcgcctacagtctggcaacgcgcctccctgacctatctcgtgggcctccgagtacgtggacggacgagtctgtaattattacnggaccagtcctactaacactaacgaaggtccggacgtacgggtccgggtttaggggttcgggttaccgggggacccggggaactaaccgaccgttccggacccgttccgtacggtcaccggccccgaaggccgtaccccgtcccccgttacggtacctcccgtcgttcccgttcccccccg

SEQ ID NO: 110105 - DNA, 567 bp, Homo sapiens
  misc_feature: GYAE6OF01DEJ4C.10.28.C06.1.454.CMB.1.raw
  modified_base (305)..(305): a, c, t, g, unknown or other
  misc_feature (305)..(305): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggaaataatgaatatgtctcctggtaccaacagtacccaggacaaacgcccccaaatgatgatttangatgtcagtaactcgacctcgtagggtttctgatcgtcttcttgcctcaagtctggacaacacggtcctcctgaccatctcgtggctccagacgtgacggacgaggctagattatactgcacgctacactatacaagcgacgtaggtcggttgggtcggttcgggcgggggaccacgtacgtcgtaccgtaccgtaggtacgacggcccgaacggccgtccggtcccccgtacggtacctacctccgttccgttaccccccg

SEQ ID NO: 110106 - DNA, 653 bp, Homo sapiens
  misc_feature: GYAE6OF01A74S6.10.28.C06.1.454.CMB.1.raw
  modified_base (331)..(331): a, c, t, g, unknown or other
  misc_feature (331)..(331): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggacccacagttacattggtaaataatgaatatgtctcctggtaccaacagtacccagacaaacgcccccaattccttgttttgagtcagtagccgcctgaggctccntacgtcggttctctgccctcgaagtctggaccaacgccgccctccgtcgaccgtctcgtcggcctcgaggtctagggacgagtaggaggtctagtactttactacgtggccaggacctcgtacgttactaccgaccggaaccccctaaggtacgggggtttgtttccgggggaccgggtacgggtaacgttaacgggtcggtacccgttacggtcgggtactaccgggaccccgtaacgggtccgtacccggtacccccggttcgggtcctaccccgttccgttcccggttccccctccccgttccctactacccgttaacg

SEQ ID NO: 110107 - DNA, 619 bp, Homo sapiens
  misc_feature: GYAE6OF01C2LRD.10.28.C06.1.454.CMB.1.raw
tcagcatagtagtgcacgaccggtgctcgatttagagctcacgtattgggtttgggggagagctctgggggagtctgcaccatggcttggaccccactcctcttcctcaccctcctcctccactgcacagggtctctctcccagcttgtgctgactcaatcgccctctgcctctcgcctcccgtggggagcctcggtcaagctcatctgcactctgagcaggtgggcacagcaactacgccatcgcatggcatcagcagcagccagagaacggcctaggtactgagtaggaaggttaacgagtagagtggacacgaccaacgaaccggaagggggaccggactcccgtagtacgtttcgttttacggacggtccagtcgtcggtcggggtctcggacggcgtacctacctaccacctactccctaccgacgtccctcgtacgtcgtaggaacggagtaggacggctacgtacttaagttacgtacgtacgacggtaccggttggggacctaggttggtttagttcgggttcggggtttacgggacgggtaacgggtacgaacggtcgtacggtacccggttcgtacggtaccgaacggacccgtaggtccgtaccccgg

SEQ ID NO: 110108 - DNA, 542 bp, Homo sapiens
  misc_feature: GYAE6OF01EG5M7.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaaggccctcggtactgatgaaggttaacagtgatggcagccacgaccgaaggggacggactccgtgattcgttttcgacggtccagctcgtgggctggagcgctacctcaccatctccgacgtccctccagtctaggagatggacgctacgacttattacgtgtacgagtaccgtgggactacgttggttagtggttcgggtttacgggcgggtaacgggtaccgaaggtcgtacggacccgtaccgttacggaccaacggcccgaacggccgtccccgg

SEQ ID NO: 110109 - DNA, 659 bp, Homo sapiens
  misc_feature: GYAE6OF01ARTI8.10.28.C06.1.454.CMB.1.raw
tcagcatagtagtgcacgaccggtgctcgatttagagctcacgtattgggtttggggagagctctggggagtctgcaccatggcttggaccccactcctcttccctcaccctcctcctccactgcacagggtctctctcccagcttgtgctgactcaatcgccctctgcctctgccctcccgtgggacgcctcggtcaagctcatctgcactctgagcgaggtggcacagacaactaccgccatcgcatggcatcagcagcacgccgaagacggaacgggtcccgtacggtacttgagtaggaaaggttaacagtagagtggacacgaccaacgaccggaacggggacggactccgtgtacttcggtttcgacggtcacgtcgttcggtacgggtctcggtacgccgtaccgtacccgtcaaccctactacccgtaccgacgtcccctaccgtacgtccgtaggtacggtagtacggacggtccttaggtaacttacgtttaacgtcggtaccgtacgggtaccgggtcgggtaccgtacggtttagggttagttcgggtttacgggtttccgggacgggtacgggtaccgtaacggtcggttaccggtaccggtaccgtacggtacccaaccggtacccaacgggtcccgtaccccgg

SEQ ID NO: 110110 - DNA, 681 bp, Homo sapiens
  misc_feature: GYAE6OF01C79XI.10.28.C06.1.454.CMB.1.raw
  modified_base (322)..(322): a, c, t, g, unknown or other
  misc_feature (322)..(322): n is a, c, g, or t
tcagcatagtagtgcacgaccggtgctcgatttagagctcacgtattggggtttgggggggggtctcaggaggcggccctctcgggacgtctccaccatggcctgggctctgctattcctcaccctcctcactcgagggcacagggtcctgggcccagtctgccctgactcagcctgcctccgtgtctgggtctcctggacagtccatcacatctcctgcactcggaacccacagttacagttaggtaataatgaatatgtctccgtagtaaccaacacgtaaccaggaccaaacgacccccaaaatcgatagtaatttagngtatgtacaggtaactccgaacccttcgtaaggggtttctagacgtcgtctttcttcgcctccgtaggtctgaccaacgccggtaccctccacgactacgttccgtcgtcgggtacctaccgaggtacgtgggaacggtaggacggttacgtaaggtttaacttaacgttacgtacgacgtaacgtcctaacgaactaacgtaacgaacggcgtacggtaggggttccggggtttaggggttcgggtaccgggggtaccggggaaccctacggtacggtacccgtaccgttcggaacggtacgaccgaccggtacggcctacccggccccgtaggccctccgtcgtcccgttacccccg

SEQ ID NO: 110111 - DNA, 590 bp, Homo sapiens
  misc_feature: GYAE6OF01BC3LZ.10.28.C06.1.454.CMB.1.raw
  modified_base (294)..(294): a, c, t, g, unknown or other
  misc_feature (294)..(294): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgcctctgcctctgcctccctgggacgcctcggtcaagctcatctgcactctgagcaggtgggcacagcaactacgccatcgcatggcatcagcagcacgccaggagaaggccctggtactgataggaagttaacngtgatggcagcacacgaaggggcgactcccgtagacttcggttttacgacgggtctagtcctcggtgggctggacgcgtacctaccgtcaccactcctaccacgtccctacgacgtcgtacggagtacgtggacggtcgtacgtaacttagttacgtgtaccgtaggaccgtgggtacctacggttaggttgttcggttggggttttccgggacgggtaacgggtacccgaaggtccgtacggtacccggttacgtacgggtaccgtaccggacccgtaagggtcccggtccccgg

SEQ ID NO: 110112 - DNA, 581 bp, Homo sapiens
  misc_feature: GYAE6OF01AI4WP.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctccctgggagcctcggtcaagctcatctgcactctgagcagtgggcacagcaactacgccatcgcatggcatcagcagcagccagagaacgggccctaggtacttgatgaaggtaacagtgagtggacagaccacgaccggaagggggacggactcccgtgtacgtttcgttttacgacgggtccagtccgtcggtggggctggacgcgtactacccgtccaccactcctccacgtccctacgacgtctaggagtatacggacgtctacgtacttacttacgtcgtcgacgtaccggtgggtacgtacgttggttacgtggtttcggggtttaccggacgggtacgggaccgtaaggtcgtacgtaccggtcgtacggtcacggtcccgaggtcccgtaccccgg

SEQ ID NO: 110113 - DNA, 669 bp, Homo sapiens
  misc_feature: GYAE6OF01CB9Y3.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctcccgtgggacgcctcggtcaagctcatctgcactctgagcagtggcacagcaactacgccatcgcatggcatcagcagcagccagacggaacgggccctcggtactgagtgaaggttaacagtgagtggacacgccacgaccggaaggggacggactccgtgtattcggttttcgacggtaccacgtcgtgggctggacgccgtccgtacctccacctatccctccgacgtccctccgtaacgtcgtaggacggacgtcggacggtcgtacgtacgtttaacgtttaccggtacgttaccgaaccggtacccgggttacgggggtccttaacggggtttacgggtttaagtttcgggggtttacggggttttccggggaaccgggggtaaacggggtaacccgtaacgggttccggttaccgggttaccccgttaccggtacgggtacccgacggtaccccgaacggggtcccgttccccgggttccccccgg

SEQ ID NO: 110114 - DNA, 621 bp, Homo sapiens
  misc_feature: GYAE6OF01BXZLC.10.28.C06.1.454.CMB.1.raw
  modified_base (441)..(441): a, c, t, g, unknown or other
  misc_feature (441)..(441): n is a, c, g, or t
tcagcatagtagtgcacgaccggtgctcgatttagagctcacgtattgggtttggggagagctcgtggggagtctgcaccatggcttggacccactcctcttcctcaccctcctcctccactgcacagggtctctctccagcttgtgctgactcaatcgccctctcgcctctcgccctcccgtgggacgcctcggcaacgctcatctgcactctgagcaggtgggacacagacaactacgccatcgacagtcggacatacacgcagcacgaccgaaggacggaacgggccgtacggttaactgaagtaggtaaaggttaacgagtagaacgtggacgaacgaccgaacggaaccgggaaacgggggacgacttcccgtagtacgtttcggttttacgacggtccacgtcgtcggtagggctaggacgcgtcctacgcaccntcctacgacgccctacgacgtcgaggtagacgtgagctaacgtacttactacgtcgtacgtacgtaccggtgggtctacggttgttacgttcgggttcgggtttacgggacgggtacggaaccgaggtccgacggtaccgtaccgacggtaccgaacgcccgtaaggtccgtacccccgg

SEQ ID NO: 110115 - DNA, 800 bp, Homo sapiens
  misc_feature: GYAE6OF01EJI1K.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctcgcctctgcctcccgtgggagcctcggtcaagctcatctgcactctgagcagtgggcacagcaactacgccatcgcatggcatcagcagcagccagaggaacgggcccgtcggtacttggagtaggaaaggttaacaggtagagtggcagccaacgaccggaaagggggacggaactcccgtggtacgtttcggttttacgacgggttccacggtccgttcggtcgggggtccttagggacgtccggtacccgttaaccctacccaacccgttaccttaccccgtaccccgtaaccggtccccgttaccccgtaacggttcccgttaacgggaacgggtaacggttacgggtaacgggtacccgtttacgttaaaccgtttaacgttttaaccgttacggtacccgtaaacggggtaccccgggttacgggggtacccgttaacggttttaggggttttaacggtttacggggttttacgggggttttacccgggggtaccgggggtaaaccggggtaacccgggttaaacgggtacccggttaaccggggtaacccccggtttacccgggttaaccgggttacccggaacccgggtaccccggtaaaccggggtcccggttaaccccccgggg

SEQ ID NO: 110116 - DNA, 737 bp, Homo sapiens
  misc_feature: GYAE6OF01DWNUQ.10.28.C06.1.454.CMB.1.raw
  modified_base (164)..(164): a, c, t, g, unknown or other
  misc_feature (164)..(164): n is a, c, g, or t
  modified_base (517)..(517): a, c, t, g, unknown or other
  misc_feature (517)..(517): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacgaggtctctctccagcttgtgctgactcaatccgcctntcgcctctcgcctccgtgggacgtccgtcggtacaacgcctactacttccgcgacctacgttcgtaggacgtaccgagggtcggaccaacgaagaccgtaaaccgtaccggacctagttaccgacgtaacgtcggactaacgacgacgacacgacaacggaccgaaaggtacggaaccgggtcccgttacggttaccgttaggtaaggtaacggtaaacggttaacgaaggtgaacggtcgacgaaccgaccgaaccggaacgggaaacgggaccgtaccgtacgttacgttacgttacggtttacggcggtacgcggtacgtcggtcggacgtcggtacgccgtaccgtacncctaccgagtcccacgcgccttacgacgttaggacgacgtagtacggcgtacgtacgtaacgttagtacgtaccgacggtaacggaccgggttggttaccgttagggttaacggttggttaccggtacggggtttaccggacgggtaccggtaacgccgtaccggtaccggtacccgtacggtacgaccgaccggtaccggtacgtcccgttaaccccgg

SEQ ID NO: 110117 - DNA, 746 bp, Homo sapiens
  misc_feature: GYAE6OF01ENVT0.10.28.C06.1.454.CMB.1.raw
  modified_base (245)..(245): a, c, t, g, unknown or other
  misc_feature (245)..(245): n is a, c, g, or t
  modified_base (306)..(306): a, c, t, g, unknown or other
  misc_feature (306)..(306): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcgtggacagtccatcaccatctctgcactcgacccacagttacattgtaataangtaatatgtctccgtggtaaccaacacgtaccaggacaaacgccccaaatgatgtatttangatgtactaagtaactccgtaccctggtaggggtttctagtatcgtctttcttcgcctacgaagttctggaccaaccgaccggtccctacccgtgaccctattccgtacggtccgggccttacgaacgtacgtaggaacggtacggacggtctaggttaactttacgttactcggtaccgtaacgtccgttaaccaactagttaaacccgacgggtaccgggtaccggtaaggggtttccgggggtttacgggggttcggggttaaccccgggggggaccgggggtaaacccctaacggtaccggttacccgggtaaccccggtttacccgggtaacggttaccgaaccccgggtaacccggaaacgggttcccccgtaccccgggtaccccccggttggtacccccttaccgtttcccgtaccccggtttaaccccccc

SEQ ID NO: 110118 - DNA, 531 bp, Homo sapiens
  misc_feature: GYAE6OF01AK2RM.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacgggatcccgtgattcgttttcgagggttccagctcgtggggctggagcgctacctcaccactcctccacgccctccagttctggaggtatgacggctgtacttacttacgtgtacctagacccgtgggaccacgttggttatggttgggtttcggcgggtacgggaccaaggcgtacggaccgttccgtacggtcacgcccaggcctcccgg

SEQ ID NO: 110119 - DNA, 596 bp, Homo sapiens
  misc_feature: GYAE6OF01AL0I2.10.28.C06.1.454.CMB.1.raw
tcagcatagtagtgcacgaccggtgctcgatttagagctcacgtattggggtttgggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagaggaacgggccctcggtactgagtagaaggttaacagtgatggcagaccaacgaaccggaaagggggaccgggtactcccgtggtactttacggttttacgagggtcccgagtccgtcggtcggggcttaggacgccggtctaccgtccacctactctcccacgtccctaccacgtctaggacggagtcggacggctacgattaacgtttacgtcggtactacggtaccggtggggctagttgggtttagtgggtttcgggtttacggggcggtacgggacctaggtccgtacggtaccgtcgtacgggcacggcccgtaggcccgtaccccgg

SEQ ID NO: 110120 - DNA, 725 bp, Homo sapiens
  misc_feature: GYAE6OF01BJEBC.10.28.C06.1.454.CMB.1.raw
tcagcatagtagtgcacgaccggtgctcgatttagagctcacgtattggggtttgggggggtcgtcaggaggcggccctctcgggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagccaccaccaggacaaacgacccccaaacttcctttgttttgaggtcagtaacggccgccctcgaggacgtccctgacttcggttctctcgtccctaccaagtccgtcggacaaccgaccggccccttcccgtacggtaccccgttcgtccggtcggggtcctcccgagggtccttgggacggtatgggacggtctagtactttacctacgtgtaccgagtccgtactaattccttacccgaccggtacccccgaacggtggggtttacggtttcgggggaccggggtaccggggttaacggttaaagggttcccgggacccggtttaccgggtcggggttaccgaacccggtacccggtaacgggtcccttaccccgggtccccccggttcgggtaccctaccgtttcccgttcccggttccccccggtccccctcccttcccgtacccttaccg

SEQ ID NO: 110121 - DNA, 790 bp, Homo sapiens
  misc_feature: GYAE6OF01C46BI.10.28.C06.1.454.CMB.1.raw
  modified_base (261)..(261): a, c, t, g, unknown or other
  misc_feature (261)..(261): n is a, c, g, or t
  modified_base (321)..(321): a, c, t, g, unknown or other
  misc_feature (321)..(321): n is a, c, g, or t
  modified_base (360)..(360): a, c, t, g, unknown or other
  misc_feature (360)..(360): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtcctcctggacagtccatccaccatcctcctgcacgtcggaccccactagttacagtttggtaataatgaatntcgtctccgtaggtaccaacacgtacccgaggacaaacgcccccaaatgattgtatttancgtagtgtacaagtaactccgtaccctgtacgggtttcngtactcgtctttctttcgccttaccgagttccgtaggaccaaccgtaccggtccccttcccgtacggaaccccttagttcccgttccgggtcgggtacccctacccggtaacggtaccgttaggggaaccgggtaccggacggttaccttaggttaactttttaacggttaccttcggaccgagttaccgtacctaactaacgttaacgaacgggtccgggaccggtaggggttccgggggttttagggggtccgggttacccgggggggtacgggggacccgttaggggtcccgttaccggtaccccgggtttaccgtacccggttaccggacccggtaccccggtaacggggtccccgttaccccccggtccccggtttccccgggtacccgttacccctttcccggttccccgggttaccccccccg

SEQ ID NO: 110122 - DNA, 725 bp, Homo sapiens
  misc_feature: GYAE6OF01BJLHE.10.28.C06.1.454.CMB.1.raw
  modified_base (186)..(186): a, c, t, g, unknown or other
  misc_feature (186)..(186): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacaggtctctctcccagcttgtgctgactcaatcgccctctgcctctgccctccctgggacncctcggtcaagctcatctgcactctgagcaggtggcacagcaactacgccatcgcatggcatcagcagcagccagacgaacggcctcggtactgagtaggaacgttaacagtgagtcggacacgaccaacgaaccgggaacggggacggtacgtcccgtagtacgtttccggttttacgacgggtccctacgtccgttcggtcgggtcttcggacggtccgtacccgttaccccgtaccgtaacccgtaccttaccctacccgacgttaccccgtccgttaacgttccgttaacggaacgggttaacgtacgggaacggttccgttaaccggttaactttaacgttaccgtttacggaaccgttaaccgggaacccggtttacgggggacccttaacgggttttacggggttaacgtttcggggttttaccggggtttaacccggggacggggtaaccggtaaccgtacggttcccggtaccggtacccgttaccggtacggtacccgtacggtacccgtaacggtcccgttaccccgg

SEQ ID NO: 110123 - DNA, 680 bp, Homo sapiens
  misc_feature: GYAE6OF01C5DVQ.10.28.C06.1.454.CMB.1.raw
  modified_base (166)..(166): a, c, t, g, unknown or other
  misc_feature (166)..(166): n is a, c, g, or t
  modified_base (277)..(277): a, c, t, g, unknown or other
  misc_feature (277)..(277): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctntcgcctctcgccctcccgtgggacgtccgtcggtacaaacgtctcatctcgcactctggacgcgaggtcgggacaacgacgacaaccgtacgccaatccgacagtggctancagcagcacgaccaaggacggaacgggcccgttacggtacttaggaagtacggtaaaggttaacgagtagtagcggacaacgaccgaacgaaaccgggtaaggggaaccgtacttacccgtagtacgtttcggttttacgacggtccagtcggtcggtgggacgtaggacgcgtaaccctacgtaccgaactactcccgtaccaccgtacccgtcgtaacgtcgtacgggaggacgttcggacggtcgtacgttaacgttacgttacgtacggttaccgaccggtacggtcggtaccttaggttaggtttacggtggtttacggggtttccggacgggtacggaacgtacgtcgtacggtacccgttacgtacggacgaccgacccggaggtcccgtacccgg

SEQ ID NO: 110124 - DNA, 693 bp, Homo sapiens
  misc_feature: GYAE6OF01ER5H5.10.28.C06.1.454.CMB.1.raw
tcagcatagtagtgcacgaccggtgctcgatttagagctcacgtattgggtttggggagagctctggggagtctacaccatggcttggaccccactcctcttcctcaccctcctcctccactgcacagggtctctctcccagcttgtgctgactcaatcgccctctgcctctgcctccctgggagcctcggtcaagctcatctgcactctgagcagtggcacagcaactacgccatcgcatggcatcagcagcagccagaggaacggccctcggtacttgataggaaggttaacagtgatggcagccgaacgaccggaagggggacggacgtcccgtgtacgttcgttttacgagggtccagtccgtacggtggggctggacggccgtactacccttccaacctactccgtccccaaggtccccttacgtacgtacgtacggaagggtactcgggtaacggccgttacggaactttaacgttaccgtcggtaaccgtaacgtaccccgggttagggggacccttaacggtttaggggtttaacgttcggggttttacgggggttttccggggaacggggtaaccggggtaacccgtaaacgggttccggtaccggtaaccccgggttaccgttaaccgggtaccggaacccggtaaccccgtaacggggtccccgttccggtaccccccccgg

SEQ ID NO: 110125 - DNA, 662 bp, Homo sapiens
  misc_feature: GYAE6OF01EX3NA.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctccctgggagcctcggtcaagctcatctgcactctgagcagtgggcacagcaactacgccatcgcatggcatcagcagcagccagaggaacgggcccgtcggtactgagtagtaaggtaacagtgagtggacacgccgaacgaaccggaagggggacggactcccgtagtactttccgttttcgacggtccacggtcgtcggtgggctaggacgtccggaccttacccacgaccctactccgtacctacgtaccctccgtagttccgtaggaggtatcggacggtcgtacgtaacgttaagttaccgttcggtcgtaaccggtaccggtcggggtacctacgggtttgggtttacgtttcggggtttacggggtttcccggggaacgggtaccggggtaaccgaacgggttccgttacggtaacccggttccggttaaccgggtacccgaaccggaccccggtaacgggtccccgttacccccggg

SEQ ID NO: 110126 - DNA, 620 bp, Homo sapiens
  misc_feature: GYAE6OF01EQTTI.10.28.C06.1.454.CMB.1.raw
tcagcatagtagtgcacgaccggtgctcgatttagagctcacgtattggggtttgggggagagctctgggggagtctgcaccatggcttggaccccactcctcttcctcaccctcctcctccactgcacagggtctctctcccagcttgtgctgactcaatcgccctctgcctctgcctcccgtgggagcctcggtcaagctcatctgcactctgagcagtgggcacagcaactacgccatcgcatggcatcagcagcagccagaggaacgggcctcggtacttgatggaaggttaacagtgagtggcagccaacgaccggaaagggggacggactcccgtagtactttcggtttttacgacgggtccacggcgtcggtcggggctggacggccgccgtaccctccgacctactcctcccacgtccctaccacgtcgtggaggtagtggaggtctagtacttattacgtgtacgtacgtaccgtgggcctacgttgggttagttgggtttcgggttttccggggacgggtacgggtaacccgtaacggtccgttacggtaccccggttaccggttacgggtaccaccgggaccccggtaaacgggtcccgtacccccggg

SEQ ID NO: 110127 - DNA, 755 bp, Homo sapiens
  misc_feature: GYAE6OF01BTBKJ.10.28.C06.1.454.CMB.1.raw
  modified_base (165)..(165): a, c, t, g, unknown or other
  misc_feature (165)..(165): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctntgcctctcgcctcccgtgggacgcctcggtcaagctcatctgcactctgacgcaggtcgggacacgagaccaactaccgccaagtccgacaagtcggacactcgagacacgccgacgaccgaaggacgggaaccggggtccccgttacgggtaacttggaagttacgggtaaacggtttaacgacggttagagtcggacgaccggacccaaccggaaccgggaagggggaccggtactccccggtaggtaccgttttcggttttacggacgggttaccacggtccgttcgggtaggggtcgtacggtacggccgtaccttaccccgaccgtaccgtacgttccccgtaccgaccgtaccctccgtaaggttccgtagggaacggtacgtacgggacggttacctaacggtacttaacgtttacgtacggttaccgacggttaccgggttacggggtaccttaacgggtttggttacggtttcggggtttcggggttacggggaccgggtacgggtaaccgtaaggtccccgtacgggtacccgttacgtacgggtaccgaacccggcccgtacggccccgttaccccggg

SEQ ID NO: 110128 - DNA, 841 bp, Homo sapiens
  misc_feature: GYAE6OF01DZ66D.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggacgcctcggtcaagctcatctgcactctgagcaggtggcacagcaactacgccatcgcatcggacatcagcacgcacgaccgaaggaaggaacgggcccttacgggttaaccgttaggaagttaggtaaacggttaacaaggtacgaagttcgggacgaacgacccgaacgaaccgggaacgggggaacggtacgtcccgtagtacgttcgttttcggacggtaccgtacggaccgttcggtgggtaccgtaggtacggacgtcccgttaacctccgaaccctacgtacccgtaccgtaccggtcccctaccgtaacgtccgtaggtaacggtacgtacgggaacgggtcttaacgggtaaacctttacgtttaaccggttacggtacccgtaacgggttaccccggggttacggggtaacccgttacgggtttacgggtttaacggttttacggggttttcggggttttaaaccccggggggaccgggggttaaaccgggggtaaaaccccgtttaaacgggggtaccccggttttaaaccggggtaaacccccgggtttttaccccggttaaaacgggggttacccccggaaaaccccggggtttacccccgggtaaaaccgggggttcccccgttttaaaccccccccggggggg

SEQ ID NO: 110129 - DNA, 678 bp, Homo sapiens
  misc_feature: GYAE6OF01B9OGK.10.28.C06.1.454.CMB.1.raw
  modified_base (229)..(229): a, c, t, g, unknown or other
  misc_feature (229)..(229): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctctgcactggaccaacngttacattggtaataatgaatatgtctctggtaccaacagtaccaggacaaacgacccccaaactgatagtatttatgatgtacagtaactccgtaccctcgtaaggggtttctgattccgtctttcctttcgccctacgtaaggttctaggaccaaccgaccggtcccttcccgtacgtacctagtcctcgtacgggtcctaccgaagtacgtggacggaacgaggtcgtagtaacttagttactcggactacgtctacaactacgtaacgaacggcggtaccgtaacggggtcggggtttacggggtcgggtttccggggggacccggggtaacccgacggtacgtcccggtaacccggttaccggtacggtccgaaccggtcccgaacggtcccgtacccggtcccccgttacggtacctacccgttccgttcccgttaacccccc

SEQ ID NO: 110130 - DNA, 832 bp, Homo sapiens
  misc_feature: GYAE6OF01BB7PQ.10.28.C06.1.454.CMB.1.raw
  modified_base (244)..(244): a, c, t, g, unknown or other
  misc_feature (244)..(244): n is a, c, g, or t
  modified_base (306)..(306): a, c, t, g, unknown or other
  misc_feature (306)..(306): n is a, c, g, or t
  modified_base (501)..(501): a, c, t, g, unknown or other
  misc_feature (501)..(501): n is a, c, g, or t
tcagcatagtagtgcacgaccggtgctcgatttagagctcacgtattgggtttggggagagctcgtggggagtctgcaccatggcttggaccccactcctcttcctcaccctctcctccactgcacagggtctctctcccagcttgtgctgactcaatccgccctctcgcctctcgcccgttcccgtggggacctccgttcgggtacaaacggtcctactacgtctcgcctacttcgaggacgngtacgggcggaccacgtacacaaacgtccgccaagtcggactagtcggtacacgtgacgganacgtacgacgaccgaggaaacgggtaccggtccgtaacgtttagcgtaaagtacgggtaaaacgggttacaagtgtaagacggaacggttccaaccggtaaacgaaccgggggaacggggttacggtcctacgtacggttacggtttttccgttacgggaaacggttcgaacgggtttccacggggttaccgggngttaccggtacgtccgtaacccgttacctaacctaaccgtaccgttacccgtaaccgtaccgtaccgtaaccggtacggtacggtacgggtaaggacgggttaccggtacggtaacgttaaccgtaacgtttaccgtttaacgtacggtaacccgtaaccgggtacgggttccggtaacgttacgggtttacgggtttagggttacggggtttacccggggtttaccgggaaaccgggtaccggtaaaccgggtaccggttaccgggtacccggttaaccggtacgggttaccgggaacgtacccggaccggtccgtaccccggtccccgg

SEQ ID NO: 110131 - DNA, 672 bp, Homo sapiens
  misc_feature: GYAE6OF01A92OM.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagacggcctcggtacttgatgaaggttaacagtgagtggcacgccacgaccgaagggggacggactcccgtgtacttcgtttttacgagggttccacgtccgtacggtggggcttacggacgccggtcctacccgtccaaccctactcccgtacccgacgtccctaccgacgttccgtaggacggagttcggaacggtcttacggtaacttaacgtttaccgtcggtaccgtaacggtacccggttaggggccttaacggttcgggtttaagttcggggttttcggggttttaccggggaccggggtaacgggtaacccgtaaacgggttcccgttaaccgggtaccccggtttacccggttaacggggtaccctaaccgggcccccggtaaacgggtcccgtacccccggg

SEQ ID NO: 110132 - DNA, 738 bp, Homo sapiens
  misc_feature: GYAE6OF01DRH37.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctgccctcccgtgggacgcctcggtcaagctcatctgcactcgtgacgcgaggtcgggcaacgacgacaaacgtacgccagtcgcatggctatcagcacgacacgaccgaaggaacggaaccggggtaccctcgggttaacgttaggaagtagggtaaaggtttaaacgaggtagagtgggaaccacggacccgaaacggaaaccgggaaacgggggaccggacgttacccgttaggtacgtttcggtttacgacgggtccgagtccgtcggtacgggtcgtaggacgtccgtaccctaacctaccgaacctactcccgtccgaaccgtcccttccgaagttcgtacggaggtaacgtcggtacggtactacgttaaacgttacgttttaaccggtacgtaccggtaacgtacccgggttagggtaccttaggtttacgggttacgggtttcgggtttaccggggtttaccgggaccggggtaaacgggaccttaaacggtcgtaacccggtacccgttaccggtacggtaccgaacccggacccggtaacggtcccgtacccccgg

SEQ ID NO: 110133 - DNA, 651 bp, Homo sapiens
  misc_feature: GYAE6OF01AS1QN.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctcccgtgggacgccctcggtcaagctcatctgcactctgagcagtggcacagcaactacgccatcgcatggcatcagcagcacgccgagacggaacggccctacggtacttgagtaggtaaggtaacagtgagtggcagccaacgaccggaaggggacggactcccgtgtacgttcggttttcgacggtccagtcgttacggtcggggtctacggacgtccgtaccttacccgtccaacccgtatcccgtaccgacgtccctaccgtacgttcgtaggacggtagtacggtacggtactacgtaacgttaacgtttaaccgtcggttaccgaccggtaccggttcgggtactacgttggttagttcgggtttacggggttttccgggaacgggtaccgggtaccgtaacggtcccgtacggtacccgtaccggttacggtaccgtaccggacccgacgggttcccgtcccccggg

SEQ ID NO: 110134 - DNA, 777 bp, Homo sapiens
  misc_feature: GYAE6OF01DUUJV.10.28.C06.1.454.CMB.1.raw
  modified_base (200)..(200): a, c, t, g, unknown or other
  misc_feature (200)..(200): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacgagggtcctgggcccagtctgccctgactcagcctgcctccgtgtctgggtctctggacngtccatcaccatctcctgcacgtcgacccactagttacagttaggtaataatagaatatcgtctccgtagtaaccaacacgtacccaggacaaaccgacccctaaatgatagtaatttagtgtatgtactaagtaactccgtacccgtcgttacgggtttcaggtacttcgttctttcgttcgacccttacgtaacgttcgtacggacctaaccgtcccggtaccctcccgtaccgtacccgttccgtccggtcgggtacctccggacggtcgtagggtaacggtacggtaggtaccggtacgttagttaaccgtttactaccggtacgaccgtacgacgttactaagtttaaccgtaccgaacccgggtaccccgttaagggttaggggtttcgggttacggggaccggggtaccgggtaaacggttaacgggtcccggtacccgggttccggtacggggtacccgaacccggtaccccgggtaacggtccccgttaccccccgggtcccccggtttaccgggttccctaccccgtttcccgttaacccccgttcccccgtacccccgtttacccc

SEQ ID NO: 110135 - DNA, 707 bp, Homo sapiens
  misc_feature: GYAE6OF01DFTGC.10.28.C06.1.454.CMB.1.raw
  modified_base (327)..(327): a, c, t, g, unknown or other
  misc_feature (327)..(327): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctggcccagtctgccctgactcagcctgcctccgtgtcgtgggtctccgtggacagtccatccaccatcctcctgcacgtcgacccacagttacattaggtaataagtgaattatcgtctccgtaggtaaccaacacgtacccaggaccaaaccgacccccaaatgacttagtaattttangtattacgtactaagtaactccgtaccttacggtagggtttcagtactccgtctttccgttacgcctacgtaagtcgtacgaccaaccgaccggtccctccgtacgacctacttccgtcgtcgggtacctaccgaaggtaccgtaggaacggtacggtacggtcttagttaacttacgttacgtagacctacgtcctacaactacgtaacgaaccgggcgtacggtacggggttccgggttaggggttaccgggttaccgggggaccggggaaccctacgtaccggtaccgtacccggttacgtacggtaccgaccggacccgaacggtcccgtccccgtccccgtacggtacctaccgttccgtccccgttaccccccg

SEQ ID NO: 110136 - DNA, 618 bp, Homo sapiens
  misc_feature: GYAE6OF01A7HLA.10.28.C06.1.454.CMB.1.raw
  modified_base (185)..(185): a, c, t, g, unknown or other
  misc_feature (185)..(185): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggancctcggtcaagctcatctgcactctgagcaggtggcacagcaactacgccatcgcagtggcatcagcagcagccagagacggcctcggtactgatagaaggttaacagtgatggcagccacgaccggaagggggacggactcccgtgtacgtttccggttttacgacgggtccacggtcgtcggtcggggctagggacgtccgtacctaccctaccacctacttccctacccgaacgtcccgttaccgtacggttccgtaggacggtattacggacggtctacgtaacttagttacgtcgtacgtacggtaccggtcgggactacggttggttagttcggttacgggtttcgggcgggtaacggtaccgtacggtccgtacggtacccgtaccgtacggtaccgaccggacccgtaaggtccccgtaccccgg

SEQ ID NO: 110137 - DNA, 880 bp, Homo sapiens
  misc_feature: GYAE6OF01EH95M.10.28.C06.1.454.CMB.1.raw
tcagcatagtagtgcacgaccggtgctcgatttagagctcacgtattgggtttggggagagctctgggggagtctgcaccatggcttggaccccactcctcttcctcaccctcctcctccactgcacagggtctctctcccagcttgtgctgactcaatccgccctctcgcctctcgccctcccgtggggactccgtcggtacaagcctacatcctgccactcgtagacgcgaggtcgggaccacgacgaccaaactaccgcctaagtcgcaagtcggacatacacgacacgacgacgaccgaaggtaacggaaccgggtcccttacgttacggttaaccgttaggtaacggttaagggttaaaacggtttaaacgtagggttacggtaacggttacgggaaccgaaccggaaccccggaaaccggtaaaacccggggggaaaccgggggggtaacccgggttacccgttaccccggttaagggttttaacccggtttttacccgggttttttaaccgggaaccggggttacccgttaacgggttcccggtttaccgggggttcggggttaccgttacgggacccggttaccgtaccccgttaaccctacccgtaacccggttaccctacccgttacccgtaaccgtacccccgttaccggtaacggttcggtaacgggtaacggtacggttacgggtacggttacgttacgttaaccgtttacgtaccggttacggtacgtacccgggttaacgggtccgggtacgtttacggttcggtttacggttcggggtttacggggttccgggaacgggtacggtaccgtacggtcgtaaccggtaccgttacgtaccggaccgtacccgtccggcgtccccgg

SEQ ID NO: 110138 - DNA, 623 bp, Homo sapiens
  misc_feature: GYAE6OF01BRKJ8.10.28.C06.1.454.CMB.1.raw
  modified_base (439)..(439): a, c, t, g, unknown or other
  misc_feature (439)..(439): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgcctcccgtgggacgcctcggtcaagctcatctgcactctgagcaggtgggcacgagacaactaccgcatcgcagtgcatcagcagcagcgagacggaacggccgtacggtactagagtaggtaacgttaagaggtagagtcggacgtacgaccgaacgaccgggaacggggacgtactccgtagtcgtttcggtttcgacggtaccgtgcgtcggtcgggcgtacggacgccgtaccctaccgtaccactactcccgtaccgacncccttccgagttcgtaggagtgtcggagtacgtcgtaacttcgttactggtccacggtcggtcgggtacttacggttgggttattcgggtttgggttaccgggaacggggtacgtaaccggtacggtcctaccggtacccggttaggtaccgtaccgaccgaccgtacggtcccggtaccccgg

SEQ ID NO: 110139 - DNA, 590 bp, Homo sapiens
  misc_feature: GYAE6OF01EU7CY.10.28.C06.1.454.CMB.1.raw
  modified_base (422)..(422): a, c, t, g, unknown or other
  misc_feature (422)..(422): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacaggtctctctcccagcttgtgctgactcaatcgccctctgcctctgcctcccgtgggagcctcggtcaagctcatctgcactctgagcagtggcacagcaactacgccatcgcatgcatcagcagcagccagagacggccctggtacgttgataggaagtacagtgatgcagcacgaccgaaggggacggactcccgtgtacgttcgttttacgacggtccgaggtcctcggtcgggtcgtcggacgtccgtacctaccctccgaccactcccgtccacgtccctccgacgttcgnggaggactggaacggtcgtagtaccttaagttaccgttacgtacgacgtaccgggttacgggactaccgtttgggttacgttcgggttgggtttccgggacgggtacgggacgacggtcgtacggtaccgtccggttagtccgacggtcccgaacggtcgtaccccgg

SEQ ID NO: 110140 - DNA, 828 bp, Homo sapiens
  misc_feature: GYAE6OF01C5G27.10.28.C06.1.454.CMB.1.raw
tcagcatagtagtgcacgaccggtgctcgatttagagctcacgtattggggtttggggggggtctcaggaggcggccctctcgggacgtctccaccatggcctgggctctgctattcctcaccctcctcactcagggcacgagggtcctgggcccagtctcgccctgactcagcctgcctccgtgtcgtgggtctccgtggacacgtccatccaccatcctcctgcacgtcggacccagcactgattggtggctaatttactaacttcgtctcgtgtactaccaaaccaaccgaccaagaaccaaacccgacccccactacttacgttagttaacttagtacgtaacgtacgaacggtaacggtcccggtacccgttacggttacggggtttctacggtcttcgttccttttccgttcgacccgttacccgtaacggttccgtacggtaccgtaacccggtcccggtacccttcccgtacgacccttacgttccgttaccggtcgggtccctaaccggtaacggtaccgtagggaaacgggtaccgtacgggttacttacggttaacttttaacgttaccgcgtaccgtaacgtaccgtaacaaccttaacgtaaccgacgggtcggtacgggttacgggttacgggggtttacggggttcccggggttaccggggggacccgggggtaaccctaccggtacggttacccgggtaacccggttaccgggtaacgggtaccccgtaacccgggtaacccggtcgggtaccccgtacccggtacccccgttaaccggtttcccgggtacccttccggtttaccccccggg

SEQ ID NO: 110141 - DNA, 862 bp, Homo sapiens
  misc_feature: GYAE6OF01DJX3T.10.28.C06.1.454.CMB.1.raw
  modified_base (148)..(148): a, c, t, g, unknown or other
  misc_feature (148)..(148): n is a, c, g, or t
  modified_base (227)..(227): a, c, t, g, unknown or other
  misc_feature (227)..(227): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagtcttgngctgactcaatccgcctctcgcctctcgccctccgtgggacgccgtcggtacaacgctcatcgtgctactcgtaggacncgtaggtcggacaacgacgtaccaaacgacgcctaacgtcgacgtagtcggacagttacgagacacgacgacgacgaaggaacggaaccggtcccgtacggttacgtagtacgtacggtaaaggttaacgtaggtaggacgtacggaccgaacgtaccgaaccggaaaccggggtaacgggggtaaccggtaccggttccgttacggttaccgttttacggtttaccgggtaacgggtcccgtaacggtccggttcgggttacggggtacgtcgggtaaccggtcccgtaccgttaaccccggtccctaaacccgtacccgttacccgtaacccgaccgttaccccggttaaccgtaccgggttaaccggtaacgggtaacgggtacgggttaacgggacccgtttagggtaccccgtttaaagttttaaccgtaccggtttaacggtaaccggttacccggttaaaccgggggttcggttaccggttttaaccgggttggggttttacggtttacggggttaccggggtttaccggggaccggggtaaacggtacccgggtaaccgtcgggttaaccgtacccggttaccggtaccggacgtacccggtcgaacccgggtcccgttacccccgg

SEQ ID NO: 110142 - DNA, 622 bp, Homo sapiens
  misc_feature: GYAE6OF01BHAM5.10.28.C06.1.454.CMB.1.raw
tcagcatagtagtgcacgaccggtgctcgatttagagctcacgtattggggtttgggggagagctctgggggagtctgcaccatggcttggaccccactcctcttcctcaccctcctcctccactgcacagggtctctctcccagcttgtgctgactcaatcgccctctgcctctcgcctcccgtgggagcctcggtcaagctcatctgcactctgagcaggtggcacagcaactacgccatcgcagtggcatcagcagcagccagaggaacgggcctcggtactgataggaaggttaacagtgatggcacgaccacgacggaacggggcggactcccgtagtactttcggtttacgacgggtccaggtccgtcggtgggcgtggacgccgtacctaccctcctacctactcctacccgacgtccctaccgacgtcgtaggacggtatacggacggtctagtacttacgttaacgtcgtaccgtacgggtaccggttacggggactacggtttacgggttagttcgggtttacgggtttcgggacgggtacgggacgtaacggtccgtacggtacccgtaccggtacggtaccgacggacccgtaagggtcccgtaccccgg

SEQ ID NO: 110143 - DNA, 719 bp, Homo sapiens
  misc_feature: GYAE6OF01BXQVZ.10.28.C06.1.454.CMB.1.raw
  modified_base (210)..(210): a, c, t, g, unknown or other
  misc_feature (210)..(210): n is a, c, g, or t
  modified_base (256)..(256): a, c, t, g, unknown or other
  misc_feature (256)..(256): n is a, c, g, or t
  modified_base (315)..(315): a, c, t, g, unknown or other
  misc_feature (315)..(315): n is a, c, g, or t
  modified_base (509)..(509): a, c, t, g, unknown or other
  misc_feature (509)..(509): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccntctctgcactcggacccacagttacattaggtaataatgaatagtntctcctagtaaccaacacgtacccaaggaccaaaccgacccccaaatgatgtaatttangtatgtactagtaactccgaacccttggtacgggtttctagtacgttcgtctttcgtttcgacccttaccgtaaaggttccgtacggaccgaaaccgtaccggccccttcccgtacgacctacgtccgttacgtcgggtccctaccgacggtacgtaggacgggacgacggtactagttaatttactaacggtnaccgtacgtcctacaacgtaactaacggaacggccgggtaccgtacggggtcggggttttacggggtcggggttaccgggggaccgggggtaaccctaccggtaccgttccggtacccggttaccggtacggtacccgaccggtacccgacgggtcccgttacccggtcccccgtacggtacccttccggttcccgttccccgtaccccc

SEQ ID NO: 110144 - DNA, 724 bp, Homo sapiens
  misc_feature: GYAE6OF01C9IDF.10.28.C06.1.454.CMB.1.raw
tcagcatagtagtgcacgaccggtgctcgatttagagctcacgtattggggtttggggagagctctggggagtctgcaccatggcttggaccccactcctcttcctcaccctcctcctccactgcacaggtctctctcccagtcttgtgctgactcaatcgccctctcgcctctcgccctcccgtgggacgtccgttccgggtacaaacgcctcactccttcgacctacgttcgtaggacgcgtaggtcgggaccaacgacggaaccaaacctaccgaccctatccggacaagtcggacaactacgagacacgacgaacgaccgaaggtaacggaaccgggtcccgttacgggttacttagaagtaaggtaaacggtaacgtaggtagtacgtcggacaccgaaccgaacggaaccgggaacggggaccgtacttaccgtagttacgtttacggtttcggacggtccgtacgtccgtcgggtcgggtacgtacggtacgtccgtaccctaccacctaaccgtactcccgtaccgaccgtcccgtacgtacgtcggtagtacggaggttacgacgtactacgttaacttacgttcgtaccgaggtacgtaccggtggtactaggttaggttaggttcgggttacgggttagggacggtaacggaccgtaagtccggtacgttaccgtcggtaacgtaccgacggacccgacggtccgttccccgg

SEQ ID NO: 110145 - DNA, 607 bp, Homo sapiens
  misc_feature: GYAE6OF01DAL0O.10.28.C06.1.454.CMB.1.raw
  modified_base (355)..(355): a, c, t, g, unknown or other
  misc_feature (355)..(355): n is a, c, g, or t
tcagcatagtagtgcacgaccggtgctcgatttagagctcacgtattgggtttggggagagctctgggggagtctgcaccatggcttggaccccactcctcttcctcaccctcctcctccactgcacagggtctctctcccagcttgtgctgactcaatcgccctctgcctctgcctcccgtgggacgcctcggtcaagctcatctgcactctgagcaggtggcacagcaactcgccatcgcatggcatcagcagcagcagaggacggccctcggtactgatagaaggttaacagtgagtggcacgccacgaccggaaggggacggactccgtgtagttcgtttacgacggtccngcgtcggtgggctggacgtccgcctaccctccacctactccctccgacgtccctaccgtacgtcgtaggaggagtggacggtcgtagtacttaacgtttaccgtcgtaccgtacggtaccggtacggggtaccttacggttggtttacggtttcgggttcggggttttacgggacggggtacgggtaccgtaacggtcgtaccggtaccgtaccgtacggtaccaaccggtcccggacggtccgtccccggg

SEQ ID NO: 110146 - DNA, 698 bp, Homo sapiens
  misc_feature: GYAE6OF01ECSEJ.10.28.C06.1.454.CMB.1.raw
  modified_base (231)..(231): a, c, t, g, unknown or other
  misc_feature (231)..(231): n is a, c, g, or t
  modified_base (364)..(364): a, c, t, g, unknown or other
  misc_feature (364)..(364): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacgagggtcctgggcccagtctgccctgactcagcctgcctccgtgtctgggtctctggacagtccatcaccatctcctgcactacggaaccngcagttcgtacttttgtgctttaataactatgtcctcctggtaccagccaccaccaggacaaaccgcccctaaacttccttgttttgacgtcagtaacgccggcctcgaggtacgtccctgacttcggtctcncgtcctacgaagtcgtcgacaaccgtaccgcctccctacgacctcgtcgtcggtctcgacgcgtggaagacgtggacgtctagtacttactcgtcgacgagtcgactatacgtcgaccggacccctaaaggtcgggttcgggtttacgggacggggttacccgggtaaacgtacggggttccggtacccgggttaccgtaccggggtaaccgtacgggaaacccccggtaacgggtccccgttaccccgggtccccccgtttccgggttacccttaacccggttcccggtttacccccggtttccccccgttccccgttcccgttaaccccccg

SEQ ID NO: 110147 - DNA, 716 bp, Homo sapiens
  misc_feature: GYAE6OF01C5JPF.10.28.C06.1.454.CMB.1.raw
tcagcatagtagtgcacgaccggtgctcgatttagagctcacgtattgggtttggggagagctctggagagtctgcaccatggcttggacccactcctcttcctcacctcctcctccactgcacagggtctctcgtcccagcttgtgctgactcaatccgcctctgcctctcgccctcccgtgggacgtccgtcggtacaacgctcatctgcactcgagacgcgaggtgggaccagagacctaaacgtaccgcacttccggactacgtggacataccaacgcgaagaccgaagaccgaaggtaacggaaccggtacccgttacggttaacttaggaacgttaaggtaaacggtttaaacgagtagtagtacggacaacgaccgaacgaaaccgggaacgggggacggtaacgtccgtagtacgtttaccgtttcggacggtacgtagttccggtcggtgggtcctagggaccgccgtacctacccgtacgacctacggttccctaccgacggtccctacgtacgtgtcggaacgtagtcggaaggttcctaaggtaacttacggttaccgtagttaccgaaccggttacccggtcgggtaacttaccgggttaggttaccgttacggggttcgggtttaaccgggacgggttaacggacccgtaagggtcgtaacccggtccgttaacggcggtagaccccgaacgtaccggtccg

SEQ ID NO: 110148 - DNA, 675 bp, Homo sapiens
  misc_feature: GYAE6OF01DBWBO.10.28.C06.1.454.CMB.1.raw
  modified_base (199)..(199): a, c, t, g, unknown or other
  misc_feature (199)..(199): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (264)..(264): a, c, t, g, unknown or other
  misc_feature (264)..(264): n is a, c, g, or t
tcagcatagtagtgcacgaccggtgctcgatttagagctcacgtattggggtttggggggggtctcaggaggcggtcctctcgggacgtctccaccatggcctgggctctgctattcctcaccctcctcactcagggcacgagggtcctgggcccagtctgccctgactcagcctgcctcgtgtctgggtctctggacngtccatcacatctctgcactgacccacagttacattggaataangaatntgtctctggtaccaanacgtaccagacaaacgacccctaaatgagtgtaatttatgatgtactaagtacgtcgacccgttagtaggggtttctggacttcgtctttcttcgcctacgaagtcgtagacaaccgtaccggccccttacccgtacgaccctatccgtcgtaccgggtcctaccgacggtaccgtaggaacgggtacggtacggtacgttaaggtaactttacgttaacgtcggtcacgtacctacactaacgtacgaacggcggtacgtaggggttcggttcgggggtaggttccggggacgggggtaccctaaccgtacgtaccggtacccgtccggtacggtaccgaccggtacccgtaacggccctccgggtacccccgtcggttaccctaccgttccgttccccggtaccccccg

SEQ ID NO: 110149 - DNA, 718 bp, Homo sapiens
  misc_feature: GYAE6OF01EJ4L1.10.28.C06.1.454.CMB.1.raw
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctcgtgtctgggtctcctggacagtccatcaccatctcctgcactggacccacagttacattggtaataatgaatatgtctcctggtaccaacacgtacccaggacaaacgcccccaaaatcgatgtatttatgatgtacaagtaatccgacccttgtaacggggtttctgacttcgtcctttcgttcgcctacccgaaagtctggacctaaacgtaccggcccttcccgtacggtacccgtccgttcgtcggggtcccttacccgaaggtccgttaggaacgggtacgttagggaacgggtacttaggtaactttaaccgtaacgttcgaccgtagccgtactaacgtacgttacgaaccgggtacccctaaacggtaggggtttcggtttacggggccgggtacgggtaacggttaacggtcggtacccggtccggtaggggtacccgaacggtacccggaaacgggtcccctaccgggtcccccccgttacgggtaccctacgttcccgttacccggttcccccacccccgtttacccc

SEQ ID NO: 110150 - DNA, 855 bp, Homo sapiens
  misc_feature: GYAE6OF01ET78A.10.28.C06.1.454.CMB.1.raw
  modified_base (146)..(146): a, c, t, g, unknown or other
  misc_feature (146)..(146): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacaggtctctctcccagcttgngctgactcaatccgccctctcgccctctcgccctcccgtgggacgtccgtcggtcaacgtcctcactctgcctacgttcgtaggacgcgagggtcgggaccaacgtacggacctaaaaccgtaccgccaacgttccggacctaagtcggacctaacgtaccgacggaccgaacgaccgaaacggaccccggaaagggtaaccgggtaacccgggggtccccgtttaacggggtttaaacgtttacggtaacggttaagggttaaaacgggtttaaaccgtaagggtacggtacggttacggaccgaacggaacccggaaccggaaaccggggaaacgggggaaccggtactacccgttacggttacgttttccggttttacggacgggtacctacggtccggtacgggtcgggtccgtagggaccgtacccgtccttacccgtaccgtacctacgtcctaccgaccgtacccgtaccgtacgtaccggtacggaaggtcgtacggtacggtacgttacgtaacgttaacttaacgtacgtaccgggtaacggttacccgggtacgggtaccttaacgggtttcgggtttaacgggtttaccgggtttggggttacccggggagggtaaccgggtaccgaacgggtccggtacccggtaccgtaccggtacggtaccgacccgtacccggacccggtcccgtaccccggg

SEQ ID NO: 110151 - DNA, 596 bp, Homo sapiens
  misc_feature: GYAE6OF01ATUQ6.10.28.C06.1.454.CMB.1.raw
  modified_base (186)..(186): a, c, t, g, unknown or other
  misc_feature (186)..(186): n is a, c, g, or t
  modified_base (409)..(409): a, c, t, g, unknown or other
  misc_feature (409)..(409): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctcccgtgggancctcggtcaagctcatctgcactctgagcgagtgggcacagcaacgtacgccatcgcatggcatcgagcagcacgccgaagacggaacgggtccctacggtactgagtaggtaaggttaacagtagagtggcacgaccacgaccggaacggggacggactccgtagtactttcggtttacgacggtccagtccgtcggtcgggctggacgtccgtacctaccncacctactccctaccgacgtccctcgacgtcgtcggagtgacggtacgtctacgtaacttacttacgtacgtacgtacggtaccgtgggtacttacggtgttacggttggtttcgggttacgggacgggtacggaccgagtcgtacgacccgtaccgtacggacaccggccgacggtccgtccccgg

SEQ ID NO: 110152 - DNA, 897 bp, Homo sapiens
  misc_feature: GYAE6OF01BIA4C.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgccctctcgccctcccgtgggacgccgtcggtcaagcctcacttcgtcgcactcgtgacgcgaggtgggaccacgagaccaactaccgcctacgtcgacagtcggacagtcagcgagacgacgaccgaggtaacggaaccgggtcccgttacggttacgtaggtaagttaagggtaaacggtttaacgaggtagaacgtcgggaccgaacggaccgaaccggaaccggggaacgggggacggtaccgtcccgttaggttacgttttaccggttttacggacgggttccgtacggtccgttacggggtcgggtaccttacgggacggtacccggtaacccttaccccgtaaccaacccgttaacccgttcccgaaacccggtacccgttccccgttacccggtaaaggtttccccggtaaggggtaaaccgggttaacggtaccgggaaccggtttccggttaaactttaacccggtttaaacgtttaccggttaccgggtaacccgtaacccgggttaccggggtttcggggttaaccttaggggttttaacggtttacggggtttacgggttttacccgggggtttacccgggggtaaccggggtaaccggggttaaccctaaacgggttccccgggttaacggtaacccccggtttaaccgggttaccggaccccggttaaaccccggacccgggttacccgggtccccggtttaaccccccccgggg

SEQ ID NO: 110153 - DNA, 699 bp, Homo sapiens
  misc_feature: GYAE6OF01AZP9Z.10.28.C06.1.454.CMB.1.raw
  modified_base (285)..(285): a, c, t, g, unknown or other
  misc_feature (285)..(285): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaagtcgggaagcgaaaagtgactatttggttactttaaattttgtcttcttggtaaccaacagacncccaagaaccaaaacgtacccccaaaaatttactactaattttcctagccttagtacaagtaaacgttccggcccttacgtacggggttttctacgtcgtcttcgtcgtaggctaccaagtcgtaggaccaacgacccggtcctcccgtcgaacctacttccgtcgtcgggacctccgtaaggccgttaggacgggaccgaaggtcttacggtaatttaagttaagttcgacgagttacctcaataactaaccaaaacctaaccgaaaagttccgtttagaacttaggttccgggacgggtaacggaaccctaaacgtcgtaacccgttccgttacgaccgtacgaccctaacggcctacccggtccccctacggttaccaccgttccgttaccgtccccctaccccgttaccc

SEQ ID NO: 110154 - DNA, 653 bp, Homo sapiens
  misc_feature: GYAE6OF01E0EFJ.10.28.C06.1.454.CMB.1.raw
tcagcatagtagtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtggcacagcaactacgccatcgcatggcatcagcagcagccagacgaacgggccctcggtactgataggaagtaacagtgagtggcacgaccacgacggaaggggaccggactcccgtagtacgtttccgttttcgacgggtccaggtccgtcggtggggctggacggccgtacctacccgtcacctacgtccctacccgacgtccctccgagtcgtaggacggtatcgggacggtctacggtaaccttagtttaaccgtcggtaccgacggtacccgggtgggaccgtacgttgggttagttcgggtttccgggggtttacggggacccgggtaacggggtaacccgtagggtcccggttaccgggtaaccccggttacgttaaccggggtaccaacccgggtacccccggtaagggtccccgttaccccccggg

SEQ ID NO: 110155 - DNA, 743 bp, Homo sapiens
  misc_feature: GYAE6OF01DKEEK.10.28.C06.1.454.CMB.1.raw
  modified_base (187)..(187): a, c, t, g, unknown or other
  misc_feature (187)..(187): n is a, c, g, or t
tcagcatagtagtgcacgaccggtgctcgatttagagctcacgtattggggtttgggggagagctctggggagtctgcaccatggcttggaccccactcctcttccctcaccctcctcctccactgcacagggtctctctcccagcttgtgctgactcaactccgccctctgcctctcgccctccgngggacgtccgtcggtcaacgcctcatctcgctactcgtggacgcgtacggtcggaccacgacggacctaaccgtaccgacctacgtccgaccgtagtcggcacgtacgacgacgacgacgacgaccgaagggaacggtaaccgggtcccgttacggtacgttagtaacggtaaggtaaacggttaagtaggtaggtacgtacggaccaaccggacccggaaaccggaaccgggggaaccggggacggtaccgttacccggttagttaccgttttacgggttttacggacgggttaccgacgttccgggtacggtcgggtcgtacgggaccggtcccggtaaccctacccgtacccaccttacgttcccctaccggtaccttccgaccgttagtccggtaggaggtacgtggtacgtctacgttactacgttacgtcgtacgacggtacggtggtacgttcggttgttcggttcggttgggtaccgggacggtacggacggtactccggtacgtcccggttaacgtcggaccaccggtaccgtccggtccgtcccgg

SEQ ID NO: 110156 - DNA, 790 bp, Homo sapiens
  misc_feature: GYAE6OF01CH3TS.10.28.C06.1.454.CMB.1.raw
  modified_base (656)..(656): a, c, t, g, unknown or other
  misc_feature (656)..(656): n is a, c, g, or t
tcagcatagtagtgcacgaccggtgctcgatttagagctcacgtattgggtttggggagagctcgtggggagtctgcaccatggcttcggaccccactcctcttcctcaccctcctcctccactgcacgagggtctctctcccagtcttgtgctgactcaactccgccctctcgcctctcgccctcccgtgggactcccgtcggtacaacgtctacactcgtcgcctacctcgtaggacgcgtagggtcggacacgacgaccaacgtccgccacgtcgactagtcggcactcgacgacgacgacacggaccgaaggtaaccgggtaaccgggtccgttaacggtacgtaaggtaacgttaacggtaaaggttacgtagggtagtaacggtcgaccggaccgaacccgaaccgggtaaaccggggaacggggtaccggtaccgttcccggttaggtaccggtttttaccggttacggacgggtaccgtcggttacggtcggggtacgggtacgtacgggtaccggtccctaacctaccgtacccgaaccgtacgttccccgtaccgtaccgtcccttacggcgttaggtacgggaacgtcggtaacgtcgtacgtaaccgttaatttaccgtggtacgtaccggagggtttaccggnggtttaccttagggttcggtttagggtttcggggttaaccgggttacgggggaaacccgtacgggtactaacggtccgggtaaaccgtcccggttagaccggtaccgaccggtaccggtcgtcccgtaccccgg

SEQ ID NO: 110157 - DNA, 710 bp, Homo sapiens
  misc_feature: GYAE6OF01ADQ9V.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctcgccctcccgtggggacgccgtcggtacaagctcatctcgccactctgacgcaggtgggcacacgaccaactaccgccatccgcatcggacatcagcagcacgaccaggaaggaacgggccccgttacggtaccgttagacgtaggtaaaggttaacgtaggtagacgtacgggaccgaacggacccaaccggaaaccggggaaacggggggaaccgggaccgttacccggtagttacgttttccggttttacggacgggttccacggtcgttcggtgggctgggacgccggtcctaccctctaccacttccctaccacgtcccttaccgacgttcggtaggacggtagtacgggtcggtacgttacgtaacttacgtttacgtacggtacgtaccggacggttacgggcgtacgtttcgggttacgttgggtttccgggtttacgggacggggtaacgggtaccgacggtccgttaccggtacccggttaccgtacggtaccgaaccggacccgtaccgggtcccgtacccccggg

SEQ ID NO: 110158 - DNA, 643 bp, Homo sapiens
  misc_feature: GYAE6OF01ES3IH.10.28.C06.1.454.CMB.1.raw
  modified_base (192)..(192): a, c, t, g, unknown or other
  misc_feature (192)..(192): n is a, c, g, or t
tcagcatagtagtgcacgaccggtgctcgatttagagctcacgtattgggtttggggagagctctgggggagtctgcaccatggcttggaccccactcctcttcctcaccctcctcctccactgcacagggtctctctcccagcttgtgctgactcaatcgccctctcgcctctcgccctcccgtggggacncctcggtcaagctcatctgcactctgacgcaggtggcacagcaactaccgccatcgcagtggcatcagacagcagcaggacggaacggccctcggtacttgataggaaggtaacaggtgagtggcacgccacgacggaacggggacggactccgtggtactttcgtttcgacggtccacgtcgtcggtcggggctacggacgccgtaccttacccaccgaccgtactccctaccgacgtccctaccgacgtcgtacggacggtatggacggtcgtacgtaacttacgttactggtccgtaacggtaccggtcggggtactacggttggttacggttcgggtttacgggtttaccgggacggggtaacgggtaaccgaaggttcccggtaaccggtacccgttacggttacgggtccgaaccgggtacccgtaacgggccccgtaccccggg

SEQ ID NO: 110159 - DNA, 613 bp, Homo sapiens
  misc_feature: GYAE6OF01D1DSS.10.28.C06.1.454.CMB.1.raw
  modified_base (365)..(365): a, c, t, g, unknown or other
  misc_feature (365)..(365): n is a, c, g, or t
  modified_base (427)..(427): a, c, t, g, unknown or other
  misc_feature (427)..(427): n is a, c, g, or t
tcagcatagtagtgcacgaccggtgctcgatttagagctcacgtattggggtttggggagagctctggggagtctgcaccatggcttggaccccactcctcttcctcaccctcctcctccactgcacagggtctctctcccagcttgtgctgactcaatcgccctctgcctctgcctcccgtgggacgcctcggtcaagctcatctgcactctgagcgagtgggcacagcaactcgccatcgcagtcggcatcagcagcagccagaggaacggcctggtactgataggtaagtacagtgatggacacgcacgacggaaggggacgactccgtagtacgttcggtttacgacggtccagtcgtcgngggtctgacgcgtacgtaccctacgacctactcctccacgccctccgacgtcgtaggacggngtacggacgtctagtaaccttagttaccgtaggtaccgtacggtacccggtgggtacctacggttggtttacgttgggtttacgggtttaccggggacggggtaacggtaaccgacggttccggtacggttaaccccgtcggttaccggacgtacccggaacccgtacgggcccgttacccccggg

SEQ ID NO: 110160 - DNA, 876 bp, Homo sapiens
  misc_feature: GYAE6OF01CYENO.10.28.C06.1.454.CMB.1.raw
tcagcatagtagtgcacgaccggtgctcgatttagagctcacgtattgggtttggggagagctctggggagtctgcaccatggcttcggacccactcctcttcctcaccctcctcctccactgcacaggtctctctccagcttgtgctgactcaactccgccctctcgcctctcgtcctccgtgggacgtccgtcggtacaacgctcatctgctactcgtggagcgaggtcggacaacgacgacaacgtacgccaagtccgcgagtcggactacgtacgacgacacgtacaacggaccgaacggaacgggaaccgggtcccgttaacgggttacttaaggtagtaacggtaaacggttaacgagtacggagtacggacgacggaccgaaacggaaccggggaacggggtaccggtacgttaccgttaggttacgttttacgggttttacggacggttaccgtacggttccgtacggggtcgggtaccgtacgggtaccggtaccggttaacccttacccgaaccgtaacccgttccgttaccccgtaccgtacccggttacccgtaccggtacggttacggtaacgggtacgggtacgttacggggtaacgtccgtttaaacgtttaaccgtttacgtttaacggtaccggtaacgggtaccgggttaccgggttacgggttaaccgtttacggggttttaaccgggtttaggggttttaccggggggtttaccgggttttacccgggggaaacggggttaacccgggtaaccggttaaccgggttccggttaaacccgggttacccgggttacgggttaaccgggtacccgtaaaccggggtaaccccggtacccggttcccggttacccccggg

SEQ ID NO: 110161 - DNA, 927 bp, Homo sapiens
  misc_feature: GYAE6OF01BXXCD.10.28.C06.1.454.CMB.1.raw
tcagcatagtagtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatccgccctctcgccttctcgccctcccgtgggacgtccctcggtcaagcctacatctgcctacctcgtaggacgcgtacgggtcgggaccaacgagaccaaaccgtccgacctaagtccgacagtcggacatcgagcacgacacggaccgaaggaacggaaccggtcccgttacggttaacgttacgtaagtaacggtaaacgttaacgaggtagaagtcggaccacgaacccgtacgaaacggggaacggggacggtaccttccggtagttacgtttaccggttttacggacgggttaccctacggtcggttcgggtcggggtaccgtacggaccgtacccgtacccgttaacccgttacccgtaaccgttaccgttaccccggttaacccgtacccgttaccccgttaacccgttacgggttaccggttaacgggaacgggtaaccggttacggggtaaccgttacccgttaacgggtttaaaaccgttttaacctttaaccggggttaccgttaaccgggtaaccccgggttaacccggggttaccgggttaacccggtttaacgggtttaggggttttaaaccgttttccggggggggtttttaacgggggttaacccgggggtaccggggtaaaccggggttaacccggaaccgggtttccccgggttaaacccggggtaacccgtttacccggggttaaaccggtaccccggtaacccgggtaacccccgggttaaacgggtccccccggttaaccccccggg

SEQ ID NO: 110162 - DNA, 621 bp, Homo sapiens
  misc_feature: GYAE6OF01CK8LW.10.28.C06.1.454.CMB.1.raw
  modified_base (235)..(235): a, c, t, g, unknown or other
  misc_feature (235)..(235): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
tcagcatagtagtgcacgaccggtgctcgatttagagctcacgtattggggtttggggagagctctgggggagtctgcaccatggcttggaccccactcctcttcctcaccctcctcctccactgcacagggtctctctcccagcttgtgctgactcaatcgccctctgcctctgccctcccgtgggacgcctcggtcaagctcatctgcactctgagcagtgggcacagcaacncgccatcgcatggcatcgagcagcacgccgaaggacggaacgggcccttacggtacgtagagtaggaaggttaacgagtgagtggacgacgaccgaaccggaaccgggaacggggtaccggacgttcccgtggtacgtttcggtttcggacggtccgacgtcgtcggtcgggctggacgccgtcctacctccactactccncgaccncctacgcgtcgtaggacgtagtcggacgtcgtacgtagttctagtcgtacgtacggtacggtcgggtactacgttagggttgtcgggttcggttacgggacgggtacggtaccgtacggtccggttaccggtaccgttccgtacggtacgaccgtaacccggcggtcccgtcccccggg

SEQ ID NO: 110163 - DNA, 771 bp, Homo sapiens
  misc_feature: GYAE6OF01ER1JC.10.28.C06.1.454.CMB.1.raw
tcagcatagtagtgcacgaccggtgctcgatttagagctcacgtattggggtttgggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctctgcactcggacccacagttacattagtaataatgaaatatcgtctcctggtaccaacacgtacccaggacaaacgacccccaaactgatgtatttatgtatgtacagtaactccgtaccctcgtacggggtttctgtacgtcgtctttctttcgccttaccgaaggttctaggtaccaacgtacccggtcccttacccgacgtaaccctagttaccgttccgtcggggtccctacccgtaaggtaccgttacgggaaacggggaaccggtacgggtacgttacggtaacgttttaactttaaccgtgaccgtaacggtaccctaccgtaactaacggttaaaccgaacgggtaccgggtacggtaacggggttccggggggtttaggggtttccggggttaccggggggacccgggggggtaaccaaccggtaacccggttcgtaccccgggttaccggtaccgggtacgacccggttaccccggaacggtcccgtaccccggtccccccggttacggtacccgttaccgtttcccgtttcccgtttaccccccg

SEQ ID NO: 110164 - DNA, 682 bp, Homo sapiens
  misc_feature: GYAE6OF01D62JA.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgcctctgcctctcgcctcccgtgggacgccgtcggtcaagctcatctgcactctgagcagtgggcacagacaacgtaccgcatcgcagtcggacatcgagcgagcagccgaggagaacgggcctacggtactagagtaggaaggtaacagtgagtggcacgaccacgaaccggaacggggacgacgtccgtgtacgttcgtttacgacggtcagcgttcggtacgggcgtcggacgtcctaccgtacccgtaccaccgtactaccctaccgtacgtccctaccgaggttccgtaggacggtagtacgggacggtacgttagtaacgtttacgttaccgttacggtaccggacggtaaccgggttcggggtaaccttacgggtttacgggtttaggttgggtttaccggggtttccgggaacggggtaaaccgggaacccgtaggttcccggtaccgggtaacccggtaaccggttacgggtaacccgaccggtaaccccggtacggtccccggttacccccgg

SEQ ID NO: 110165 - DNA, 772 bp, Homo sapiens
  misc_feature: GYAE6OF01CTYDF.10.28.C06.1.454.CMB.1.raw
  modified_base (226)..(226): a, c, t, g, unknown or other
  misc_feature (226)..(226): n is a, c, g, or t
tcagcatagtagtgcacgaccggtgctcgatttagagctcacgtattggggtttggggagagctcgtggggagtctgcaccatggcttcggaccccactcctcttcctccaccctcctcctccactgcacgtaggtctctctccagtcttgtgctgactacaagtccgcctctcgcctctcgtcccttccgagggacgtccgtcggtacaacgctactacgtccgngcctaacttcgtaggacgacgaggtacgggacaacgtacggaaccaacaaccgccaacgtccgacgaagtcggacctaagacgacgacgaacgaccgaacgaccgtaaggaaccgggaaaccggtcccttaggttacgttaggaaacgttaacggtaaaggttaacgaggttaggtaacgtcgggacgaacgaccggaaacggaaccggggaacggggtacgtaaccgttaccgtagttacgtttacggtttacggacggttaccacggttcgtgggttacggcgttacggacgtcccggtaacctaccgtaccacgtaacctcctaaccgtaccgtccttacggagttcgacggagacgtagaccgtatacgtaacgttaactacgtcgtaacgacggttaccggagtaccttagggttgttaggtttcgggtacggggtttacgggaacggtaaccgggaagttacgtaccgggttaccggacccgtttaaacgtacccggggtaacgaccggaaccccggtacggtcccggttaaccccccgg

SEQ ID NO: 110166 - DNA, 744 bp, Homo sapiens
  misc_feature: GYAE6OF01BZEI7.10.28.C06.1.454.CMB.1.raw
  modified_base (219)..(219): a, c, t, g, unknown or other
  misc_feature (219)..(219): n is a, c, g, or t
tcagcatagtagtgcacgaccggtgctcgatttagagctcacgtattggggtttggggagagctcgtggggagtctgcaccatggcttcggaccccactcctcttcctcaccctcctcctcactgcacgacgggtctctctccagtcttgcgctgactcaacgtccgcctcgtcgcctcgtcgcccgtccggtggggacctccgtcggacacgtctacngtcgtcgctactcgagacgcgagggtcgacacacgacaactcgactagtcgacgtacgtcggactacgacgacgaacgtacgaccgtacggacgaacgggtaacgggtaccggtacccgttaggttacgtagtaacggtaaggttaaacgtacgagtagagcgacaacgccgaacggacgggacgggactcgtcgtacgttcgttcggttacggaccggtagtacgtcggttacggggtacgtacgtacggaccgtccggtaacctaccggtacctaaccgtactacccgaccgtaccgttaccgtacggaacgtacggtaggggaaccgtagtaacggggttacgacgttaaaccgggttacttaacgttaccggtactaaaccgggtacccggtacgggttaggtaacccgtttggttaacgggttcggtttagggttccgggttaacgggacggtaacggtacggacgtccgggtaccgtacggtacggtaccgtacgaccggacgtaggcccgttacccgg

SEQ ID NO: 110167 - DNA, 725 bp, Homo sapiens
  misc_feature: GYAE6OF01A2S82.10.28.C06.1.454.CMB.1.raw
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggacccaccagttacattaggtaataatgaatatgtctcctggtaccaacagtacccaggcaaacgacccccaaatgatgatttatgatgtcagtaatcgaccctgtaggggtttctgatccgtctttctttcgcccttcctaaacgtcgtacggccaaaccgtaccgggtccctccccgtacgacccgtattccctcgtcggggacctcccaggaccttacggacggacgggtacgtctaggtaatttacgttaactgacacgtcctacgaactaacgtaaccgtaagggccggacggtagggtccgggggttttggggttccgggttaccggggggacccgggggtaacccctaggacccggttacggtaaccccgggttaccgttaaccggggtacctaacccggggaccccgtaaacgggggtccccttaaccccgggccccccccggtttacgggttaccctaccggttccccgtttcccggtttaaccccccccccg

SEQ ID NO: 110168 - DNA, 727 bp, Homo sapiens
  misc_feature: GYAE6OF01BFRQP.10.28.C06.1.454.CMB.1.raw
  modified_base (147)..(147): a, c, t, g, unknown or other
  misc_feature (147)..(147): n is a, c, g, or t
  modified_base (537)..(537): a, c, t, g, unknown or other
  misc_feature (537)..(537): n is a, c, g, or t
tcagcatagtagtgcacgaccggtgctcgatttagagctcacgtattgggtttgggggagagctctggggagtctgcaccatggcttggaccccactcctcttcctcaccctcctcctccactgcacaggtctctctccagcttgtnctgactcaatccgccctctcgcctctcgccctcccgtggggacgcccgtcggtacaacgcctcactctgccactctgagcaggtgggccacagcaactaccgccatcgacagtggacactcgacgcgaggccacggaccgaagggaacggtaccggggtaccccgttacggttacgttaggtaacgtaaggtaaacggttaacaggtacgaggtcggacgacgacccgaaccggaaccggggaacggggaccggtcgtacccgttagtacgttttcggttttacggacggttcgacgtcgttcggtcggtacgtacggacgtccggtaccttaccctaccgacctaccgtcctaccgaccgtccctaccggtacgtacgtgggagtacgnggtacgtctacgtaacgttacttacgtacggtacgtacggtaccgggtacgggttactacggtttacggttacggttcgggtttccggggtttaaccgggaccggggtaaccggtaacgtacggtcccggtaacccggtcccgtaccggtacggtacccgaccggtaccgacccggtcccgtacccccgg

SEQ ID NO: 110169 - DNA, 752 bp, Homo sapiens
  misc_feature: GYAE6OF01AP8Z8.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacaggtctctctcccagcttgtgctgactcaatcgccctctgcctctgccctcccgtgggacgcctcggtcaagcctcatcgtgcctactctgacgcgaggtcggccacgagacaactaccgccatcgcatcggacatcagcagcacgaccgagacggaacggtccctacggtacgtgagtacggtaaacggttaacgtagtagaagtcggaccgaacgccgaaccggaaaccgggtaacgggggaccggtaaccgttcccgtaggttacgtttccggttttaccggacgggttacccacgtccgttcggtcggggccgttacggaacggcccgtaccttacccgtacctaacccgtacgttcccctaccgacccgtcccgttaccgtacggtccgtacgggacgtacggtacggtacggtacgtaacgtaacgtttacgttaacgttaccggtacgtaaccgggtaccggacgggtaccgttacgttagggtttacggttacgggtttacgggtttaccggggacggggtaccgggtaacccgaacgggtccgttaaccggtacccggttaccggtaccggttacccgaacccggtacccgggtaaccgtccccggttaacccccgg

SEQ ID NO: 110170 - DNA, 797 bp, Homo sapiens
  misc_feature: GYAE6OF01BY8LL.10.28.C06.1.454.CMB.1.raw
tcagcatagtagtgcacgaccggtgctcgatttagagctcacgtattggggtttggggggggtctcaggaggcggccctctcgggacgtctccaccatggcctgggctctgctattcctcaccctcctcactcagggcacgagggtcctgggcccagtctgccctgactcagcctgcctccgtgtcgtgggtctcgtggacagtccatcaaccatctctgcacgcgacccactagttactagttaggtaaataatagtaaatagtcgttaccgtaccttacgggtaaacccaaacgtaaccggtaacccgaagggaaccaaaaaccgaaccccccctaaaagtagtaacgttaggtaatttttaacgaggtaacgttaggtactaacggtaaacctcccggtaaccctagggttaacggggtttctaggtaacttccggtctttacgttcgaccctactaaacgtccgtacggaacccaaaccgtaccggtaccctcccggtaacgtacctaacgttctcgggtaccgggtcctaccggtaacgtacggagggtaacgggaacgtacgggtacttaaggttaactttacgttaacgcgaacctacgtaccgtaacaacgtaacgaacgtacgacgggtacgtaggggttccggggtttagggtcggggttaccgggggaccgggtaacccacggtacggtaccgtaccgttaccgggtacgtacggaccgtcccgggacgtccccgtacccgtccccgtacgggttaccctaccgtttcccgttccccgtacccccg

SEQ ID NO: 110171 - DNA, 935 bp, Homo sapiens
  misc_feature: GYAE6OF01DAU2X.10.28.C06.1.454.CMB.1.raw
  modified_base (190)..(190): a, c, t, g, unknown or other
  misc_feature (190)..(190): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaactcgccctctcgcctctcgcctcccgtgggacncctcggtacaagctcatctgactactctgacgcgagtcgggacacgagcaaactcgccatcgctagtcggacatacgacgcacgaccacggaccgaaggaacgggtaaaccgggtccccgttacgggttaaccgtttaggtaacggtaacgggtaaacggggttttaaaacgtaggttacggtaacgtacgggaaccgaaccgggaacccctaaaccggggaaaccggggtaacgggggggtaaccgggtaacccgttaccccggttaggtttaccgttttacccggttttttaacggaccgggggttaacccgtacgggttcccggttcgggttacggggggtcctttaacgggacccgggtacccgttaacccgttacccgttaaccctaaccgtacccgttaccccgtacccggtaacgtacccccgttaccgttaccgtacggttacgggtaaccggtaaggttaccgggtaacggttacgttaaccggtttaacgttaaccgttttacccggttacggttaaccggtacccggttaaccgggttcggggtaaccgtttagggtttaccggtttaacgggtttccggggttttacggggttttcccggggaaaccggggtaaccggggtaacccggttaaccggttcccgggttaaccgggttaacccccggttacccggttaaaccggtacccggtaacccgggtaccccggtaacgggtcccccggttaaccccccggg

SEQ ID NO: 110172 - DNA, 730 bp, Homo sapiens
  misc_feature: GYAE6OF01CE7VY.10.28.C06.1.454.CMB.1.raw
  modified_base (317)..(317): a, c, t, g, unknown or other
  misc_feature (317)..(317): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccaatcaccatctcctgccacgtcggacccactagttacagttgtaaatatgaactatgtctctacggtaccaacacgtaccaggacaaaacgccccaaagtgatagtatttagngtatgtacaagtaactccgaaccttgtagggtttactgtattccgtactttcttcgcctacgtaagtctggacaaccgtaccggtccctacccgtagtacccctaagttcccgttcggtaccgggtacccttaccgaacggtaccgtaagggaacgggtaccggaaggtacctaaggttaactttaacgtacgtcgtacgacgtctaacaacctaagtaaacgaccggtacggtcgtaacgggtcggggtttacgggtcgggttaccgggggaccgggtaaccgtacgtaccggtaccggtaacccgttaccggttaacgggtacccgaccggtaaccccggaacgggttcccctacccgggttaccccccgtaggttaccctaccgttaccccgttcccgttaacccccccg

SEQ ID NO: 110173 - DNA, 846 bp, Homo sapiens
  misc_feature: GYAE6OF01DV45D.10.28.C06.1.454.CMB.1.raw
  modified_base (662)..(662): a, c, t, g, unknown or other
  misc_feature (662)..(662): n is a, c, g, or t
tcagcatagtagtgcacgaccggtgctcgatttagagctcacgtattggggtttggggagagctcgtggggagtctgcaccatggcttcggaccccactcctcttccctccaccctcctcctccacgtcgcacgaggtctcctccgtcccagtctttgcgtctagacctacaactcccgtcccttctccgtccttcgtccggtccccgttcccggtaggggaccgtcccgttacgggtaccaacgtccttactacgttccgtaccgacctaccttcggtacggacgtacggtacggggtccgggaccaaccgacgtaaaccgaacccggtaccgacctacgtccgacgtacgtacggactacgacgacgacgacggaccgaacggacggaacgggtaaccgggtaaccggggttcccgttaggttacgtaacggtaacggttaacgggtaaacggtttaacggacggtacggacggtacggaaccgaaccggacccggaacgggaaaccgggggtaacggggtaccgtcgttaccgttacggtttacgttttcggtacggtaccgtcgtcggtacggtcgggtacggcgtacggaccgtcctaccgtaccgaccgtacaccgttaccgacctaccgtcgtacgtcggtacgagggttaccgngtacggtacgttactacgttacgttaccgtacggttacggccgtaacggtacgggtcttaacggttcggttaggttcgtttcgggggtcggttaacggtacgggaccggttagacggttcccgggtccggttacggtaccgtacgggaccctaaccgggacccgtcccgggtacccgttccccg

SEQ ID NO: 110174 - DNA, 789 bp, Homo sapiens
  misc_feature: GYAE6OF01BCRKP.10.28.C06.1.454.CMB.1.raw
  modified_base (174)..(174): a, c, t, g, unknown or other
  misc_feature (174)..(174): n is a, c, g, or t
  modified_base (520)..(520): a, c, t, g, unknown or other
  misc_feature (520)..(520): n is a, c, g, or t
tcagcatagtagtgcacgaccggtgctcgatttagagctcacgtattggggtttgggggagagctctggggagtctgcaccatggcttggaccccactcctcttccctcaccctcctcctccactgcacacgggtctctctcccagtcttgtgctgtacctcaactccgccctntcgcctctcgccctcccgtgggacgtccgtcggtcaagtcgtcgattcgtcgcctacttcgtacggacgcgtaggtcgggaccaacgacggtacctaaccgtacccggacctaacgtccgacctagttacggactacgttacgagaccgagaccaacggacccgtaaggacgggtaaccgggtcccgttacggttacgtaggacgtaggtaaacggttacgaggtagagtcggacgacgaccgaacgaaccgggaaggggtacgtacgtaccgtacgtacgtttacgtttacggaccggtacgtacgtcgtcggtcgggtctacggtacgtccgtacccttaaccnccgtaaccgtactcccgtaaccgactacccgtacgacgttcggaggtaacgtcgtacggtacgtacttaacgggttaacttacgttaccgtagttaccggaacgttaccgggttacgggtacttacgggtttacgggtttcgggttacgggtttaccgggtttacggggaaccggttaaacggggtactaacgggttcggaacccggtttaccgtaccggttaacggtcccgtaaaccgggtacccacgggttcccgttaacccccggg

SEQ ID NO: 110175 - DNA, 974 bp, Homo sapiens
  misc_feature: GYAE6OF01EJ0P6.10.28.C06.1.454.CMB.1.raw
  modified_base (166)..(166): a, c, t, g, unknown or other
  misc_feature (166)..(166): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctntcgcctctcgccctcccgtgggactccgtcggtacaagtcctcatctgcctactcgtgacgcaaggtcggacacgagaccaaactaccgccatcgcagtcggcatcagcagcacgccaaggacggaaccgggtcccgttacggttacgttagaacgttaaggtaaaacggtttaaccgaggttagacggtacggaccgaaacggaccccgtaaaccggaaaccgggggaaacggggggtaccggtaccttacccggttaggttacgtttttcccggttttaacggaccggggttacctacggtccggttcgggtacggggtaccgtagggtaacccggtccgtacccgtttaacccgtacccgtaacccgttaaccgttccccgtaacccggaccgttaccccgttaaccggttaaccgggttaccgtaacggggtaacgggttaaccggtaccggggtaaccggttaaccgtttaacggttaaacccgttttaacggtttaaccccggttaccgggttaaccccgggttaaaccggggttaccccggggtttacgggggttaaccctttaacgggggtttttaacggggttttacgggttttccggggggttttttaccggggggttttaaacccggggggaacgggggtttaaaccccggggttaaacccggttaacgggtttccccgggtaaaccccgggggtttaaccccggtttaacccgggttaaacccgggttacccccgggaaaccccgggtaacccccgggttaaaccggggttccccccggtttaaccccccccgggg

SEQ ID NO: 110176 - DNA, 772 bp, Homo sapiens
  misc_feature: GYAE6OF01D5J3B.10.28.C06.1.454.CMB.1.raw
  modified_base (678)..(678): a, c, t, g, unknown or other
  misc_feature (678)..(678): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctcgccctgactcagcctgcctccgtgtcgtgggtctccgtggacacgtccactcaccatcctcctgcacgtcggacccacctagttacattaggtaataagtgaaattagtcgtcctccgtacggtaaccaaactacgtaacccgaaggaccaaaaaccgacccccctaaaagtgtaattacgttaagttttatacggtaattcggtacgtaagttaaacctcccggtaacccgtttacggtaacggggttttctacggtaacgttccgttccgttttctttccgacccgttaaccgtaagttccgtacggaacccgaaaccggtcccgtccccttacccgtaccgacctacgtttccgtcggttacgggtacccttacgaacgtaaccggtaggaacggggtaacgtaggtacgttacggttaaatttacgttacgtcggactacgtcaaccgaactaagaacgaagggccggacggtaggggtcgggtttgggccggttaccggggaccgggtaaccncgtacggtccgaaccgttaccggagtccaaccggtccgaacgggtcctccccggtaccccgtcgtacctacccgttccgtcccgtaaccccccg

SEQ ID NO: 110177 - DNA, 836 bp, Homo sapiens
  misc_feature: GYAE6OF01AFLX7.10.28.C06.1.454.CMB.1.raw
tcagcatagtagtgcacgaccggtgctcgatttagagctcacgtattgggtttggggagagctctggggagtctgcaccatggcttggacccactcctcttcctcacctcctcctccactgcacagggtctctctcccagcttgtgctgactcaatcgcctctcgcctctcgcctcccgtggggacgccgtcggtacaacgctcactctgcactctgacgcacggtggcacacgaccaactacgccacgtcgcagtcggcatcagcagacacgaccgaaggaacggaaccggggtcccgttacggttaaccgttaggtaacgttacggtaaacgggttaacgtaaggttaggacgtacgggaccgaacggacccgaaaccggaaccggggaaacgggggggtaccgggtaaccgttcccggttacggttacgtttttccgggtttttaccggaacggggttcccgaacgggttccggttacgggtcggggtaccgtacgggtaccggtcccgtacccttaacccgtccgtaaccgtaccgttcccgtaacccgaccgtaccccgttaccgtacggttaccggtaggacggtagacgggtacggtcgttacgtaacgtttaccgttacgttacggtaccgtaacgggtccggttacggggtacccgttacgggtttacggtttagggtttaccggggttttcggggtttaccggggtaccggggtaaaccgggtaccggtaacgggttcccggtaacccggttacccgggttaacccggttacgggttacccgtaacccgggacccgggttaaacccggttccccggtacccccggg

SEQ ID NO: 110178 - DNA, 735 bp, Homo sapiens
  misc_feature: GYAE6OF01DOY8P.10.28.C06.1.454.CMB.1.raw
tcagcatagtagtgcacgaccggtgctcgatttagagctcacgtattggggtttgggggagagctctgggggagtctgcaccatggcttggaccccactcctcttcctcaccctcctcctccactgcacagggtctctctcccagcttgtgctgactcaatccgcccttctgcctctcgccctcccgtgggatccgtcggtcaagctcatctgcctactctgacgcgaggtcgggccaacgacgacaacgtaccgacctagtcgacagtcggactactaccgacgacacgacgacgacgaaggaacgggacgggtacccgttcggtacgttaggacgtaaggtaacggtaacgaggtagtaggtcggacacgaccaacggacggaacggggacgtacgtccgtgtacgtttcggtttacggacggtcacggtcgtcggtgggtcgtaggacgtcgtaccctaccgtccgtacctactaccgtccgtaccggtcctcgtacgtcgtacggagacgtgggtaacgtcgttacgttaattaacgtttacgtaccggtacgggtaccgtccgggtacgggtacgttcggtttaagggtttccggttaggggtttaccgggtttaccgggggtacggggtaacccgggtaaccggttaacgggtcggttaacccgggtcccggttaaccggtccgggtaacgaccccgggacccggtacggtccccggttaccccccggg

SEQ ID NO: 110179 - DNA, 717 bp, Homo sapiens
  misc_feature: GYAE6OF01DQP9I.10.28.C06.1.454.CMB.1.raw
tcagcatagtagtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatcgccctctgcctctcgcctccctggggacgcctcggtcaagtcctcgtactctgcactctgagcaggtcgggacacacgacaactacgccatcgcagtcggacactcgagcacgcacgccgaaggacggaacgggcccgtaggttacttagagtacgggtaaacggtaacgtacggtagtacgtcggacgaacgaccgaacgaaccgggaacgggggtaccggtacttaccgtaggtacgtttaccgttttacggacggtaccgacggtcgtcgggtggggcgttacggacggtccgtaccttaacccgtaccgtacctacgttcccaccgaccgtcccgtacaccgggttctaacgggtacgtacgtacggtacgtacttacgtaacttacgttacgtacgtaccgtaacggtaccggttgggtaccttaggttacgggttagttcgggttaccggggtttcggggaaccgggtacgggtaaccggtaacggtcccgttaacgggtcccgttacggtacggtaccgaccggtaacccgacggtcccgttaccccggg

SEQ ID NO: 110180 - DNA, 935 bp, Homo sapiens
  misc_feature: GYAE6OF01AR78P.10.28.C06.1.454.CMB.1.raw
tcagcatagtagtgcacgaccggtgctcgatttagagctcacgtattgggtttgggggagagctctgggggagtctgcaccatggcttggaccccactcctcttcctcaccctcctcctccactgcacagggtctctctcccagcttgtgctgactcaatccgccctctgcctctcgccctcccgtggggacgtcccgtcggtacaagtcctcactctgcctactctagagtcgagggtcgggaccaacgacggaccaaaccgtaccgacctaacgtccggacctagtcgggacctaactccgacgaccgacggacgaccggaacccggaacgggtaaacggggtaacccgggggtccccggttaccggggtttaaccgtttagggtaacggttaacgggtaaaacgggtttaaacggtaacggttacgggtaaacggttccggggaaccgaacccggaacccggaaacccgggaaaccgggggaaaaccgggggggtaccgggtaaccgttcccggttaacggttacgtttttaccggggttttaccggtaccggggtacccgtaccggtccggttccgggtacgggggtaccgtacgggtaacccggtccgttaccccgttaacccgtaccgtaaccccgttacttaccccgtcccgaaccggttccccttaaccggtaacgtttccgggtacgggtaagggtacggttacgggacgggttacttaaccgttaaccgtttaacgttacggtacgtacgggtaaccgggtaccgggtacgggttcgttaacggtttggtttaccggggttcgggttttacggggttaccgggaacggggtaaccgggtaccaaccggggtttcctaccggggtacccgttacgggtaaccggtaccggtaacccggcccggtccgggtcccctaccccccgggg

SEQ ID NO: 110181 - DNA, 737 bp, Homo sapiens
  misc_feature: GYAE6OF01CJ2IY.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctcgcctctcgccctccgtgggacgccgtcggtcaagctcatctgcactcgtgagcgaggtcggaccacgagaccaaactaccgaccagtccgactagtcggcatcgacgcacgacgacgaccgaaggaacgggaaccgggtcccgttacggttacgttggaacgtaggtaaacggttaacgaggtacgtagtacggaccgaccggaccgaaccgaaccggggaacgggggaccggtacgttacccgtaggttacgttttccggttttacggaccgggttaccgaggtaccgttcggtcggggcgtacggacggtcccgtaccttacccgtaccgaccttaacgtcccgtaccgaccgtacccctaccgtacgtcggtacggaggtacgtacggacggtacgttagtaacctttagttaaccgtcggtacgtacggtaccggtacgggtaccgttaggttggttacggttgggtttaccgggttacggggacgggtacggtaaccgtacggtccgtaccgggtaccgttacggtacggtaccgtaccggaccggtacggtcccgtaccccgg

SEQ ID NO: 110182 - DNA, 874 bp, Homo sapiens
  misc_feature: GYAE6OF01B66PJ.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaactccgccctctcgcctctcgccctcccgtgggacgccgtcggtcaacgtcgtcactcgtcgactactcgtagacgacgaggtgggaccacacggacctaacgtaccgcctacgtccgactagtcggaccagtcgacgcgacgacgacgaccgaaggacggaccggtccgttacggtacgttaggtagtacggtaaaggttacgaggtagacgtacggaccgaacgaccgaaccggaaccggggaacggggtaccggtaaccgtttaccggtacggttaccgttttaccggtttacggaccggttaccgtacgtccggtcggtggggtaccgacgggtaccgtcccgttacccgtaacccgttcgaaccccgttaccttacccgaacccgtacccgttaccccgttacgggacggttacccggtaaggggaacggttaccggtcgggtaaccggttaccgtttaaccggtttaaacctttaccggttttacccggtacgtaacccggggttaccggtaccggggttacgggttcccgttaaaggttttcggggtttaacggggttcgggttttacccgggggttaacggggaccggggtaaaccgggttaacggttaaccggttcccggtaaaacccggggtttccccggttaacgggtaccggtaaccccggttaaacccggcccgggttaaccgggttccccggttaccccccggg

SEQ ID NO: 110183 - DNA, 831 bp, Homo sapiens
  misc_feature: GYAE6OF01ED686.10.28.C06.1.454.CMB.1.raw
  modified_base (380)..(380): a, c, t, g, unknown or other
  misc_feature (380)..(380): n is a, c, g, or t
  modified_base (431)..(431): a, c, t, g, unknown or other
  misc_feature (431)..(431): n is a, c, g, or t
tcagcatagtagtgcacgaccggtgctcgatttagagctcacgtattggggtttggggggggtctcaggaggcggccctcgtcgggacgtctccaccatggcctgggctctgctattcctcaccctcctcactcaggcacgagggtcctgggcccagtctgccctagactcagtcctgccttccgtgtcgttgggtcctccgtggacacgtccaatccaaccctatccgtccgttgacctacgtaccggaaccccacctaagttacctaagtttaggtaaaataagtagtaatagtcgttcctacccgtaggtaaaccaaaccgacgttaaccccgaggaaccaaaaccgaccccccgtaaaatggacttagtaatttanggtaattcggtactaaaggttaactcccggtacctacggttagggtttacngtacgttcgtctttaccgttcgccgtaacaacgttcgacggaacctaaccgccggaccccttaccgacgtaacctagttctacggcgggtaccctacgaacgtactagggaaacggaccggagtacgttaagtaacgttttaacctttacgtcgtaaccgtaggtaaccctactaaaccaacttaacggaaacggacccgggacggtaacggggtttccggggtttaggggttacggggttccccgggggaccgggggtaacccctaacggtaaccggttccgggtaaccccgttcccggggttaaacgtacccgggaacccgacccgaacggggttccctaaccccgggttcccccggttagtccccgtaaactttcccgtaccccggttacccccccg

SEQ ID NO: 110184 - DNA, 805 bp, Homo sapiens
  misc_feature: GYAE6OF01A8PFB.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctagactcaatccgccctctcgcctctcgccctccgtgggacgcctcggtcaagctcatctcgctactcgtaggacgctaggtcgggaccaacgacggacctaaaccttaccgaccgaattccggctaagtgggacctaagtcaaacgccgacgaccgaacggaccgtaaacggaacgggtaaccgggtaccccgttacggggttaaccttagggtaaccgtaaagggttaaacggtttaaaccgtaggttaccggaaggttacgggaaccgaaccggtaacccgaaacccggaaaccggggtaaacgggggaaccggttacccgttacccggttagtaaacccggtttttccggttttaaccgggaacggttacccgacggtaccgtcgggtacggggtctacggtacggtccgtaacccttaccctacggtaacctcgttaccacccgtacgttaccccgcgtaacgttccgagggtacgtacggttacggaccggtttataaacccggttaacgtttacttacgtacggtacgtaccggtacgggttcggtacccttagggttacggtaggttcgggtttcgggttaaccggacggtaacggtactacgtccgtacgtaccgtacggtactcggacctcgaccgtcgtaccccg

SEQ ID NO: 110185 - DNA, 841 bp, Homo sapiens
  misc_feature: GYAE6OF01CL616.10.28.C06.1.454.CMB.1.raw
tcagcatagtagtgcacgaccggtgctcgatttagagctcacgtattgggtttggggagagctcgtggggagtctgcaccatggcttggaccccactcctcttcctcaccctcctcctccactgcacagggtctctctcccagcttgtgctgactcaatccgccctctcgccctctcgccctcccgtgggacgtcccgtcggtacaacgcctacacgttctcgcctactcgtggacgtacgaggtcgggacaacgacgaacctaaccgtcgcctagtccgacacgtcggacctataccgacgaccgaacgaccgaacggaccgtaaacgggaaaccgggtaacccgggtacccccgttacgggtttacgttaacggtaagttaacggggttaaaacggtttaaaccggtaggttaggtacggtacgggaaccaccggaacccgaaaccgggaaaccgggggaacggggggtaaccggtaaccgttcccggttaacggttaccgttttaccggttttacggaaccggttaccgtacgtccggttacggggtcgggtacgtcggaccgtccgtacccttaacccgtctaacccgtaccttcccgtaccggtacctaccgttaccgaccgttacggtaggtaacggtacggtaacgtacggttaccgtaacgttaccttaacgttcgtaacgtacccggtaacggttccggggtacggtaccgttaggtttcgggttacgtttcgggttacggggttacgggtaccggtacggtaaccgaccggttccgtaccggtacccggtacgtaaccgtcggaaccctccgggacgtccccgtaccccgg

SEQ ID NO: 110186 - DNA, 764 bp, Homo sapiens
  misc_feature: GYAE6OF01ENZ9D.10.28.C06.1.454.CMB.1.raw
  modified_base (165)..(165): a, c, t, g, unknown or other
  misc_feature (165)..(165): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctntgcctctcgccctccgtgggactcctcggtcaagctcagtctgcactcgtgagcgtaaggtgggaccaacacggacctaaaccgtaccggcccctaagtccgacgaacgttcgggacaacgtcgaacgaccgaacggccgaacggacccgaaacggaacgggaaaccggggtcccccgttacgggttaacgtttacggaagttaacgggtaaacggttaaccgtaggtaggaagtcggacacggtacccgaacgaccggggtaaacgggggaccggtactcccgttaggtacgtttccggttttacggacggttaccgaggtaccgttcggtcggggtactcggaccggtaccgtaccgtaccctaccgacctacctcccgtaccgtccgtccctacgtcgttcgacggtacgtagtacggacgtctacgtactttacgttacgtcggacgtaacggtaccggtacgggtacgtaggttcggttaggttcggttccgggggtttacgggacgggtaacggtaccgtaggtcccgttaccggtacccggttccgtacggtacccgacccggtacccgtaaccgggtcccgttaccccggg

SEQ ID NO: 110187 - DNA, 830 bp, Homo sapiens
  misc_feature: GYAE6OF01BW1WU.10.28.C06.1.454.CMB.1.raw
  modified_base (150)..(150): a, c, t, g, unknown or other
  misc_feature (150)..(150): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacgagggtctctcctcccagtcttgngctcgaccttcaactccgcccttctcgtcctctcgccctccgtgggactccgtcgtacagtctacatctgcctacttcgtgacgtcgagggtcggacaacgacgaacctaaccggtaccacctacgtcgaccgtaaggtcggaactacgtacgacgacgacgaccgacgaccggaacgggacgggtaaccggtccgttaccgggttaacgtaggtaacggtaacggttaaacggtaacgtaggtacggtaacggtccggaacgaaccggaaccgaaccgggaaccggggggtaacgggggtaccgtaccgttaccggtaggtttaccgttttaccgggtttacggaccggttaccgtacggttccggttacgggtacgggtacgtacggtaccggtaccgttacccgttaccctacctaaccgtcttaccccggactaccggtcctaacggtcgtacgggtaggtacggtacgtacggtaacttacggtaactttaaccgtcgttaccggtacggtaacgtaaccgggtcgggttaaccggtactttgggtttacgggttagtttcggggttaccggggttaccggacggggtaaccggacgttaacggtccggttaacccggtaccggttaccggtaaccgtaccggacccgtaccgggttacgcccggttaacccccg

SEQ ID NO: 110188 - DNA, 769 bp, Homo sapiens
  misc_feature: GYAE6OF01C9BP0.10.28.C06.1.454.CMB.1.raw
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
  modified_base (219)..(219): a, c, t, g, unknown or other
  misc_feature (219)..(219): n is a, c, g, or t
  modified_base (276)..(276): a, c, t, g, unknown or other
  misc_feature (276)..(276): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacgagggtctctctcccagcttgtgctgactacaatcgccctctcgcctctcgcctcccgtagggcncctcggcaaacgtctacatctcnctacnctgaagctaggtggacaacacgacaacctaacgccaagtcgactagtacggactacnccgaagacgaacgaccgacgaccggaaggaacgaacggggaccccgttaggtacgttagagtaacggtaaaggttaacgaggttagagtaggaccaacggaccgaaacgacgggaacggggtaaccgtcgtacccgtagtacgttacggttttaaccggtaccggtacgtacgtcgtacggtcgggtaccgtaggacggaccgtaccctaacgttaccaccgacttaccctaccgacgtacccgttaaccgacgttacggtacggaacggtacggttaggaccggtactacgtttaaccgtttaaattccgtacgttaaacgtccggtaaccggttacgggtacgttacggtttaacgggtacggttaggggtttaccgggtttaacggggaccgggttaaaacggggacttaacgggtcccggtaccggttaacccggtaaccggtacggtaaccggaccccgggaaccgttacgggcccggttacccccgg

SEQ ID NO: 110189 - DNA, 833 bp, Homo sapiens
  misc_feature: GYAE6OF01B6IXV.10.28.C06.1.454.CMB.1.raw
  modified_base (401)..(401): a, c, t, g, unknown or other
  misc_feature (401)..(401): n is a, c, g, or t
tcagcatagtagtgcacgaccggtgctcgatttagagctcacgtattgggtttgggagagctctggggagtctgcaccatggcttggaccccactcctcttcctcaccctcctcctccactgcacgaggtctctctcccagtcttgtgctagacctacaactcccgtcccttctcgtcccttcgtcgtccccttacccggtggggaccgtcccgttacgggtacaacgccttactacgttcctcgcctacttcgtaggagtcgagggtcggacaacgacgacctaaccgccgacctacgtccgcgtaagtcggacctacgacacgcgacgactacggaccgaaaggacgggtaaccgggcccgttacggttacgtaggaacgttaggtaaacggttaacgngtacgtagacggaccgtaacgaccgaacggaaccgggggtaacggggtaccgtaaaccgttcccggttagttaccggtttttaccggttacggtacggtccgtacggttcggttcgggtcgggtacgtaccggtaccgtacccgttaccctacccgttaacctaccgttaccgttccccttacccggaccgttacccgttcgtacgtacggtacggaggtacgttacggacgttactaacgttacttacgttcgtaccggtaccgtacggtaccggttacggttacttcggtttaggttacgggttcgggtttaccgggtacgggtaaaccggggaccgttaaagggttcccttaccgggtacccggttaaccggtccggtaacggtacccgacccggtacccggtaacccgtccccggttaaccccccggg

SEQ ID NO: 110190 - DNA, 861 bp, Homo sapiens
  misc_feature: GYAE6OF01BAIQK.10.28.C06.1.454.CMB.1.raw
  modified_base (192)..(192): a, c, t, g, unknown or other
  misc_feature (192)..(192): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagtcttgtgctgactcaatccgccctctcgcctctcgccctcccgtgggacncccgttcggtacaacgctcactcgtgctactctgacgcgaggtcggaccacgacgaccaaccgtaccgaccacgtccgacgagtcgacatcgacgcgacgacgacgacgtaggaacggaccggtcccgtacggttacgttaggaacgtaaggtaaacggttaacgtaggtagaacgtacggtacgaaccggaccgaaccgaaaccggggaacgggggaccggttacgtacccggttaaggttaccgttttaccggtttaccggtaccgggttaccgtccggttcggttaccgggtaccggggtcgtacgggaccgtacccgttaccgtaccctacccgtacctacgtccccgtaacccgtaccttaccccgtacggtacgtccgttagggaacggttacgtacggtaccggttacgtaccgtttaacgttaacgttaccgtacggtaccgggtaaccggttaccgggttacgggtaaccgtttacgggtttaacgttttcgggggttaacgggtttttacccgggggttaaccggggaacccggggttaaccgggtaaacccgttacggggtccccgtttaaaccgggtaccccgttaacgggttaccccgggtacccgaacccccgggttacccggttaaacccggtccccggtttaccccccccggg

SEQ ID NO: 110191 - DNA, 787 bp, Homo sapiens
  misc_feature: GYAE6OF01CHRN9.10.28.C06.1.454.CMB.1.raw
  modified_base (206)..(206): a, c, t, g, unknown or other
  misc_feature (206)..(206): n is a, c, g, or t
  modified_base (551)..(551): a, c, t, g, unknown or other
  misc_feature (551)..(551): n is a, c, g, or t
tcagcatagtagtgcacgaccggtgctcgatttagagctcacgtattggggtttgggggggggtctcaggaggccggccctcgtcgggacgtctccaccatggcctgggctctgctattcctcaccctctcactcagggcacgagggtcctgggacccagtctcgccctgactcagcctcgcctcgtgtcgtggtcctcgtggacngtccatcaccatcctctgcacgtcgacccacgtagtacagttagtaatatgtaatcgtgtcctcgtacgtaccaataccgaaccgacggaacaaaacccgacccctaaagtgtacttagtatttagtgtactacgtaactaacgttaaccgtacccggtacccgttcggtttaacggggtttctagtccgttaccgtttctttccgtttcccgaaccgttacgtaacgtccgtacgacctaaccgcccggtccctacccgtacgacctagtccgtacggtcggcctacgagacgtacggacgggacgtcgtacgtagttaacttactacggtacgccgaccgtanacctaacgtaacgtacgaacgggacggtcccggtaggggtttccggggttacgggggttccgggtacccggggggacccgggtaacccgtacggtaacccggtcccgggttaacccgtccgggttaacccgggtacccggacccggttaccggaacccgggtccccttaccccgggtcccccggtttacgttacccctacccgggtttccccgttacccccgtttaaccccccccg

SEQ ID NO: 110192 - DNA, 906 bp, Homo sapiens
  misc_feature: GYAE6OF01B9ZYK.10.28.C06.1.454.CMB.1.raw
tcagcatagtagtgcacgaccggtgctcgatttagagctcacgtattgggtttggggagagctctggggagtctgcaccatggcttggaccccactcctcttcctccaccctcctcctccactgcacgagggtctcctctccagtcttgtgctgactacaatccgcccttcttcctctcgcctccgtggacgcctcggtacaacgctctatcgcgctaccttcgtacggacgcgtagggtcgggaaccaaccgaacgaccgtaaaccgtaaccgaccgtaagtccgataacggtgaccgtaattaccaacggacgacggtaacgaccgggaaccggaacgggaaacgggggtaacccgggttcccccggtttaagggttaaccgtttaggtaaacggttaaaggggttaaaaaccggtttaacgaacgggttaggtaacgtccggggaacgtaaccgaaccccgtaaaacccggggaaccggggtaaacggggggtacggttaaccgtacccgttaggtttaacccgttttcgggttttaaccgggaccggttccggtaccggtcggtccgggttacgggtcgtaccgggtacgtcccgtaccgttacccgttaccgaaccgtaccgttaccgaacccgcccgttaccgttaaccggccgttacgtacgggtacggtaacggtacggtacggtaacctttacggtaaaccgttttccgtaaggttaccgtaaccgggacggtttaccgggtacgggacgttttacggggttgggtttaacgtttcgggggttacggtacgggtagggtaaacccgggtacgtaaacggttcggttaacccgggttaccttagggaacccggtacgtaacccgggaccggttaccggtccggtccccgttacccggg

SEQ ID NO: 110193 - DNA, 1090 bp, Homo sapiens
  misc_feature: GYAE6OF01ER4HX.10.28.C06.1.454.CMB.1.raw
  modified_base (107)..(107): a, c, t, g, unknown or other
  misc_feature (107)..(107): n is a, c, g, or t
  modified_base (151)..(151): a, c, t, g, unknown or other
  misc_feature (151)..(151): n is a, c, g, or t
  modified_base (170)..(170): a, c, t, g, unknown or other
  misc_feature (170)..(170): n is a, c, g, or t
tcagcatagtagtgcacgaccggtgctcgatttagagctcacgtattgggtttgggggagagctctgggggagtctgcaccatggcttggaccccactcctcttccncaccctcctcctccactgcacgagggtctctctcccagtcttgngctgactcaatccgccctntcgcctcgtcgccctcccgtaggggacgtccttcggtacaacgtcctactactctacggcctacgttccgaggacggccgtaggtcggggaccaacgacggacctaaaccgtccgacctagtcgactaggtcggactacgtcgacgacgtacgcgaaccggtaccgaagggaacgggaaccgggttccccgttacgggttaaccgttagggtaacggttaacgggtaaaacgggttaacgtagggtacgtaaggtacgggaaccaaccggaacccgaaaacccggggaaaccggggggtaacgggggggtaacccgttaccgttacccggttaacgggtttacggtttttaccgggttttaaccggggaccgggttaccgtaaccggggttcggtttaccggggtccggggttacggtaaccgggtaccgggttaccccggttaacccctaacccgttaccccgtaaccgtttaaccgttacccccgtaaccggtaacccgttacccccgtttaccggtaaaccggttttccgggaaagggtaaacgggtttaccgggtacgggtaaacccggggtttacttaaacccggtttaacggtttaacccgtttacccgggttaacgggttaacccggttaaccccgggggttaaccggggtttaccgggtaacccggttttaccggggtttttaaggggggttttaccggtttaacggggggggtttttccccggggttaaaaccgggggggtaccgggggttaaaaacccccgggttaccggttaaaccgggttccccggggttaacccggggtttaaaccccgggtttcccgggtttaaaaaccccggggggcccggttaaaaccccccgggaaccccgggttaaaccccgggttccccccgggtttaaccccccccgggg

SEQ ID NO: 110194 - DNA, 921 bp, Homo sapiens
  misc_feature: GYAE6OF01EG3CH.10.28.C06.1.454.CMB.1.raw
tcagcatagtagtgcacgaccggtgctcgatttagagctcacgtattgggtttggggagagctctggggagtctgcaccagtggcttcggaccccactcctcttcctcaccctcctcctccacgtgcacaggtcctctcctcccagtctttgtgcttagactcaactccgccctctcgccttctcggtacccttccccggtaggggaccgtcccgttaccgggtacctaacgtccttacgtacgttctcggtactaccgtcgtagacggtcgaaggtcggaaccacgacgactaaaccgtaccgacctagtccggactacggtacggtaccagtaccgacgtcaaacgcgaacgaccgtaacggtaacggtaaccgggtcccgttacgggttaacgtagggaaacggtttaaacgggtaaaacggtttaacgacgggttcgttaaacggtccggaccggtaaaccggacccggtaaacgggaaacccgggggtaacgggggtaaccggtaaccggttcccggttacgtttaaacgggtttttcccggtttaacgggtacgggacgttaacgggcgggttaccggggttacgtacgggttaaccggtaccgtcccggttaaccttaccgtaacccggttacacccgtcccggttaccaccccggttaacgtccggttagtaccgggtaggtaccgtagtcggggttaacacggttttaacgtacgtttaacgtaccgttaccgtacgggtaaaccgttccgggttccggttaattaccgggttttacggttagggttccggttttaccgggggtaacgacgggtaccggtaaaggttccccggtaacgggtaccgttccccggtaaacgggttaccttaccggaaaccccgggttacgttaacccggcccggtttaaccccg

SEQ ID NO: 110195 - DNA, 703 bp, Homo sapiens
  misc_feature: GYAE6OF01AHJIA.10.28.C06.1.454.CMB.1.raw
  modified_base (195)..(195): a, c, t, g, unknown or other
  misc_feature (195)..(195): n is a, c, g, or t
  modified_base (352)..(352): a, c, t, g, unknown or other
  misc_feature (352)..(352): n is a, c, g, or t
tcagcatagtagtgcacgaccggtgctcgatttagagctcacgtattggggtttgggggagagctctgggggagtctgcaccatggcttggaccccactcctcttcctcaccctcctcctccactgcacagggtctctctcccagcttgtgctgactcaactccgccctctgtcctctcgccctcccgtgggacnccgtcggtacaagctcatctcgctactcgtgagcgtggtcggacacgacgacctaacctaccgcctacgtccgactagtcggactactcgacgcgacggacacgaccgaaggacggaccggtcccgtacggttactaggagtaggtaaacgtaacgnggtcgacgtcggacacgaccgtacggaacggggaacgggcgtacgtaccgttagtacgttttcggttacggacggtacctaggtccgtcgggtacgggctcggccgccgtacctacctacctaacctcctaccctaccacgtacccgttccgacggttacgtagggtacgtaggtccgtacgtaactcggtaacctttacgtacggtccgtaccgtacgggtacggtacgggtacttcgggtaacggtttcgttgggggttccgggttacggacggggttaccgaccggtactcgggtaccgtaccgttacgggacccgtcgtaccccggacggtccgtcccgtaccccgg

SEQ ID NO: 110196 - DNA, 798 bp, Homo sapiens
  misc_feature: GYAE6OF01AP94J.10.28.C06.1.454.CMB.1.raw
  modified_base (123)..(123): a, c, t, g, unknown or other
  misc_feature (123)..(123): n is a, c, g, or t
tcagcatagtagtgcacgaccggtgctcgatttagagctcacgtattgggtttgggggtaggagcgtctggggagtctgcaccatggcttggacccactcctctcctcacctcctcctcactncacaggtctctctccagcttgtgctgactcaactcgcctctcgctctcgcctccgtacgggcgtcccgtcggtcaacgtcgtctactctgtcactctacggacgcgtaggtcgggccaacgacgtaccgtaacaccgtccacgtacgacgtacgtacgtacctacgtacgacggaccgaacgaccgaacgaccgaacgggaaccgggtaaccgggtacccggttacggttacgttaggtaacggttaacgggttaaacggttaacggtaacggtacggtaacggttacggaccgtaccggaaacccgaaccgggtaaaccgggggaaacggggtaaccggtaaccgttaccggttaacggttaaccgtttttaccgggtttacggtacggtaccggtacggtccggttaccgggtacgggtcgtacggtacgtaccgtaacccgtaccctaccgtaccttaccgtaccctaccgtaccgtcccgtaccgtacgttacgtacggtacggtacgtacggtacgacgttacgtacgttacgttacgtcgtacgtaccgtcggtacggttacgtacggttagttacggttcgggttacggttaccggacgggtacggtacgtacggtccgtaccggtaccggtcggtacgtacgtaccggaccggtccgtccggtcccg

SEQ ID NO: 110197 - DNA, 765 bp, Homo sapiens
  misc_feature: GYAE6OF01BIBR3.10.28.C06.1.454.CMB.1.raw
  modified_base (167)..(167): a, c, t, g, unknown or other
  misc_feature (167)..(167): n is a, c, g, or t
  modified_base (493)..(493): a, c, t, g, unknown or other
  misc_feature (493)..(493): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctcctccagcttgtgctgactcaactccgccctntcgcctctcgtccctacccgtgggactccgtcggtcaagtctcactctgcacgtctagacgcgaggtcgggcaactacggacaacctacggcctagtccgactacgtcggaccaacgtccgaaggaccgacggaccgtaacggaccccgaaaggtaaccgggaaaccggggtccccgtttacgggttacgttaggtaacgtagggtaaaacggtttaaccgaggtacgagtacggaccgacgacccgaacggaaccgggtaacggggaccgtactcccggtagtacgtttcggtttacggacggttcacggtcgtcggtacgggtntacggcgtaccctacgttaccccaccgtaacccgtctacccgtaccctaaccgtcccgtaccggtacgtcgtacgggaggtactagggacgttacctaaggttaaccttagttaaccgtcggtacgtaaccgtcgggttacgggacttacggttaggttcgttacggggttcgggtttaacgggacccgggttacggtaccgtacggtccgtaccgtcccggtaccggtaacgtacccgacccggtacccggtaccggtcccggtaccccgg

SEQ ID NO: 110198 - DNA, 837 bp, Homo sapiens
  misc_feature: GYAE6OF01A4ZZ2.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagtcttgtgctgactcatccgccctctcgccttctcgccctcccgtgggacgtcccgtcggtacaacgctacacttcgtacgcctaccttcgtaggacgacgtagggtcgggaacctaacgacggaaccctaaaccgtaccggccctagttccgacgtaagttcggacctactaccgagacgacgaccgaacggacccgaaggtaacgggtaacccggggtcccccgttaacgggtttaccgttaggtaacgttaacgggtaaaaccggttaaggtaaggtacggtaacggtccggaaccgtaaccggacccgtaaaaccggaacccgggggaaagggggaccgtaccgttcccgtaggttacttttccggtttaccggacggttccgacgttcgtcgggtacgggtacgtcgaaccggtccgtaccgttaccctaccgtaccgtactacccctccgaccgttcctaccggtacgtacgtaggtacgtaacgtcgaggtactacgttacgttacgttacgtacgtaccgtaacggtccgggttacggtaccgttaggttacggtttacggttcggggtttacgggttacgggtaccggggtaaacggttaccggtaccggttcgggtaacccggttacccggtacggttaccggtaccggaacccggtaccggtaaccgggtcccggttcccccggg

SEQ ID NO: 110199 - DNA, 753 bp, Homo sapiens
  misc_feature: GYAE6OF01A749Y.10.28.C06.1.454.CMB.1.raw
  modified_base (99)..(99): a, c, t, g, unknown or other
  misc_feature (99)..(99): n is a, c, g, or t
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
  modified_base (484)..(484): a, c, t, g, unknown or other
  misc_feature (484)..(484): n is a, c, g, or t
tcagcatagtagtgcacgaccggtgctcgatttagagctcacgtattgggtttggggagagctctggggatctgcaccatggcttggaccccactcctnttccctcaccctcctcctccactgcacgagggtctctcctcccagtcttgtgctgactcgaattccgccctgtcgtcctcgtacgccctcccggtgggacctccgtcggtacaacgccttcattccgagcctactcggtaggaacgcgtaagggtcggaccaacgtacaaccctaaacgccgaccagtcgacnggtacgcacacgagcacgngaccgcgaaggaacgggaccggtttcccgtaggttcttaaggacggtaaggtaacgttaaggaggttagacgtacggaccgaaccgacccggaacggaaccggggggaacgggttaccgtaacttcccggtagttacgtttcgttacggaccgtcgagtcggtcggtcgggtnacgggaccgtccctaacttacccgcctaacggttctacccctccaacccgtccgttaacaccgggtttacgagggaaagttccaagggtccgtagtaaaccctttagtaccgttagccgttaacgaaccgggtccggtagggttacctagtttcggttaggtttcccgggttcggggtcgggaaggggtaacttaccgcggttaaccggccgttaccgtaacgggtccgtaccggaaccgtcccggtaaccgggttcccctccccgggg

SEQ ID NO: 110200 - DNA, 751 bp, Homo sapiens
  misc_feature: GYAE6OF01BUG32.10.28.C06.1.454.CMB.1.raw
  modified_base (169)..(169): a, c, t, g, unknown or other
  misc_feature (169)..(169): n is a, c, g, or t
  modified_base (192)..(192): a, c, t, g, unknown or other
  misc_feature (192)..(192): n is a, c, g, or t
  modified_base (506)..(506): a, c, t, g, unknown or other
  misc_feature (506)..(506): n is a, c, g, or t
tcagcatagtagtgcacgaccggtgctcgatttagagctcacgtattgggtttgggggagagctctggggagtctgcaccatggcttggaccccactcctcttcctccaccctcctcctccactgcacagggtctctctcccagcttgtcgctgactcaatccgccctntgcctctgccctcccgtgggacncctcggtcaagctcagtctagcacgtctgacgcgaggtgggcaacagaccaaacgtcgaccatcgacagtggcatcagcaacgcaagccaaggaacggaacggtcctacggtacgttgactaggtaaacggttacaggtgagtgaccacgacacgaccggaaggggtacgacgtccgtagtacgttccggtttacgacggtaccgtacgtcggtaccggtggggtacctacgggcggtacccgtaccgtaaccgttacccaccgtaaccttccctaccggaccgtaccccgtagacgtaccgtacggacggtanacggtcggtaactacgtaactttacgttaacggtcgtacgtaaccggttacccgggtacggggtaacctacggggtttaggtttaccggggttcgtttaccgggggtttaccgggaaaccgggggttaacggtaacccggaaccgggttaacgggtacccccgggtttacccggttaaaccgggtacccggtaaccggtaaaccccgggttaacccgggaaagggttccccgggttaacccccgg

SEQ ID NO: 110201 - DNA, 716 bp, Homo sapiens
  misc_feature: GYAE6OF01AL3QD.10.28.C06.1.454.CMB.1.raw
  modified_base (480)..(480): a, c, t, g, unknown or other
  misc_feature (480)..(480): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctcgccctcttcgccctacccgtggggacgccgtcggtcaagcctcatctgccacttcgtgacgtcaggtcggaccacgtagacaaccgtaccgcctactcggacaacgtcgggacctacgtcgaacgcgacggacaccggaccgaacggaacgggaaccgggtccccgtacggttacgttaggaggttaaggtaaacggttaacggaggtgacgtcggaccgacgacccgaacggaccgggaacggggaccgtactcccgtagtacgtttcggtttacgacggtcgacgtcgtcggtgggctggacgccgttccncccgccacgtacctactccgacgtcccttacccagttaccgagggtagaccggtagccggttcgtaccgttacgttacgttacgtaccggtaccgtaccggtaccggttacgggtccgttaaggttcggtttacggttcggttacggggttcggaacgggacggtacccggaattccggtacccggtaccggttacggttccgtaacgacccgacggtaccggcccgttaccccgg

SEQ ID NO: 110202 - DNA, 767 bp, Homo sapiens
  misc_feature: GYAE6OF01BQIPA.10.28.C06.1.454.CMB.1.raw
  modified_base (573)..(573): a, c, t, g, unknown or other
  misc_feature (573)..(573): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctcgactcaactccgccctcgtcgcccttctcgccctcccgtgggactcccgtcggtacaagcctcactccgtcgcctaacgttcgtcggtaagcgacggggtacgggaccaaccgaacggtaccaaacccgttccgacctaagtccgactacgtcggacctacgtacacgacgacggcaaccgccgaaggtaaccggaaccgggtcccgttaacggttacgttagaacggtttaacgggtaaacggttaacggtaggttacggaacgttccggaacgaaccgacccggaaccggtaaccgggggaacgggtacggtacccgttaccgttagttacgtttcgtttaccgacgggtcctacggtcgtagggtcggactcggacgtcccgccgtacctaccgtaacctctcccctacgaccgttccnccgtagtcgtaggacgtagtcggaacggttcctaggtaactttacgtacggtcgtacgacggttcggacgtcgttaggttacggttggtttacgggtacgggtcgggaccgggaaccggtacgtacgggtcccgttaccggtaacccggtccgtacggtaccggcccgtaaccgtccggtcccggttaaccccg

SEQ ID NO: 110203 - DNA, 1111 bp, Homo sapiens
  misc_feature: GYAE6OF01B80DW.10.28.C06.1.454.CMB.1.raw
  modified_base (280)..(280): a, c, t, g, unknown or other
  misc_feature (280)..(280): n is a, c, g, or t
tcagcatagtagtgcacgaccggtgctcgatttagagctcacgtattggggtttgggggggggtctcaggaggccggccctctcgggacgtctccaccatggcctgggctctgctattcctcaccctcctcactcgagggcacgaggggtcctcgggcccagtctcgccctgactcacgcctgcctcgtgtcgtgggtctccgtggacacgtccatccaaccattcctacctgaccacgtacggaacctagctagtgtactttgtacgacttagtaactntcgtctccgtaggtaccagaccaaccaaccgagaaccaaaccgaccccctaaattccgtttaggttttacgagttaccgaacggtaacggcccggtacctacgaacggtaccgtaccgtagtaacgttccggttacctcgttaccgtacccgtaaccgtaaacgggttcccgtaaacgggtaacccgaaaaccccggtacccgggtccccctttaaacccccgggtagggttacccccggtttacccggttaccggggtaccccggggttaaccgtttaacccccgggtaagggggtacccggttaaacgggggtaaacgggttaaccgggtttaaaccggggtaacggggttaaccgttttaaacccggtttaaaaccggttttaaaccccggtaaaccgttccggtaaacccgggacggttaaccccggttaacgtttaaaacctttaaaccccggggtttaaccccgggaaaaacccccgggttaaacccccggggttaaaaaacggggggttttcggggggtttttacccgggggtttaaacccgggggggtaaacccccggggggttaaaccggggggttttaaaaacccgggtttaaccgggggttaaccccgggggttaaaacccccccgggtttaaccggggttccggggggttaaaccccgaacccggggtttaaaaccccccggaaccggggttacccccgggtttaccccccggtacccccccgggtttaaacgggttacccccgttaacccggttaccccttttaaccccccggggtttaaccccccccttacccccggtttaacccctaaaaccccgg

SEQ ID NO: 110204 - DNA, 663 bp, Homo sapiens
  misc_feature: GYAE6OF01BXFLN.10.28.C06.1.454.CMB.1.raw
  modified_base (183)..(183): a, c, t, g, unknown or other
  misc_feature (183)..(183): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacaggtctctctcccagcttgtgctgactcaatcgcctctgcctctgcctccgtggganccgtcggtcaagctcatctgcactcgtgagcagtggcacagacaactacgccagtcgcagtggcatcagcagacacgccgaggacgaacgggtcccttacggtacgttagagtaggtaaacggttaacgagtagagtggaccacgaccgacgaaccggaacggggaccggtactacccgtagtacgtttccgttttacggacggtaccgacgtcgtcggtcgggtcgtacggacgtccgtacccttacccgtaccgtacctaccgttaccctaccgaccgtacccgttaccgtacgtccgtaggacggtagtacgacggtctagtacttagtacgtcgacgtacggtacggtcggtacgtacgttacggtgtttcggttcgggtttacggtacggggtaccggtaacgaacggtcccgttaccggtacccgtacggttaccggcgtaacccggtaacccgtcggtaccccgttcccccgg

SEQ ID NO: 110205 - DNA, 852 bp, Homo sapiens
  misc_feature: GYAE6OF01B1RFD.10.28.C06.1.454.CMB.1.raw
  modified_base (348)..(348): a, c, t, g, unknown or other
  misc_feature (348)..(348): n is a, c, g, or t
  modified_base (364)..(364): a, c, t, g, unknown or other
  misc_feature (364)..(364): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctctcactcagggcacgagggtcctcgggcccagtcgtcgccctgactcagcctcgcctccgtgtcgtgggtcctccgtggactagtccatcacctactctccgtgctacgtcggacccaccgtagttaactgttaggtaaatagtagtaatatgtccttaccgacgtaacaacgacgtaccgaggaaccaaacccgacccctaaatcggaattggttaactttntaggtactcggttaanacgttaaacgcccgtaaccggtttcggacggggtttctgtaacgttccgttcttttaccggtcccgtaccctagtaacgggttccgacggtaaccgaacccgttacccgtccccgttttccccggaacgtacccgttaacgttcccgttccggttaaccgggtccgtaacccgtaacggtaccggttacgggaagggtaaccggtacggggtaacgttacgttaagtttaacgtttaacgtcgtaacccggtacgtaccctaacgtaaaccgtaacgtaaccggtaacgggccgggtacgttacgggggttacggggtttacggggttaccggggttaacccgggggaccggggtaaccccgtaggtaaccgttacccggggacccgtttaacgggtccggtaccggtaccccggaccggtaccggtccccggtacccggttcccctaccgggtacccttaacccgttcccgttacccggtacccccc

SEQ ID NO: 110206 - DNA, 893 bp, Homo sapiens
  misc_feature: GYAE6OF01E5KOR.10.28.C06.1.454.CMB.1.raw
  modified_base (181)..(181): a, c, t, g, unknown or other
  misc_feature (181)..(181): n is a, c, g, or t
tcagcatagtagtgcacgaccggtgctcgatttagagctcacgtattggggtttgggggagagctcgtgggggagtctgcaccatggcttcggaccccactcctcttccctcaccctcctcctccactgcacgagggtctctctcccagcttgtgctgactcaatccgccctctcgcctcncgccctcccgtgggacgccgtcggtacaacgtcctacactcgtacgcctacttcgacgacgcgtaggtcgggaccaaccacgaccaaaccgtccgacctaccgtaccgactaggtacggacctacgtacgacgaccgacgaccgaacgaccggaacggacgggtaaccggtcccggttacggtacgttacgaacggtaacggtaaacggttaacgacggtaggacggcggtaaccgaccggaacccggaaccgggaacggggaacggggtaccgtaccgttcccgtaggtttaccggtttcggtttacggaccggttacggcggtaccggtcgggtacgggtccgacggtaccgcccgtaacctacccgtccaaccgttaccttaccccggaccgtccggtcccgttacggtacggttacggagggtacgttacggtaccggttacgtcgttaaaccgttaacgtttacggttaccgtcgggtaacccgggtaaccgggttcccgggttagggttcccggtttaaggggttttacgggtttacccggggtttacggggggtttaccccgggtccgggggtaaaacccggggtaccggtaaaccccggttcggtaaccccgggttacccgggttaccccgggtaacggtttacccggaaccccggttaacccgggggcccggtttaaccgggtcccccgttaacccccccggg

SEQ ID NO: 110207 - DNA, 691 bp, Homo sapiens
  misc_feature: GYAE6OF01E5A7Q.10.28.C06.1.454.CMB.1.raw
  modified_base (188)..(188): a, c, t, g, unknown or other
  misc_feature (188)..(188): n is a, c, g, or t
  modified_base (459)..(459): a, c, t, g, unknown or other
  misc_feature (459)..(459): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacaggtctctctcccagcttgtgctgactcaatccgcctctgcctctcgccctcccgtgggacnccgtcggtcaagctcatctgccactctgagcgaggtcggacacgacgccaactaccgccgtatccggcagtcggcctatacgacgcacgccgacggccgaacggaacggaaccgggtcccgttacggttaacgttagaacgttacggtaaacggtttaacgacggtcgtacgtcggacacggcccaaacggaaccgggtaacgggggaccgtacgttcccgtaggtaacgtttcggttttacgaacgggtccacgtcgtacggtcgggtcnggacgtccggccttaaccacctaacgtactcccgtaccgaccgtcccgttacgtacgggtcctagggtacgtacgacggtacgtcgttacgtaacttacggttactacgggtactacgggtccgcgggtactcgggttagttagtcgggtttacggttcggacgggtccgtaacgtaggtccgtacgtacgtccgtacggacccgaaccggacccgtcgtccggtacccccg

SEQ ID NO: 110208 - DNA, 840 bp, Homo sapiens
  misc_feature: GYAE6OF01EI0R5.10.28.C06.1.454.CMB.1.raw
  modified_base (209)..(209): a, c, t, g, unknown or other
  misc_feature (209)..(209): n is a, c, g, or t
tcagcatagtagtgcacgaccggtgctcgatttagagctcacgtattggggtttggggggggtctcaggaggcggccctcgtcgggacgtctccaccatggcctgggctctgctattcctcacccctcctcactcgagggcacgagggtccgtgggcccagtctcgccctgactcagcctgaccttcgtcgtcgtggtcctcgtggacngtcgatcactagtcctctagctacgtcggccaccgagtcagtacgaacaggttaggtactacttaactaaacttactcgttaccttccgaaccgtaaacccaaaccaaccaacccggaccggacccgaccggacccccaacggtacctactacttacttacgtttctacgtagtcgtacgtagtacgtcggttaccggttaccgtttagggttacctttacgtaacgttccgttcgttctaccgtccgtacctaacgtactcgtacggacgtaaccgtaccgtcccgtttaacccgacggtacccgtaaccgttccccggtacccggtacccctaccggttacccggtaccgtaacgggtaccggtaaaccggtccggtacccgtttacgttaaccgtttaccgtacgtaccgtaccgtccgtacttaaaccttacggtaccccgtaccgggtaccgggtaaccgggtaccccttacgtttacgtaccgggtaacgttaacgggtttacgggtcccgggggtaaccgggtacccgggtttacggacgggttacccggacgggttacccccgttacccggtaaccgtaccggaacccggttaaccccgggtcccgccccggttacccccggg

SEQ ID NO: 110209 - DNA, 915 bp, Homo sapiens
  misc_feature: GYAE6OF01AY198.10.28.C06.1.454.CMB.1.raw
  modified_base (256)..(256): a, c, t, g, unknown or other
  misc_feature (256)..(256): n is a, c, g, or t
  modified_base (665)..(665): a, c, t, g, unknown or other
  misc_feature (665)..(665): n is a, c, g, or t
  modified_base (711)..(711): a, c, t, g, unknown or other
  misc_feature (711)..(711): n is a, c, g, or t
tcagcatagtagtgcacgaccggtgctcgatttagagctcacgtattgggtttggggggggtctcaggaggcggccctctcgggacgtctccaccatggcctgggctctgctattccctcaccctcctcactcagggcacgacgggttcctgggcccagtctcgccctgacctcacgcctcgtcccttccggttggttccgttcggggtcctcccgtagggtaaccacgttcccattaccaccctattcccgtccngtaccaccgttaccggaccccaaccttaacgtttacctaagtttaggtaaaattaagtacgtaaatttacgtcgttcccgttccgtacggtaaccccaaaccgtaaccggttacccgaacgggaaccctaaaaccccgaaccccccgtaaaacgtgtaacgtttaggttaatttttagtaggttaagttccggttaactaaaccggttttaacctaccccggttaccccgtttaagggtaacggggtttttcctagttacgttttcgttcccttttacgtttcccgtaccctttaaccgtaaccggtttacgaccggtaaccctaacccggtacccccggtcccctttacggtaaccaccccttaggttcccgttaccgggtcgggtacccgttcccgaacgttaccgngggaaaccgggtacgtacggtacgttagttactttaccgtttaacncgtaccgtacgtacctactacgtaaccgtaacggtaaggtccggacgtcgggggttcggggtttcggggtacgggggttcccggggaccgtaaccggtcgtaccggtacccgggtccgtaacccggtccggaacggtacccgaccggaccgttccccgcccgtacccggtccgtacccgtccgttcccgttcccccggtccccg

SEQ ID NO: 110210 - DNA, 737 bp, Homo sapiens
  misc_feature: GYAE6OF01B2L1Q.10.28.C06.1.454.CMB.1.raw
  modified_base (200)..(200): a, c, t, g, unknown or other
  misc_feature (200)..(200): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccaatctgccctgactcagcctgcctccgtgtctgggtctcctggacngtccatcaccatcctctgcactcggacccacagttacattggtaaatatgaatatcgtctcctgtaaccaacagtacccaggaccaaacgaccccaaatgatgtatttagagtatgtacagtaactccgtaccctacgtaggggtttctgtacttccgtctttcgtttcgacctactaagtccgtggaaccctaaccgtaccggtccccttcccgtacgtaccctacgttccgtaccggttcgggtaccctacccggtacgacgttacggggaaggacccggtaaggtccttagtaaattttaccttacgtaggaccgactcccgttaaccaacgtaactaacgaaccggaccggtacggacggggttccggggtttaggggtttcccgggtacggggggtaccgggggaaccctacgttacccggtacggtaacccggtttccggtaacgggttacccaccgggacccggtaaccggtcccgtaccccggccccctttacggtaccctaccgttcccgttcccggttacccccccg

SEQ ID NO: 110211 - DNA, 634 bp, Homo sapiens
  misc_feature: GYAE6OF01A74W3.10.28.C06.1.454.CMB.1.raw
  modified_base (425)..(425): a, c, t, g, unknown or other
  misc_feature (425)..(425): n is a, c, g, or t
  modified_base (450)..(450): a, c, t, g, unknown or other
  misc_feature (450)..(450): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctcgcctctcgccctcccgtgggacgccgtcggtacaagctcatctcgcactctgacgctaggtcgggaccacgacgacaacctaccgcctatccgacacgtcggcaactacgacgcagacacgaccgaagacggaacggtcccgtcggttactagacgtaggtaacgtacgagtacgagtcggcacgacgaacgacggaacggggacgactccgtagtacgtttcgttacgacggtcagtctggtgggtcagacgtaccnctaccgtcaccgtctaccgaccacnccgtaccgtagtcgtaggaacgacgtggacgtctacgtactacttgtcgtaccgtacggtacggttacggatacgttaggttcgtcgggtttcgggttaccgggacgggtagtaaccggtacgtccgttacgggtacccgttacggaccggtactacccggaacggtccgtcccggtaccccgg

SEQ ID NO: 110212 - DNA, 498 bp, Homo sapiens
  misc_feature: GYAE6OF02IKOAI.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccaaggggacggatccctgatcgttttcagggtccagctctggggctgagcgctacctcaccatctccagcctccagtctgaggatgaggctgactattactgtcagaccgtggggcacgttggttatggttggtttcgggcgggtagggaccaaggcgtgaccggtcgtaggtcacgcccaggctccgg

SEQ ID NO: 110213 - DNA, 533 bp, Homo sapiens
  misc_feature: GYAE6OF02GM9LH.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacgaccgaagggggacgggatcccgtgtacgtttcgttttacgagggtccagctcggtgggctggagcgctacctcaaccatcctaccgacgccctccagtctaggaggatggagtctagacttattactgtcaggtacgtgggctagttggttagtggttggtttcggacgggtagggaaccaggtcgtacggaccgttcgtagggtccacggcccaggcctcccgg

SEQ ID NO: 110214 - DNA, 496 bp, Homo sapiens
  misc_feature: GYAE6OF02F7M4J.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacggatccctgatcgttttcaggtccagctctgggctgagcgctacctcaccatctccagcctccagtctgaggatgaggctgactattactgtcagaccgtggggcacgtggttatgttggtttcggcggtagggaccaaggctgaccgtccgtaggtccaggcccgtaggcctccgg

SEQ ID NO: 110215 - DNA, 535 bp, Homo sapiens
  misc_feature: GYAE6OF02HNEPQ.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctcgtcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacgggatccctgattcgttttcgagggtcagctcgtgggctgagcgctacctcaccatcctccacgccctccacgtctgaggatgagctggactattactgtcagaccgtggggctacgtggttactgggttcggttttcgggcgggtaaggggaccctaaaggcgttacggacccggttccgtacgggtccacggaccccgtaaggtcctcccggg

SEQ ID NO: 110216 - DNA, 537 bp, Homo sapiens
  misc_feature: GYAE6OF02IFQXR.10.28.C06.1.454.CMB.1.raw
  modified_base (451)..(451): a, c, t, g, unknown or other
  misc_feature (451)..(451): n is a, c, g, or t
  modified_base (471)..(471): a, c, t, g, unknown or other
  misc_feature (471)..(471): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaaactgatgatttatgatgtcagtaatcgaccctcaggggtttctgatcgcttctttgcctcaagtctggcaacacggcctccctgaccatctctgggctccagactgaggacgaggctgattattactgcagctcacatacaagcggcaggcggttgggngttcgcggggaccgacacgngccggtaccgtcgtacgtacgccgacgacgccgtccccgtcccgttcggacctccgtcgttccccg

SEQ ID NO: 110217 - DNA, 496 bp, Homo sapiens
  misc_feature: GYAE6OF02GVFTM.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacggatccctgatcgttttcagggtccagctctggggctgagcgctacctcaccatctccagccctccagtctgaggatgagctgactattactgtcagccgtggggctacgtggttatggttggttttcggcggtagggaccaagctcgaccgtcgtaggtcacgccgaggcctccgg

SEQ ID NO: 110218 - DNA, 578 bp, Homo sapiens
  misc_feature: GYAE6OF02J1TNO.10.28.C06.1.454.CMB.1.raw
tcagcatagtagtgcacgaccggtgctcgatttagagctcacgtattgggtttggggagagctctggggagtctacaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacggccctcggtacttgatgaaggttaacaggtgagtggcagccaacgaccgaagggggacggatcccgtagtattcgttttcacgggtcagctcgtgggctggacgcgcctacctcgacctacgtcctccacgccctcagtctggaggtagtggacgcgtcgacttattacgtacgtcgtagtaccgtcgggtaccgtacgttcggttaagttgggttacgggttttcgggacgggtaacggggaaccgtaacgtacggtcggtaccgtccggtacggtaccgaccggcccgaacggtccgtaccgtcccccgg

SEQ ID NO: 110219 - DNA, 511 bp, Homo sapiens
  misc_feature: GYAE6OF02I8JJ7.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacgggatccctgatcgttttcgaggtccagctcgtggggctgagcgctacctcaccatctccacgcctccagtctgaggatgagctgactattactgtcagaccgtggggcacgttggttatggttggtttcggcggtagggtaccaaggtcgtagtacccgtccgttagggtccacggcccgaggcctcccgg

SEQ ID NO: 110220 - DNA, 506 bp, Homo sapiens
  misc_feature: GYAE6OF02JF233.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaagggggacgggatccctgattcgttttcgagggtccagctcgtggggctggagcgctacctcaccatcctccacgccctccacgtctgaggatgagctgactattactgtcagaccgtgggctacgtggttatggttggtttcggcggtagggaccaagctgaccgtcgtacggtcacggcccgaggcctccgg

SEQ ID NO: 110221 - DNA, 509 bp, Homo sapiens
  misc_feature: GYAE6OF02F4YPQ.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacgggatccctgatcgttttcgagggtccagctcgtggggctgagcgctacctcaccatctccagccctccagtctgaggatgagctgacttattactgtcagaccgtgggcacgtggttatggttggtttcggcgggtagggtactaaggttcgaccgtcgtacgtcacgcccgaaggtcctcgtcccccg

SEQ ID NO: 110222 - DNA, 521 bp, Homo sapiens
  misc_feature: GYAE6OF02FJSA6.10.28.C06.1.454.CMB.1.raw
  modified_base (324)..(324): a, c, t, g, unknown or other
  misc_feature (324)..(324): n is a, c, g, or t
  modified_base (509)..(509): a, c, t, g, unknown or other
  misc_feature (509)..(509): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctnaggggtttctgatcgcttctttgcctccaagtctggcaacacggcctccctgaccatctctgggctccagactgaggacgaggctgattattactgcagctcacatacaagcgcagcggttgggtgttcggcggggaccacgacgtcgaccgtctaggtcacgcccaaggctcgcccctggtccncgtctcgtcccc

SEQ ID NO: 110223 - DNA, 533 bp, Homo sapiens
  misc_feature: GYAE6OF02H8L03.10.28.C06.1.454.CMB.1.raw
  modified_base (378)..(378): a, c, t, g, unknown or other
  misc_feature (378)..(378): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctccctgggagcctcggtcaagctcatctgcactctgagcagtgggcacagcaactacgccatcgcatggcatcagcagcagccagagaacgggccctcggtacttgatgaagttacagtgatggcagccacacgaaggggacggatcctgattcgttttcagggtccagctcgtgggctggagcgctacctcaccatctccncgcctcagtctgagatggagctagtacttattacgtgtcagaccgtggggcctacgtggtttagttggttcgggttttcgggacgggtacgggaaccgtaaggtcgttaggacgttcggtaccgttacgggtccgacggtaccccgaaggtcccg

SEQ ID NO: 110224 - DNA, 516 bp, Homo sapiens
  misc_feature: GYAE6OF02IP3IP.10.28.C06.1.454.CMB.1.raw
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacgggatccctgatcgttttcagggtccagctctggggctggagcgctacctcaccatctccngcctccagtctgagntgagctgactattactgtcagaccgtggggcacgttgggttagttggttgggttttcgggcgggtagggaccgaaggtcctcggtaccgtccgtacgggtccacggcccgaggcctcccgg

SEQ ID NO: 110225 - DNA, 546 bp, Homo sapiens
  misc_feature: GYAE6OF02GWTN5.10.28.C06.1.454.CMB.1.raw
tcagcatagtagtgcacgaccggtgctcgatttagagctcacgtattgggtttgggggggtctcaggaggcggccctctcgggacgtctccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccaccaggcaaagcccccaaactccttgtttttgaggtcagtaagcggccctcaggagtccctgatcggttctctgcctcaagtctggcaacacggcctcctgacctctctggctccaggctgagatgagctgattactactgcagcgcatacttcaggccccaagagggttgtttgggcggcgggtactaagggtcgaccgtcgtgggtcacgacccgaaggcctcgcccccgtggtccacgttccgtccgttccccgccctccctccacttaccg

SEQ ID NO: 110226 - DNA, 518 bp, Homo sapiens
  misc_feature: GYAE6OF02G17S0.10.28.C06.1.454.CMB.1.raw
  modified_base (303)..(303): a, c, t, g, unknown or other
  misc_feature (303)..(303): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttangatgtcagtaatcgacctcaggggtttctgatcgcttctttgcctcgagtctggcaacacggcctccctgaccatctctggctcagactgaggacgaggctgattattactgcagctcacatacaagcgcagcggttgggtgttcgggcggggaccacgacgtcgaccgtccgtaggtcagcccgaaggctcgccccgtcgtcactctcgtcccc

SEQ ID NO: 110227 - DNA, 800 bp, Homo sapiens
  misc_feature: GYAE6OF02JRSTU.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgacctacaactccgccctctcgcctctcgccctccggtgggacgtccgtcggtacaacgtcctactacttccgtcgacctacttcgtagacgcgtagggtcgggaccaacgacgaccaaaccgtaccgacctacgtccgacctagtcggactactaccgacgacgacgacgaccgaccgaaggaacgggaacccgggtccccgttacggttacgttacggtaacgtaacgggtaaacggttaacgtaggtaggtagtcggacgacgaccgaaccggaacggggaacggggacgtacctccgtagtacgttttcgtttacggacggtcacgtcgttcgggtacgggtcgtacgacggtccgtacccgttaccgtaccgtaaaccgtccgttcccgttaccgaccggtcccttaaccggtcgttacggtacgggaacggttacgtacgggacggtaccgttaacgttaaccgtttacgttaccgttacggtaccgtaccggtaccgggttcggggacccttagggttacggtttaacggttcggggttttcggggtttacgggaacggggtaaccgggtaaccggtacggttccggaccggttaccgtaccggtcgggtacccgaccggaccggtacggtcccttccccggg

SEQ ID NO: 110228 - DNA, 519 bp, Homo sapiens
  misc_feature: GYAE6OF02IXF1D.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacggatcccgtgattcgttttcgagggtccagctcgtgggctgagcgctacctcaccatctccacgcctccagtctgaggatgagctgactattacgtgtcagtaccgtgggcacgtggttatggttgggtttcggcgggtaacgggaccgtaaggtcgtacggacccgttccgtaggtccacggacccgaggtcctcccgg

SEQ ID NO: 110229 - DNA, 502 bp, Homo sapiens
  misc_feature: GYAE6OF02HGGK2.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtactgatgaagttaacagtgatggcagccacaccgaaggggacggatcctgatcgttttcagggtccagctcgtgggctgagcgctaccgtcaccatctccacgcctccagtctgagatgagctgactattactgtcagaccgtggggctacgtggttatggttggttttcggcgggtaagggaccaggcgtagtaccgtctaggtccacggacccgaggcctcccgg

SEQ ID NO: 110230 - DNA, 518 bp, Homo sapiens
  misc_feature: GYAE6OF02HEA4B.10.28.C06.1.454.CMB.1.raw
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaaactgatgatttatgatgtcagtaatcgacctcagggtttctgatcgcttctttgcctccaagtctggcaacacggcctccctgaccatctctgggctccagactgaggacgagctgattatactgcagctcanatacaagcgnagcggttgggtgttcgggcggggaccacgacgtgaccgtccgtaggtcagcccaaggctacgcccctggcacgtctcgtcccc

SEQ ID NO: 110231 - DNA, 538 bp, Homo sapiens
  misc_feature: GYAE6OF02F5VCC.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctggtacttgatgaaggttaacagtgatggcagccacaccgaaggggacgggatccctgattcgttttcgaggtccagctcgtggggctgagcgctacctcaccatctccagccctccagttcctgaggatgagctgactattactgtcagaccgtggggccacgttggtatggttggtttcgggcgggtaacgggaaccgtaaggtccgttacggtacccggttccgttacgggtaccacgggtaccccgaagggtcccttacccggg

SEQ ID NO: 110232 - DNA, 530 bp, Homo sapiens
  misc_feature: GYAE6OF02I8H9D.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgatgaaggttaacagtgatggcagccacgaccgaaggggacggactcccgtgtattcgttttcgagggtccagctcgtggggctgagcgctacctcaccatcctccacgtcctccagtctgagatgagtctgactattactgtcagtccgtgggctacgtggttatggttggtttcgggacgggtagggacccaaggtccgtacggacccggttaccgtacgggtccacggacccgtacggcctacccgg

SEQ ID NO: 110233 - DNA, 541 bp, Homo sapiens
  misc_feature: GYAE6OF02HXRRK.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctggtactgatgaaggtaacagtgatggcagccacaccgaaggggaccgggatcccgtgattcgttttcgacggtccagctcgtgggctgagcgctacctcaccactctccacgccctccagtctaggaggatgaggctagacttattacgtgtcgagaccgtgggctacgttggttagttggttgggttttccggacgggtagggacccgaaggtccgtacggtacccggtcgttacgggtaccgaccggacccgtacgggtcctccccgg

SEQ ID NO: 110234 - DNA, 606 bp, Homo sapiens
  misc_feature: GYAE6OF02I4PKD.10.28.C06.1.454.CMB.1.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
tcagcatagtagtgcacgaccggtgctcgatttagagctcacgtattgggtttgggggggtcgtcaggaggcggccctctcgggacgtctccaccatggcctgggctctgctattcctcaccctcctcactcagggcacagggtcctgggcccagtctgccctgactcagcctccctccgcgtccgggtctcctggacagtcagtcaccatctcctgcactggaaccngcagtgactttgtgcttanaactatgtctcctggtaccagcaccaccaggcaaagcccccaaactccttgtttttgaggttcagtaagcggaccctcaggagtccctgactcggttctctgcctccaagtctggcaacgacggcctcccgtgaccgtctctgggcctccaggctgaggatgaggctgattactactgctagcgcatacttcacggaccccaagtacggggttgtttacgggccgggtacgggtaacgttaagggtcggtaccggttcccgtggggtccacggtacccgaagggcccgtaccggcccccgtaccggtccaccgttccgttccggttccccgcccttccccgtaccctaccgttaacccg

SEQ ID NO: 110235 - DNA, 548 bp, Homo sapiens
  misc_feature: GYAE6OF02H65XK.10.28.C06.1.454.CMB.1.raw
  modified_base (293)..(293): a, c, t, g, unknown or other
  misc_feature (293)..(293): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacngtgatggcagccacgaccgaaggggacggatccctgactttcgttttcgagggtccagtctcgtggggctgacgcgcctacctcaccactcctccgacgtccctccagtctgaggatgaggctagacttagttactgtacaggtaccgtggggtacacgttgggttattgggttgggttttcgggcgggtacgggaccgtaaggtcgttacgacccggttaccgtacgggtccacggtcccgacggtcctcccgg

SEQ ID NO: 110236 - DNA, 533 bp, Homo sapiens
  misc_feature: GYAE6OF02IQTI2.10.28.C06.1.454.CMB.1.raw
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggaaccagcagtgactttgtgcttataactatgtctcctggtaccagcacacccaggcaaagccccaaactccttgttttgaggtcagtaagcggccctcaggagtccctgatcggttctctgcctccaagtctggcaacacggcctcctgaccgtctctgggctccgaggctgaggatgaggctgattactactgcagcgcatatcaggccccaagagggtgtttggcggcgggtaactaaggtcgaccgtccgtgggtccaggcccaaggctcgccccgtggtccacgttcctcgtcccaccctcctaccc

SEQ ID NO: 110237 - DNA, 535 bp, Homo sapiens
  misc_feature: GYAE6OF02HTXWZ.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctggtacttgatgaaggttaacagtgatggcagccacgaccgaaggggacgggatcccgtgattcgttttcagggtccagctcgtggggctggagcgcctaccgtcaccatcctccacgccctaccgagtcgtgaggatgagctagactagttactgtacacgtaccgtgggcacgttgttagtggttgggttttcggacgggtaacgggaccaaggtcgtacggacccgttccgttacgggtccacggacccgaggtcctcccgg

SEQ ID NO: 110238 - DNA, 536 bp, Homo sapiens
  misc_feature: GYAE6OF02IP903.10.28.C06.1.454.CMB.1.raw
  modified_base (376)..(376): a, c, t, g, unknown or other
  misc_feature (376)..(376): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgtcctgactcagcctgcctccgtgtctgggtctcctggacagtccatcaccatctcctgcactggacccaccagttacattggtaataatgaatatgtctcctggtaccaacagtaccccaggcaaacgcccccaaactgatgatttatgatgtcagtaatcgaccctcaggggtttctgatcgcttcttgcctcaagtctggcaacacggcctcccngaccatctctggctccagctgaggacgaggctgatttattactgcagctcacatacagcggacagtcggttggtgttcgggcggggaccacgaccgtgaccgtcgtggtaccacgccgaacggccgtccgccccgtcggtcctaccgtcctcgttccccg

SEQ ID NO: 110239 - DNA, 533 bp, Homo sapiens
  misc_feature: GYAE6OF02FLL8M.10.28.C06.1.454.CMB.1.raw
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
  modified_base (516)..(516): a, c, t, g, unknown or other
  misc_feature (516)..(516): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttangatgtcagtaatcgaccctnaggggtttcngatcgcttcttgcctcaagtctggcaacacggcctccctgaccatctcgtggctccagactgaggacgaggctgattattactgcagctcacatacagcggcagcggttgggtgttcgggcgggggaccacgacctggacccgtccgtaggtccgagcccgaaggcctcggcccctcggtcnccttcctcgttaccccc

SEQ ID NO: 110240 - DNA, 670 bp, Homo sapiens
  misc_feature: GYAE6OF02HE9OI.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggcctcggtactgatgaaggttacagtgatggcagccacgacgaaggggacggatcctgacttcgtttcgaggtcagctcgtgggctgacgcgctacctcacctactcctccacgtccctaccgtacgttccgtagggaacggtacgtcggacgggtccttaggtaaccgtttaacgtttaaccgttggtaccgtaacgggttaacccggttggggggtaacccttaacggttacggggttttaagtttcggggttttacggggttttttaccgggggaccggggttaacgggggtaacccgttaaagggtcccgtttaaccggggtaaccccggtttacccggttaaccggggtacccgtaaccggggtaacccccgtaacggggtcccggttaccccccggg

SEQ ID NO: 110241 - DNA, 554 bp, Homo sapiens
  misc_feature: GYAE6OF02IM9DC.10.28.C06.1.454.CMB.1.raw
tcagcatagtagtgcacgaccggtgctcgatttagagctcacgtattggggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggtaacagtgatggcagccacgaccgaagggggacggatccctgattcgttttcgagggtccagctcgtggggctgagcgctacctcaccatctccagccctccacgtctggaaggatggagctgtacttattactgtacagtaccgtgggctacgttggttattgggttgggttttacggcgggtaacgggtaccgtaaggtccgttacggtacccggttccgtaacgggtccgaaccggtacccgtaacggtcccgttaccccggg

SEQ ID NO: 110242 - DNA, 529 bp, Homo sapiens
  misc_feature: GYAE6OF02IX8XG.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacggatcccctgacttcgttttcgagggtccagctcgtggggctgagcgctacctcaccatctccacgccctccagtctggagtatggaaggctagacttattactgtcacggtaccgtggggcacgttggttatggttggttttcggcgggtacgggaccaaggtcctacggacccgttcgtacggtccacggcccgtaaggcctacccgg

SEQ ID NO: 110243 - DNA, 553 bp, Homo sapiens
  misc_feature: GYAE6OF02GKKAS.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgatggaaggttaacagtgatggcagccacaccgaaggggacggatccgtgagttcgttttcgaggtccagctcgtgggctgacgcgctacctcacctatctccacgcctccagtctggagagtgaggtctagactattactcgtacgagtaccgtggggactacggttggttagttggtttcgggtttcgggacgggtaacgggaacccgtaaggtccgtacggtacccggtaccgttacgggtaccgacggtacccgtagggccgtccccgg

SEQ ID NO: 110244 - DNA, 554 bp, Homo sapiens
  misc_feature: GYAE6OF02HLFO9.10.28.C06.1.454.CMB.1.raw
  modified_base (387)..(387): a, c, t, g, unknown or other
  misc_feature (387)..(387): n is a, c, g, or t
  modified_base (408)..(408): a, c, t, g, unknown or other
  misc_feature (408)..(408): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacaggtctctcgtcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaagggggacgggatcccgtgacttcggttttcgagggttccagctcgtggggctggagcgcctacctcaccatccnccacgccctccagtctgaggntgaggtctagactattactgtacacgtaccgtggggcctacgttggttagtggtttcgggttttcgggacgggtacgggaaccaaggtccgttacggacccgttccgtagggtaccgaccggaccccgtagggtccctaccccggg

SEQ ID NO: 110245 - DNA, 651 bp, Homo sapiens
  misc_feature: GYAE6OF02IOPPV.10.28.C06.1.454.CMB.1.raw
  modified_base (170)..(170): a, c, t, g, unknown or other
  misc_feature (170)..(170): n is a, c, g, or t
  modified_base (215)..(215): a, c, t, g, unknown or other
  misc_feature (215)..(215): n is a, c, g, or t
tcagcatagtagtgcacgaccggtgctcgatttagagctcacgtattgggtttggggagagctctggggagtctgcaccatggcttggaccccactcctcttcctcaccctcctcctccactgcactagggtctcgtctcccgagcgttgtgctggactcaatcgccctntgcctctgcctccctgggagcctcggtcaagctcatctgcactcngagcagtgggcacagcaactacgccatcgcatggcatcagcagcagccagagaacgggccctacggtacttgatggaaaggttaacaggtgagtggcacgccaacgaccggaaagggggacgggactcccgtgtaacgtttcgttttcgacgggttacctaacgtcgtacggggacttcgggaacgtccggtacctaccccgttccaaccctaacgtccctaccgtaaccgtccctaccgtacgttccgttagggaaccggtagtcggaaggtcctaggtacctaagttactcgtacgtacggaccgttggggacttacggtggtttaagtggtttcgggtttcggacgggtaacgggaccgtaacggccggttacgtacccgggttacgttacggttcgaccggtaccccgagggttccctcccggtacccccgg

SEQ ID NO: 110246 - DNA, 602 bp, Homo sapiens
  misc_feature: GYAE6OF02G4ALX.10.28.C06.1.454.CMB.1.raw
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtcagtcaccatctcctgcactggaaccagcagtgactttgtgcttataactatgtctcctggtaccagcaccaccaggcaaacgccccaaactccttgttttgaggtcagtaacgcggccctgaggacgtccctgactcggttctctcgccctccgaagtctggcaacgaccggcctcccgtcgaccgttctcgtcgggcctccgaggcctggaggatggaggtctagtacttactacgtgacagcgactaattactccgacggaccccaagtacggggttcgttcgggcggacgggtacgtaagggtccgtaccgtcgtacgggtcacggtcccgaacggcctcccggcccccgttggtcctaccgttccgttcccggttaccccacccgttcccgtaccc

SEQ ID NO: 110247 - DNA, 496 bp, Homo sapiens
  misc_feature: GYAE6OF02I32F4.10.28.C06.1.454.CMB.1.raw
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (410)..(410): a, c, t, g, unknown or other
  misc_feature (410)..(410): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacgggatccctgatcgtttttcagggtccagctcgtggggctgagcgctacctcaccatctccagccctccagtcngaggntgaggctgactntactgtcagcctggggcacgtggttatggttggtttcggcggtaggggaccaaggcgtgaccgtcgtaggtcacgcccaggctccg

SEQ ID NO: 110248 - DNA, 493 bp, Homo sapiens
  misc_feature: GYAE6OF02I5A6K.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtactgatgaagttaacagtgatggcagccacaccgaaggggacggatccctgattcgttttcgaggtcagctcgtgggctgagcgctacctcaccatctccacgcctccagtctgaggatgagctgactattactgtcagtaccgtgggactacgttggttattggttgggtttcggcggacggaccagcgtgaccgtcgtaggcacgcctaggctccg

SEQ ID NO: 110249 - DNA, 564 bp, Homo sapiens
  misc_feature: GYAE6OF02JUL7E.10.28.C06.1.454.CMB.1.raw
  modified_base (448)..(448): a, c, t, g, unknown or other
  misc_feature (448)..(448): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcaggtgggcacagcaactacgccatcgcatggcatcagcagcagccagagaacggcctggtacttgatgaaggttaacagtgatggcagccacgaaccggaaggggacggactcccgtgacgttcggttttacgacgggtccagccgttacggtggggtcctacggacggcgtaccgtaccgtcaccctatcctaccagtcctccagtctaggagacgtgagctgactattacgngtcacgtacgtgggctacgttggttacgttggttcgggtttacgggcgggtaacgggtaccgaggtccgtacggtaaccgtcgtacggtccgacggacccgtacggcctaccccgg

SEQ ID NO: 110250 - DNA, 555 bp, Homo sapiens
  misc_feature: GYAE6OF02I5CVN.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaaggttaacagtgatggcagccacaccgaagggggacggatccctgattcgttttcgagggtccagtctcgtggggctgagcgctacctcaccactcctccacgtccctcacgttctaggaggtagtggagctaggtaacttaattactgtcacggtaccgtggggctacgttggttattggttcgggttttcgggacgggtaacgggtaccaaggtccgtacggtacccgttccgtacgggtaccgacggacccgtaggtcccgtcccgg

SEQ ID NO: 110251 - DNA, 533 bp, Homo sapiens
  misc_feature: GYAE6OF02GGZ60.10.28.C06.1.454.CMB.1.raw
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
tcagcatagtagtgcacgaccggtgctcgatttagagctcacgtattgggtttggggagagctctggggagtctgcaccatgggcgttggaccccactcctcttcctcaccctcctcctccactgcacagggtctctctcccagccttgtgctgactcaatcgccctctgcctctgcctccctgggagcctcggtcaagctcatctgcactctgagcagtgggcacagcaactacgccatcgcatggcatcagcagcagccagagaacgggccctacggtacttgataggaaggttaacagtgactggcagcacacgaaggggacggactccgtgtagtcgttttcgacggtccagctcgtgggctgagcgctacgcacgatcacacgctcagtcngagngtgngctcgaacttagtactagtcgacgtaccgtcgggactacgtagttgtgttcgggttcggacggtagggaaccaaggtcgtacgtacccggtcgttacggttcgaccgtacccggaggtcccgtacccgg

SEQ ID NO: 110252 - DNA, 570 bp, Homo sapiens
  misc_feature: GYAE6OF02HHXUW.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtactgatagaaggttaacagtgatggcagccacgaccgaaggggacggactccgtgacttcgtttcgaggtccagctcgtgggctgagcgctacctcactatctccacgtccctcgacgtcgtaggacggatggacgtctagtacttattacgtgtacgacggtaccgtgggacctacgttggttagttgggtttacgggttttccgggacgggtaacgggtacctaaggtccgttacggtacccggttaccgttacggtaccgtaccggacccgtaacggtcccgttaccccgg

SEQ ID NO: 110253 - DNA, 587 bp, Homo sapiens
  misc_feature: GYAE6OF02HRT41.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactcgccatcgcatggcatcagcagcagccagagaagggccctggtactgatgaaggttacagtgatggcagccacgacgaaggggacggatccctgacgtttcgttttcgagggtccagtctcgtggggctgacgcgcctaccgtccaccactcctccacgccctccagtcctaggacggatggacgctagacttagttacgtgtacgacgtaccgtggggccacgttggttacgttgggtttcgggtttttccggggacggggtaacgggtacccgtaagggtcccgttacggtaacccccgggttcggtacggggttaccgaaccgggtacccgtaaccgggttccctacccccggg

SEQ ID NO: 110254 - DNA, 539 bp, Homo sapiens
  misc_feature: GYAE6OF02HGAWX.10.28.C06.1.454.CMB.1.raw
tcagcatagtagtgcacgaccggtgctcgatttagagctcacgtattgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaagcccccaaatccttgtttttgaggtcagtaagcggccctcaggagtccctgatcggttctctgcctccaagtctggcaacacggcctcctgaccgtctctggctccagctgaggatgaggctgattactactgcagcgcatacttcagccccaagcgggtgtttgggcggacgggactaaggtcgaccgtcgtgggtcgaggtacccaaggccttcggcccccgtcggtccaccttcgtcgttccccacccttcccg

SEQ ID NO: 110255 - DNA, 542 bp, Homo sapiens
  misc_feature: GYAE6OF02GJMPL.10.28.C06.1.454.CMB.1.raw
  modified_base (426)..(426): a, c, t, g, unknown or other
  misc_feature (426)..(426): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctgaggggttttctgatcgcttctttgcctccaagtctggcaacacggcctccctgaccatctcgtcgggctccagactgaggacgaggctgtattattactgcngctcacatacaagcggcagtcggttgggtgttcggcggggaccacgacgtcgaccgtccgtaggtccacgcccgaacggtcctccgccccgtcggtccacttccgtcgttcccccg

SEQ ID NO: 110256 - DNA, 695 bp, Homo sapiens
  misc_feature: GYAE6OF02G2JFN.10.28.C06.1.454.CMB.1.raw
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacacgtaccaggcaaacgcccccaaactgatgtatttatgatgtctagtaactccgaccctcgtacggggtttctgtactcgtcttctttgccctaccaagttctcggtacaacgacggtccctccctacgaccctattccgtacgtcggggtcctacccgaagtaccgttacggaggtactcgggacgggtcgttaggtaactttacttacgtgtaccgaaggccgtactaacgttagttaccggaaccggtaaccccgtaacggtagggggtttcggtttcggggacggggtaccgggtaaacggttaacgggtccggtacccgttacggttccggggtaccggaccggacccggaacgggtcccgttccggtacccccccgttcgggtaccctacccgttccgttcccggttaccccctaccccg

SEQ ID NO: 110257 - DNA, 697 bp, Homo sapiens
  misc_feature: GYAE6OF02IUSNU.10.28.C06.1.454.CMB.1.raw
  modified_base (253)..(253): a, c, t, g, unknown or other
  misc_feature (253)..(253): n is a, c, g, or t
tcagcatagtagtgcacgaccggtgctcgatttagagctcacgtattgggtttgggggggtcgtcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaaatntgtctcctggtaccaacacgtaccaggacaaacgacccccaaaactgatgtatttatgatgtcaagtaatccgaccctcgtaggggtttctgatcgtctttcttcgtcccttaccgtaagttctacggactaaccgaccggtccctccctagaaccctactccgttacgtggggcccttacccgacgtaaccgtggaacgggcggtaacggtcgttagtaattttacgttaaccgtagcctaacgtccttaaccaactaactaacgaacggccggacgtaacgggtccggggtttgggttcggttccgggggaccggggaaccctaacgacgttccggaacccggttccgttaacggggtacccacgggaacccccgaacggtcccgttacccgtccccccggttacggttacccacccgtttcccgttacccgttaccccccg

SEQ ID NO: 110258 - DNA, 544 bp, Homo sapiens
  misc_feature: GYAE6OF02HPDA4.10.28.C06.1.454.CMB.1.raw
  modified_base (372)..(372): a, c, t, g, unknown or other
  misc_feature (372)..(372): n is a, c, g, or t
tcagcatagtagtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagagggccctcggtactgatagaaggttaacagtgatggcagccacgaaccgaaggggacggactcccgtgattcgttttcgacggtcagctcgtgggctgagcgctaccncacatctccacgcctcacgtctgagatgaggtctagtactattactgtcacgtaccgtcggggctacgttggttagttggttcggggttttcgggacgggtaacgggtaccgtaacggcgttacggacccgttccgtacggtaccgacggtacccgaacggtcctaccccgg

SEQ ID NO: 110259 - DNA, 551 bp, Homo sapiens
  misc_feature: GYAE6OF02GRNKQ.10.28.C06.1.454.CMB.1.raw
  modified_base (441)..(441): a, c, t, g, unknown or other
  misc_feature (441)..(441): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaatgatgatttatgatgtcaagtaatccgaccctgaggggtttctgatcgtcttctttgcctcaagtctggcaacacggcctccctgacccatcctcgtcgggcctccgagactggaggacgaggctagtatttattactgcagctacanatacaagcgcgaggtcgggttgggtgttcgggcggggaccacgacgtcgaccgtcgtacggcacggccgaacggcctcggccccgtcggtccaccttccgtcgtcccccg

SEQ ID NO: 110260 - DNA, 532 bp, Homo sapiens
  misc_feature: GYAE6OF02FT6AN.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatggaaaggttaaaagtgatggcagccacaccgaagggggacggatccctgattcgttttcgaggtccagctcgtgggctgagcgctacctcaccatcctccacgccctccagtctggaggataggaggctgactattactgtcagaccgtgggctacgttggttatggttcggtttcgggcggtacgggaaccaaggtcgtacggtacccgtccgtacggtccgacggcccgaaggtccgtcggtcccccg

SEQ ID NO: 110261 - DNA, 569 bp, Homo sapiens
  misc_feature: GYAE6OF02H1B2K.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagcagagaagggccctggtactgatgaaggttaacagtgatggcacgccaacaccggaagggggaccggactccctgatttcgttttcgagggtccagcgtcgtggggctgacgcgctacctcaccatcctccacgcctccgagtcgtaggaggtatggacggctaggacttaagttactcgtacgacggtaccgtggggctacgttggttagttgggtttcgggtttcgggcggggtaacgggaaccgtaaggtccgtacggtacccggttccgttacgggtaccgaccggacccgtaacggtcccgtacccgg

SEQ ID NO: 110262 - DNA, 688 bp, Homo sapiens
  misc_feature: GYAE6OF02I4GAW.10.28.C06.1.454.CMB.1.raw
  modified_base (186)..(186): a, c, t, g, unknown or other
  misc_feature (186)..(186): n is a, c, g, or t
tcagcatagtagtgcacgaccggtgctcgatttagagctcacgtattgggtttggggagagctctggggagtctgcaccatggcttgggccccactcctcttcctcaccctcctcctccactgcacagggtctctctcccagcttgtgctgactcaatcgccctctgcctctgcctccctgggacncctcggtcaagctcatctgcactctgagcagtggcacagcaactcgccatcgcatggcatcagcagcagccagagaacgggccctcggtacttgacgtagaaggttaacaggtacgagtggacacgccacgaaccggaaggggaccggactcccgtagtagttccggttttcgacgggtccagcgtcgtgggtctggacgcgactacctcaccgtactccgtccacgtccctaccgtacgtccgtaggacgtcgtacggtacgtccgtacggtaaccttaacgttaaccgttcggttaccgaacggttacccggttacggggtaaccttacggtttaacgggtttacggtttcgggtttaccgggggttttaccggggaccggggtaaaccggggtaaacccggtaacgggtaccggttaccggttaaccccgggttaccggtttaaccgggtacccggtaacccgggtaccccggtaaacgggttcccggttaaccccggg

SEQ ID NO: 110263 - DNA, 617 bp, Homo sapiens
  misc_feature: GYAE6OF02GAFYB.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcaggtgggcacagcaactacgccatcgcatggcatcagcagcacgccaggagaacgggccctcggtacttgataggaaggttaacagtgatggcagccaacgaccggaagggggacggactccgtagtacgtttcgttttacgacgggtacagtcgttcggtgggtctacggacgccgtactaccctaccacctactcctaccacgtccctaccgacgttacgtcggaagtagtacggacggtctacgtaacttagttaccgttcgtaccgacggtaccggtaggggtacctacggttaggttagttcgggtttcggggtttaccggacggggtaacggaccgaacggtccgtacggtacccggtacgtacggtaccgacggacccgtacggtccgtaccccgg

SEQ ID NO: 110264 - DNA, 540 bp, Homo sapiens
  misc_feature: GYAE6OF02J1298.10.28.C06.1.454.CMB.1.raw
  modified_base (383)..(383): a, c, t, g, unknown or other
  misc_feature (383)..(383): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagacgggccctcggtacttagataggaaggttaacgagtgagtggcacgccacgaccggaaggggacggacgtcctgtagttcgttttcgaggtccagcgtcggtgggcgtgacgcgctaccncaccgtatccgtccgacgccctccagtcgtgaggtatggagctgtactattacgtgtacgacggacgtggactacgtggttacgtggttgggttcggagggaacggacctacggtcgtcgtaccgtcgtacggcctacgacccgtaggtcctcccgg

SEQ ID NO: 110265 - DNA, 539 bp, Homo sapiens
  misc_feature: GYAE6OF02I1YOO.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctggtacttgatgaaggttaacagtgatggcagccacaccgaaggggacggatcccgtgacttcgttttcgaggtccagtctcgtgggctgagcgcctacctcaccatcctccacgccctccagtctgaggatggacgtctagactattacgtgtcgagaccgtgggactacgttggttactggttcggttttcggacgggtacgggtaaccaaggtcgtacggtacccgttacgtacgggtccacggacccgtaaggtcctaccccgg

SEQ ID NO: 110266 - DNA, 562 bp, Homo sapiens
  misc_feature: GYAE6OF02GOHYK.10.28.C06.1.454.CMB.1.raw
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaacgcccccaaactgatgatttatgatgtcagtaatcgaccctcgaggggtttctgatcgtcttctttgcctccaagtctgcaacacgcctccctgacccatcctcgtgggcctccagactggaggacgaggctagtattattactgcagcctcacactacgaacgcggacgacggtcgggttgggtcggttccgggcgggggaccacgacgtcgaccgtccgtaacggcacggcccgaaggccgtccggccccgtcggtccacgttctccgttaccccc

SEQ ID NO: 110267 - DNA, 592 bp, Homo sapiens
  misc_feature: GYAE6OF02GSK0F.10.28.C06.1.454.CMB.1.raw
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtaccaggcaaacgcccccaaactgatgatttatgatgtactagtaactccgaccctacgtaggggtttctgactcgtcttcttgcctcaagtctgcaacgcggtcctccgtgacctatcctcgtcgggcctaccgacgacgtggacggacgagctagtacttattacgtgcacgctacaactactaacgaggcggacgtaggtcgggttgggtcgggttcggggcggggtaaccacgacgtcgtaccggtccgtacggtaccgacggacccgacggtccgtccggtccccgtcggtcccacgttccgtccgttacccccg

SEQ ID NO: 110268 - DNA, 555 bp, Homo sapiens
  misc_feature: GYAE6OF02GBB86.10.28.C06.1.454.CMB.1.raw
  modified_base (448)..(448): a, c, t, g, unknown or other
  misc_feature (448)..(448): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaagcccccaaactccttgtttttgaggtcagtaagcggccctcaggagtccctgatcggttctctgcctccaagtctgcaacacggccctcctgaccgtctcgtcgggctccgaggctgaggatgaggtctgtacttactactgcagcgcatattcacgccccaagngggtgtttgggcggcggtacgtaaggtcgaccgtcgtgggtcacgcccgaaggcctccgcccccgtcggtcctaccgtctccgttccccaccctccctccacttacc

SEQ ID NO: 110269 - DNA, 736 bp, Homo sapiens
  misc_feature: GYAE6OF02G97JJ.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcagtggcatcagcagcagccaggacgaacgggccctcggtacttggataggaaggttaacaggtgagtcggcacgaccaacgaaccggaagggggacggactccgtgtacgtttcggttttcgacgggttccaggtcgtcggtcggggtcgtacggacggtccgtacctacccgtaccgtaacccacgttccctaccgaccgtccccgttaccgtacggttaccggtacggacgggtacgtacgggacgggtccgtaacggttaactttaacgtttacgtacgtaccgtaaccgggttaccggttcgggggtaaccttacgggtttagggtttacggtttcggggttttacggggttttaccggggaacccgggggtaaacgggtaacccgttaacgggttcccggttaaccggggttaccccggtttaacccggttaaccggggttacccgtaaccggggtacccccggtaacggggttccccgttccccccgggg

SEQ ID NO: 110270 - DNA, 624 bp, Homo sapiens
  misc_feature: GYAE6OF02HIL0K.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctccctgggacgcctcggtcaagctcatctgcactctgagcaggtgggcacagacaactacgccatcgcatcggcatcagcagcagccaggaacggaacgggccccgtacggtacttgaagtaggtaaacggttaacaggttagagtggacacgaccaacgaaccggaacgggggacggactccgtagtacgtttcggttttacgacgggtccagtcgtcggtggggtctggacgcgacctaccgtcacctactccgtaccacgtcctccgagtcgtgaaggatcggagtctacgtaacttagttacgtcgtacgacggtaccggtgggactacggttggttagttgggtttcggggtttacggaccggggtaaaggtaccgtaaggtcgtaccgggtacccgttacggtacgggtaccgaacgtacccggacggtcccgtaccccggg

SEQ ID NO: 110271 - DNA, 595 bp, Homo sapiens
  misc_feature: GYAE6OF02H1RVC.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagccaactacgccaatcgcatggcatcagcagcagccagagaacggccctcggtacttgatgaaaggttaacagtgagtggcacgaccaacgaaccggaacggggacgggtactacccgtgtacgtttcgttttcgacggtcagtcgtcgtggggtctggacgtcgcctacctccacctactcctccacgccctaccgacgttcgtacggagtacgtaggagggctacggtacttacttacgtacgtacaacggtaccgttggggacctaggttcggttagttcggttcgggttttcgggacgggtacgggtaccgaacggtcgtaccggaccgttcccgtacggtaccgacggacccgtacggcctcccgg

SEQ ID NO: 110272 - DNA, 649 bp, Homo sapiens
  misc_feature: GYAE6OF02JWMT6.10.28.C06.1.454.CMB.1.raw
  modified_base (187)..(187): a, c, t, g, unknown or other
  misc_feature (187)..(187): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctccctgggacncctcggtcaagctcatctgcactctgacgcaggtgggcacagacaactacgccatcgcatggcatcagcagcagccagaggacggcctagtactgatggaagttacagtgatggacacgccacgaacggaaggggacggactccgagtacgtttcgtttacggacgggtccagtccgttcggtaggggtctacggacgtcccggtacctacccgtcaacccgtacttccgtcccgacgtccctccgtaacgttccgaggtacggacgtaggacggtacgtagtaaccgtttaacgtttaccgaccggttaccgaacgggtaccggtcgggtaccgtaacggtttgggttacgttacgggtttcgggtttaccgggaccgggtacgggtaacccagggtacccgtacggtaccccggttacggtacggttacccgaccggtacccgagggtcccctccccggg

SEQ ID NO: 110273 - DNA, 696 bp, Homo sapiens
  misc_feature: GYAE6OF02GKMMF.10.28.C06.1.454.CMB.1.raw
  modified_base (305)..(305): a, c, t, g, unknown or other
  misc_feature (305)..(305): n is a, c, g, or t
  modified_base (339)..(339): a, c, t, g, unknown or other
  misc_feature (339)..(339): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagtacccaggacaaacgcccccaaatgatgatttangatgtacagtaactccgaccctgtaggggtttcngattcgtctttcgtttcgccctacgtaacgtcgtacggaccaaccgaccggtcccttacccgtagaaccctattccttacggtcggggtccttaccgaacgtaccgtagggacgggaccggagggtcttagtaactttaacgttacgtcgacgtacgtcctacaactaacgtaacgaaacggccggtacgtacggggttcggggttggggttacgggtccgggggaccgggggaacctaccggtaccgttaccgggacccggttaccggtacgggtaccgaaccggtaccccgtaagggtcccgtacccggtcccccgttacggtaccctacccgttccgttcccgttacccccccg

SEQ ID NO: 110274 - DNA, 565 bp, Homo sapiens
  misc_feature: GYAE6OF02HELOF.10.28.C06.1.454.CMB.1.raw
  modified_base (294)..(294): a, c, t, g, unknown or other
  misc_feature (294)..(294): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggcctacggtactgatggaaggttaacngtgatggcagccaacaccgaagggacgacgggactcccgtagtacgtttcgttttcgacgggtccagcgtcgtgggctggacgccgctacctcacctactctaccgacgtccctcagttctggacggagtggaggctagacttagttacgtgtcgacgtaccggtggggacctacgtgtagttacgttggtttgggtttccgggcggtacggggtaaccgaacggtcgtacggtaacccggtccgtaaggtccgacggaccccgtaacggg

SEQ ID NO: 110275 - DNA, 764 bp, Homo sapiens
  misc_feature: GYAE6OF02JFZ1B.10.28.C06.1.454.CMB.1.raw
  modified_base (226)..(226): a, c, t, g, unknown or other
  misc_feature (226)..(226): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctcccgtgggagcctcggtcaagctcatctgcactctgagcaggtgggcacngcaacctacgccatcgcatggcatcagcacgcacgaccaggacggaacgggcccttcggtaacttcgagtacggaaggttaacgagtgagtggacgacggccaacgaaccggaacgggggaccggtactccgtagtacgttttccgggttttacgacgggttaccacggtccgttcggtcggggtcgtaggacgtccgtacctaccttaccgaaacctcgttcccgaccgtaccggtcccttaccgacggtttccgtaacggacgggtaacgtcggtaacgggtactttacgggtaaaccttacgttttaacgtccgggtaacctaaccggggtaacccggttacgggggtaacctttaaccggttttagggggtttaacggtttccgggggtttttaggggttttacccggggggaccgggggttaaaccgggggtaacccgtaaaggtcccgggtttaaccggggtaccgtttaaccccgggtacgggtaaccccggtaccggaaccccgggttacgggtccccttacccccgggg

SEQ ID NO: 110276 - DNA, 688 bp, Homo sapiens
  misc_feature: GYAE6OF02JYDCH.10.28.C06.1.454.CMB.1.raw
  modified_base (156)..(156): a, c, t, g, unknown or other
  misc_feature (156)..(156): n is a, c, g, or t
tcagcatagtagtgcacgaccggtgctcgatttagagctcacgtattgggtttggggtagagctctggggagtctgcaccatggcttggaccccactcctcttcctcaccctcctcctccactgcacagggtctctctcccagcttgtgctgactnaactcgcctctgcctctcgcctccgtgggacgcctcggtcaagtctcatcctgcactcgtgacgcagtcgggcacagcaactacgccagtacgcatcggcatacacgcagcacgaccgagacggaaccgggccttacggtacgttgaagtacggaaacggtttaaccaggtacgaagtcggacaacgacccgaacgtaaccggaagggggaccgggtaactcccggtgtaacgttcggttttacgacgggtccagtcgtcgtggggctgacgcgctacctcgaccactccgtaccacgtccgtaccgtagtctacggtaggtacgtacggaaggtcttacgtaaccgtacgtttacgacggttacgtaaccggtaccggtcgggtaacctacggttcggttaacggtgggtttccgggtttacgggaccggggtaacgggttaacccgaacggttaccggtaccggttacccggtaccggtttaacgggtacccgtacgggtaaccccggtacgggttcccgtacccccggg

SEQ ID NO: 110277 - DNA, 663 bp, Homo sapiens
  misc_feature: GYAE6OF02G31HQ.10.28.C06.1.454.CMB.1.raw
tcagcatagtagtgcacgaccggtgctcgatttagagctcacgtattggggtttggggagagctctggggagtctgcaccatggcttggaccccactcctcttcctcaccctcctcctccactgcacagggtctctctcccagcttgtgctgactcaatcgccctctgcctctgcctccctgggacgcctcggtcaagctcatctgcactctgagcaggtgggcacagcaactacgccatcgcatggcatcagcagcagccaggacggaacgggccctcggtactgataggaaggttaacagtgagtggcacgccaacgaccggaaggggggcggactcccgtagtactttcggttttcgacgggtccaggtcgtcggtggggtctggacgccggtaccttacccgtcctaaccctacgttccctaccgacggttccctccgaagttccgttagggacgggtattcggaacgggtccttacggtaaccgtttaacgtttacgtcggtaccgtaacgggtacccggtgggggtacctacggtttggggtttaagttcggggtttcggggtttaccggggacgggtaacggggtaaccctaagggtccgtaccggtacccggtacgtaacggtaccgaacccggtaccggacgggtcctccccgg

SEQ ID NO: 110278 - DNA, 746 bp, Homo sapiens
  misc_feature: GYAE6OF02IJGRY.10.28.C06.1.454.CMB.1.raw
  modified_base (128)..(128): a, c, t, g, unknown or other
  misc_feature (128)..(128): n is a, c, g, or t
  modified_base (140)..(140): a, c, t, g, unknown or other
  misc_feature (140)..(140): n is a, c, g, or t
  modified_base (147)..(147): a, c, t, g, unknown or other
  misc_feature (147)..(147): n is a, c, g, or t
  modified_base (151)..(151): a, c, t, g, unknown or other
  misc_feature (151)..(151): n is a, c, g, or t
  modified_base (547)..(547): a, c, t, g, unknown or other
  misc_feature (547)..(547): n is a, c, g, or t
  modified_base (561)..(561): a, c, t, g, unknown or other
  misc_feature (561)..(561): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacgnggtctctctccngtcttgnctanactacacgtcccgcctctcgtcctcgtccgtcccctccggtaggacctccgtcggtacaacgtcctactactcgtcacctctcgtgacgcgtagggtcgaccacgacgacctaaactccgctagtccgatagcgactagcgacgcgagacgacgacgaagggtaacgtaccggtcccgttaggtactagacgtaaggttaaacgtagtaggtacgagcgacgaccgtaacgaaccgaaaccgggggacgggtacgtaacccttccgtaagttaccgttttaccggttacggaccggtaccacgtcggtacggtcgggacttaccggtacgtccgtacctacccgtaactaccggacttcccgacgtacccgtcccgagttaacgtcgaacgggtancggtttagaccgtntaccggactttacgtacgtgaccggttaaccgtcggacgttcgtaaggtttgttacgttcgggtttaccgggtaacgggccgggttaaacggaaccgccggttaccggttaaccccggttaccggttagggtaccccggtaccgtaaccccggtaaccggaccggggtttcccctaacccccggg

SEQ ID NO: 110279 - DNA, 635 bp, Homo sapiens
  misc_feature: GYAE6OF02J1WZ4.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgataggaaggttaacaggtgagtggcacgaccaacgaaccggaaggggacggacgtccgtggtacgttcgttttacgacggtccagcgtcggtgggctggacgccgcctaccgtacactactccgtccgacgtccctaccgacgttctaggacggtagtcgtacgggtctacgtaacgttacgtttacgtacgttacgaccggtaccggttacggggtaccttacggttggtttacgttcgggtttacgggtttccgggacggggtaaccgggtaaccgtacgggtaccgttaccggtacccggttaccgtacgggtaccaccggtaacccggtaccggtcccgttacccccggg

SEQ ID NO: 110280 - DNA, 590 bp, Homo sapiens
  misc_feature: GYAE6OF02FOSR7.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagaggaacgggccctcggtacttgatggaaggttaacagtgatggcagccacgacgaaggggacggactccgtgtattcgttttcgagggtcagtctcgtgggctggacgcgctacctcacctatcctaccgacgtccctaccgacgttcgtaggaggtagtggaggtctagtacttattactgtcacggtccggtagggctacggttgggttagttcgggtttacgggtttccggggacgggtaacgggtaaccgtaacgggtccgttaccggtacccggttccggttacgggtaccgaccggtaccccggtacgggtccctacccccggg

SEQ ID NO: 110281 - DNA, 527 bp, Homo sapiens
  misc_feature: GYAE6OF02H5NCU.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggcctcggtacttgatgaaggttaacagtgatggcagccacgacgaaggggacggatccctgattcgttttcgaggtcagctcgtgggctgagcgctacctcaccatctccacgcctccagtctgaggatgaggctagacttagttactgtcgacgtaccgtggggcacgttggttagttggttcgggttttcgggacgggtaacgggaccaaggtccgtcggacccgttcgtacggtccacggaccctacggctccccgg

SEQ ID NO: 110282 - DNA, 598 bp, Homo sapiens
  misc_feature: GYAE6OF02F66Q6.10.28.C06.1.454.CMB.1.raw
  modified_base (377)..(377): a, c, t, g, unknown or other
  misc_feature (377)..(377): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgcctcccgtgggacgcccttcggtcaagctcatctgcactctgagcaggtggcacacgacaacctacgccaagtcgcagtggcatcgagcagcacgccaggagaacgggccctaggtacttagagtacggtaaaggtaacagtagagtggacacgccaacgacggaaggggacggactccgtgtactttcgtttacgacggtcngctcggtgggctgcgccgtctaccgtcacctacgtcctacacgtccctaccgagttccggtagacggatcggacgactagtacttatacgtcgtaacgacggtaccggtgggactagttacggttagtcgggtttacgggttcgggacgggtacggaacgtacggtccggtacggtacccggtacgtacggtaccgaccggaccggtacggtccgtcccgg

SEQ ID NO: 110283 - DNA, 680 bp, Homo sapiens
  misc_feature: GYAE6OF02FQ406.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctcccgtgggacgccgtcggtcaagctcatctgcactctgagcagtgggcacagcaactacgccatcgcatggcatcagcagcacgccaggagaacggccctcggtacttgatagaaaggttaacaggtagatggacacgaccacgaaccggaaggggaccggactacccgtagacgttttccggttttacgacgggtaccacgtcgtccggtggggtccttaggacggtccgtaccgtaccctaccgaaccctacgtccctaccgaccgtccctaccgtacgttcgtaggagtacgttggacgtctacggtaactttacgttacggtacgtaccgtaacggtccgggttcgggtacctaacggtttgggttacgtttcggggttttacgggtttccggggaccggggtaacgggtaacccgtaacgggtaccgttacccgggttaaccggttacccggttacgggttaccgaccgggtacccgtacgggtaccgttccccccggg

SEQ ID NO: 110284 - DNA, 583 bp, Homo sapiens
  misc_feature: GYAE6OF02GBYH2.10.28.C06.1.454.CMB.1.raw
  modified_base (293)..(293): a, c, t, g, unknown or other
  misc_feature (293)..(293): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggacgcctcggtcaagctcatctgcactctgagcagtgggcacagcaacgtacgccatcgcatggcatcagcagcagccagagaacgggcctggtactgatgaaggttaacngtgatggcagccaacgaccggaaggggacggatcccgtagacttcgttttcgacgggtccagtacgtcgtggggctggacgcgtactaccgtcaccgtatcctccgagtcctccagtctagacgtagtcgaggctacgacttatacgtcgtacgacgaccgttggggacctacggttggttagttcggttacgggttttccgggaccgggtaacggggtacctaacgggtaccgtacggtacccgttaccggtacgggtccgaaccggccccgtaaggcttacccccggg

SEQ ID NO: 110285 - DNA, 614 bp, Homo sapiens
  misc_feature: GYAE6OF02HH2SL.10.28.C06.1.454.CMB.1.raw
  modified_base (348)..(348): a, c, t, g, unknown or other
  misc_feature (348)..(348): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatcctcctgcactggaccccaccagttacattggtaaataatgaatatgtctcctggtaaccaacacgtacccaggacaaacgccccccaaaatgatgtatttatgatgtacagtaactccgaccctgtaggggtttcngtatcgtctttctttcgccctaccgtaagtcctggaccaacgaccggtccctcctcgacctactctcgtggcctcagacgtgaggacgaggctgtattatacgngcacnctcaacactaacgacggcgacgtacgggtcgggttcggggttcggttcgggggaccggggaccacgtccgtacggacccgttccggtaaggccacggacccgtacggtcccgtcccggtcccccgtcggtacctaccgttccgtacccttccccccg

SEQ ID NO: 110286 - DNA, 632 bp, Homo sapiens
  misc_feature: GYAE6OF02FYKJR.10.28.C06.1.454.CMB.1.raw
tcagcatagtagtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccgagacggaacgggccctacggtacttgataggaaaggttaacagtgagtggcagccaacgaaccggaagggggacgggactccgtgacgtttcgttttcgacggtccagcgtcggtggggctcggacgtccgtacctacctcacctatcctacccgacgtccctccgacgttcgtcgaggtagtcgacggctacgtaacttacgttaccgtcgtccgtaacggtacccggttggggacctacggttgggtttacgttggggtttacgggtttcgggaccggggtacggtaaccggtaacgggtccgttacgggtacccggttaccggttaacgggtaccgaccggtaccccggtaagggtcccgtaccccggg

SEQ ID NO: 110287 - DNA, 675 bp, Homo sapiens
  misc_feature: GYAE6OF02IDEYW.10.28.C06.1.454.CMB.1.raw
tcagcatagtagtgcacgaccggtgctcgatttagagctcacgtattgggtttgggggggtcgtcgaggaggcggccctctcgggacgtctccaccatggcctgggctctgctattcctcacctcctcactcaggcacagggtcctgggcccagtctgccctgactcagcctgactccgtgtctgggtctcctggacagtcgatcactatctctgcactggcaccagcagtgacataggtgacttaataactatgtctctggtacaacaacaccacgccaggccccagacctcactctatttctgtactgtcagtgtacttcggtccctttggactttctaatccgtcttcttctcgtcctccaagtctggacaacgaccgtctttcccacgtacctactaccgtccgggtacctccacgtcctagaacgggacggacggtcttactaacgtttactttaccgtacgtacaacggtcctacctaattaaccgtaacctaaaccccgtagggggtaccctaaccgttaccgttcccggtaagtaaccttacggtttccggggtaaccggggaacgggttaacccggtacgggtaccgttaacccggtacccggtttaccccgtaaccggttacccgtaacccggtaccccgtaaacgggtcccgtttccccccggg

SEQ ID NO: 110288 - DNA, 659 bp, Homo sapiens
  misc_feature: GYAE6OF02F7BC4.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgcctcccgtgggacgcctcggtcaagctcatctgcactctgagcaggtgggcacagcaactcgccatcgcatggcatcagcagcagccagaggacgggccctcggtactgagtggaaggttaacagtgagtggcacgacccacgaaccggaagggggacgggtactcccgtaggtacgtttcggttttacgacgggtccgtagtccgttcggtggggcgtacggaggccgtacctaccctacgacctactcctccgacgtccctaccgacgtcgtaggagtacgtaggacggtctacggtaacttagttaccgtacgtccgaacggtaccggttggggaccttacggttagggttttacgttcgggttttacggggtttaccggggaccggggtaacggggtaaccgtaacgggtccgtacgggttaaccccgttaccgttagggtaccgtaccgggtacccggtaacgggtcccttacccccggg

SEQ ID NO: 110289 - DNA, 542 bp, Homo sapiens
  misc_feature: GYAE6OF02GSALL.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacgaccgaaggggacggatcccgtgattcgttttcagggtcagctcgtggggctggacgcgcctacctcgacctactcctccacgccctccgacgtctggacggtatcggagctagacttattacgtgtaccagaccgtgggcacgttggttatggttggtttcgggcgggtacgggaaccaaggtccgtacggaccgttaccgtacggtccgaccgtacccggtacggctccccgg

SEQ ID NO: 110290 - DNA, 749 bp, Homo sapiens
  misc_feature: GYAE6OF02H4U7M.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacaggtctctctcccagcttgtgctgactcaatcgccctctgcctctgccctcccgtgggagcctcggtcaagctcatctgcactctgacgcgaggtgggccaacgagaccaaacgtccgaccaagtcgccagtggccatcagcagacacgccagaacggaacgggtccctacggttacttagagttaggtaaaggttaacgagttagagtcggtacacggaccaaccgaacggaacgggggaccgacgtccgtagtacgttttccggtttacgaacggtccgtacgtcgttcggtcgggcttacgggacgccgtacctacccgtaccgtacctacgtaccctccgtaaccgtcccgtaccgtaacggttcgtacggtaacggtacgtagggtaccgtacgttacgtaacccgttttaagttaccgtacggtaccgtaaccggtacccggttaacggggtacctacggtttacgggttttaggtacgggttttttacgggggtttccgggtaacggggtaaccgggtaaaccgtacgggtaccgttaccggtaacccgggtttacgttaaccgggtacccggtaacccgggaacccggttaacccgggtccccgttacccccggg

SEQ ID NO: 110291 - DNA, 542 bp, Homo sapiens
  misc_feature: GYAE6OF02HXWSB.10.28.C06.1.454.CMB.1.raw
  modified_base (473)..(473): a, c, t, g, unknown or other
  misc_feature (473)..(473): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaaataatgaatatgtctcctggtaccaacagtacccaggcaaagcccccaaactgatgatttatgatgtcagtaatcgaccctcgaggggttttctgatcgcttctttgcctccaagtctgcaacacggcctccctgaccatctctgggctccagacctggacggacgaggctgattattactgcagctacacatacgagcgcgagtcggtggtgttcggggcggggaccncgacgtcgaccgtccgtaggtcacgacccgaggcctccgccccgtcggtccaccttcgtccgttccccg

SEQ ID NO: 110292 - DNA, 704 bp, Homo sapiens
  misc_feature: GYAE6OF02G2QEZ.10.28.C06.1.454.CMB.1.raw
tcagcatagtagtgcacgaccggtgctcgatttagagctcacgtattgggtttggggggggtctcaggaggcggccctctcgggacgtctccaccatggcctgggctctgctattcctcaccctcctcactcaggcacagggtcctgggcccagtctgccctgactcagcctgcctccgtgtctgggtctccgtggacagtccatcaccatctcctgcactggacccacagttacattggtaaataatgaatatgtctcctaggtaccaacacgtacccaggacaaacgacccccaaatgatgattatgatcgtacagtaactcgaccctgtacggggtttcagtactcgtactttcgttcgaccttaccgaagttccgtagggactaaaccgtaccggtccccttaccctaggaaccctagttaccgttcgtacgggtcctacccgtaacgtaccgtaggacgggtaacgacggtaccgttaggtaactttacgttacgtacgaccaacgtccgtacctaacgtaacgtaacgaacggtacgggacgtaacgggttcggggtttagggtcgggttacccgggggaccgggggaacccacggtaccgtcggtacccggtaccgtacggtaccacggtacccggaacggtccgtacccgggtcccccttacggtcccgtaacgttcccgttaccgttaccccccg

SEQ ID NO: 110293 - DNA, 560 bp, Homo sapiens
  misc_feature: GYAE6OF02JFTGM.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtactgatggaaggttaacagtgatggcagccacgaccgaaggggacggatccgtgacttcgttttcgaggtcagctcgtgggctgagcgctacctcaccatcctccacgccctccagttcgtggagtactggacggtctagacttacgttacgtcgtacgaacgtaccggtggggcctacggttgggttaacgttgggttcgggtttccgggacgggtaacgggtaccaagggtccgtacggtacccggtccgtagggtccgacggtacccgaggtccgtccccgg

SEQ ID NO: 110294 - DNA, 732 bp, Homo sapiens
  misc_feature: GYAE6OF02GDWT4.10.28.C06.1.454.CMB.1.raw
  modified_base (447)..(447): a, c, t, g, unknown or other
  misc_feature (447)..(447): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctcccgtgggagcctcggtcaagctcatctgcactctgagcaggtgggcacgagacaactaccgccatccgcatggcatcagcagcagccagaggaacgggccctcggtactgagtaggaaggttaacagtgagtcggacacgacccgacgaccggaaagggggaccggtactacccgtgtacgttttcggttttacgacgggtaccaggtccgttacgggtcggggtacgtggacggtaccgtaccttaacccgtccaacctacgtacccncccgtacgtaccccttaccgacggttccgttagggaacgggtacgtacggggtacgtaccgttaggtaaccgtttacgtttaccgttcggttacccgtaacgggtaccgggttacgggggacccttaacgggtttgggtttaacggtttcgggttttacgggggtttcccggggacggggtaaccggggtaacccgtaacggtccgggttaccggttaaccccggtttaccggtacgggttacccggaaccggtaccccggttaccggggtcccgttaccccggg

SEQ ID NO: 110295 - DNA, 707 bp, Homo sapiens
  misc_feature: GYAE6OF02GB0TX.10.28.C06.1.454.CMB.1.raw
  modified_base (187)..(187): a, c, t, g, unknown or other
  misc_feature (187)..(187): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctcccgtgggacncctcggtcaagctcatctgcactctgagcaggtcgggcacagcaactacgccatcgcagtggcatcgagcagcgacgccgaggaacggaacgggtccccgtacggtaccgttgaagtaggtaaacggttaacgaggtcgtagtagggacaacggaccgaaccgaaccgggaacgggggaccggtacgttcccgtaggtacgtttccggtttttacggacgggtcctaaggtccgttcgggtgggggactgggacggccgtactacccgtcctaccgacgttccaccgaacgtccctaccgtacggttcgtacgggacggattacgggagtccgttacgtaactttaagttaccgtcggtaccgtaacggaccgggttacgggaccttacggtttaggttacgtttcgggtttcggggtttaccgggacggggtacgggtaaaccgtacgggttccgtaccggttacccggttaccggtacggtaccggtaccgtaccccggtaggcccttaccccccggg

SEQ ID NO: 110296 - DNA, 558 bp, Homo sapiens
  misc_feature: GYAE6OF02I9ID1.10.28.C06.1.454.CMB.1.raw
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacacgtaccccaggccaaacgccccccaaaactgaatgtaatttatgatgtcagtaatcgaccctgagggtttctgatcgcttcttgcctcagtctgcaacacggcctccctgacctatcctcgtcgggcctccgagacgtggacggacgaggctagtacttaattctgcagctccacatacagcgcaggtcggttgggtcggttcgggccggggaccacgtacgtcgaccggtacgtaggtaccacggaccgtacggcctcgccccgtcgtccacgtccgtcgtcccccg

SEQ ID NO: 110297 - DNA, 611 bp, Homo sapiens
  misc_feature: GYAE6OF02JCZC5.10.28.C06.1.454.CMB.1.raw
  modified_base (305)..(305): a, c, t, g, unknown or other
  misc_feature (305)..(305): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttangatgtcagtaatcgaccctcgaggggtttctgatcgtcttcttgcctcaagtctggcaacaccggcctccctgaccatcctcgtcgggcctccagactggaggacgaggctagatttattactgcagcctacaactataacgaacggccggactacggtcggggtttcggggttcgggtttccgggggaccggggggaacccacgtaccgtcggtacccggtccgtaagggtcccacggtaccccgaacggtccgttcccggccccccgttcggttcccaccgtttcccgtcccgtttaccccccg

SEQ ID NO: 110298 - DNA, 710 bp, Homo sapiens
  misc_feature: GYAE6OF02G33O1.10.28.C06.1.454.CMB.1.raw
  modified_base (337)..(337): a, c, t, g, unknown or other
  misc_feature (337)..(337): n is a, c, g, or t
tcagcatagtagtgcacgaccggtgctcgatttagagctcacgtattgggtttggggaggagctctggggagtctgcaccatggcttggaccccactcctcttcctcaccctcctcctccactgcacaggtctctctccagcttgtgctgactcaatccgccctctcgcctctcgccctcccgtagggacgcctcggtacaagctcatctgacactctgagcgaggtgggcacagactaaacgtcaccatcgcatggacatcagacagaccgagaccaaggaacggtaacgggccccgttacggtaacgtttaggaattaagggaaaacggtttaanaggtagaagtcggacgtaacggaccaaccgaacgggaaacgggggacggtacctcccgtagtacgtttcgttttaccggaacgggtctaacggtcgtacgggtcggggctaggacggcctacgtacccttacgaaaccctagtccctcgacgacccgtacctacgggttacagggtaaacgggtacgtagggaccggttacgtaacgttaacttaaggtttaccctacgggttaaccacggttaaccgtcgggggaacctacggtttagttacggttagggtttcgggttacgggaccgggttaagggacccgttaagaccggttcggtaccgttacggtacggtaccgaagacccgtacgggacctcccggg

SEQ ID NO: 110299 - DNA, 610 bp, Homo sapiens
  misc_feature: GYAE6OF02IYBMN.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagacgacgggccctcggtactgataggaaggttaacagtgatggcagccacgaaccggaaggggacggactcccgtgtacgtttcggttttcgacgggtccagtcgtcggtagggtctggacgccgtacctacctccaacctacgtcctccgacgtccctccgagttaccgtggtacggacgtacggacgtcgtagtaacttagttaccgtagtaccgacggtaccgtggggtcctacggttaggtttagttcgggtttagggttttacgggacgggtaacgggtaccgtaaggtccgttacggtacccgttaccggtaggtacccgacgtacccggacggtccgtccccgg

SEQ ID NO: 110300 - DNA, 669 bp, Homo sapiens
  misc_feature: GYAE6OF02I0PYL.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgacgcaggtcgggcacagacaactacgccatcgcatggcatcagcagcagccagaggaacggccctacggtactgagtagaaaggttaacagtgatggacacgccgacgaaccggaaggggaccggactacccgtgactttcggttttacgacgggtaccacggtctcggtcggggtctacgggacgtccgtaccttacccgtccaaccgtcttacccgtaccgacgtcccctaccgacgttccgtaggacggtacgtaggaccggtcgtacggtacttaagttaccgtggtaccgacggtaacccggttcggggtacctaacggttggtttacgttcgggtttagggttttaccggggaccggggaacggggttaaccgaacggtccgttaccgggttacccggttaccggtacgggttccgtaaccgggacccggtaacggtccccgttaccccggg

SEQ ID NO: 110301 - DNA, 626 bp, Homo sapiens
  misc_feature: GYAE6OF02HELHY.10.28.C06.1.454.CMB.1.raw
  modified_base (474)..(474): a, c, t, g, unknown or other
  misc_feature (474)..(474): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggaaccagcagtgacggttggtggttataactatgtctcctggtaccaacaacacccaggacaaacgcccccaaatccatgatttttgatgtacagtactcggccctgtacggggtttctaatccgtctttctcgtggtcctccgtaacgtcgtggacctaaccgaccggtcccttccctacgaccctatccgtctcgggccttccgacggtctaggacggacgaggctgtatttacttacgtgacacgactntaacttaacaaccaaccacgccgaacgcctactttcgtagtcgttcgggaccgggtagggtaaccagtccgtacggtacccgttaccgttcggacctacggaccctaaggtcccgtacccgtcccccggtccggttacctaccgttccccgg

SEQ ID NO: 110302 - DNA, 792 bp, Homo sapiens
  misc_feature: GYAE6OF02HNL7C.10.28.C06.1.454.CMB.1.raw
  modified_base (188)..(188): a, c, t, g, unknown or other
  misc_feature (188)..(188): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctcccgtgggacncctcggtcaagctcatctgctactctgagcaggtcggcaacgagaccaaacgtcgccagtccgacagtcggactacgtacaggacgacgaccgaacgacccgaaagggaacgggaaacccggggtccccgttacgggtttaacgttaggaagttaacgggtaaaacggtttaacgaggttacgaaggtcggaccgaccgacccgaaccggaaccggggaaacgggggtaccggtacctcccggtaaggttcgttttacggttttacgacgggttacacggtccgttacgggtcgggcctaggaccggtccgtacctaacccgtccgtaaccgtaccttcccgtaccgaccgtcccgtaaccgtacggttaccgtaggtacggacgttacgggacgttacgtaaccgttactttaacgttaccgttacggtacgtaaccggtccgggttagggtaccgttaaggtttcgggtttacgtttcggggttttaccggggttacgggacccgggggtaaacggtaccgtaacgggtcccgttaccgggtaacccggttccggaacccggtaccggaacccggtacccggtacggtcccgttacccccgg

SEQ ID NO: 110303 - DNA, 588 bp, Homo sapiens
  misc_feature: GYAE6OF02JHGWO.10.28.C06.1.454.CMB.1.raw
tcagcatagtagtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcaggtgggcacagcaactacgccatcgcatggcatcagcagcagccagagaaggccctggtacttgatgaagttaacagtgatggcagccacgaaccgaaggggacggatccctagtactttcggttttacgagggtcagtctcgtgggctgacgcgtctacctcaccatcctccgacgcctaccgagttcgtagacggtatcggagtcgtagtaacttacgttactcgtacacggtaccgttcgggactacgttggttagttcggtttcgggttttaccgggacgggtaacgggtaaccgtaacggtccgttacggtacccggttaccggttacgggtaccgtaccggtacccggtacggtccgtaccccggg

SEQ ID NO: 110304 - DNA, 723 bp, Homo sapiens
  misc_feature: GYAE6OF02F6A5J.10.28.C06.1.454.CMB.1.raw
  modified_base (166)..(166): a, c, t, g, unknown or other
  misc_feature (166)..(166): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctntcgcctctcgccctcccgtgggacgtccgtcggtacaacgctacatctgctactctgagcaggtggcacgagacaaactacgccagtcgcagtcggcatcagcacgccgagccaaggaacggaacgggtcccttacggtacttaggaagtaagggtaaacggttaaagaggtagacgtcgggacaacgacccgaacgaaaccgggaaacgggggtaccgtacgttccgtagttaacgttttcgttttaccggaacgggtacctacggtccggttacggtacggggtctaacgggacggttacccgtaaccgttacccttaaccgaccttaccgttccgaccgtaccgtcccgtaccgtacggttcggtaacggacgggtagtacggtacgggtacttacggtaattacgtacgtacgtaccgtaccgggtacggtcgggacttacggttggttagttcggtttcgggttaccgggaacgggtaacggaactacggtccgtaaccggtaccgtaacggttcggaacccggaacgtacccggtacgtccggtcccccgg

SEQ ID NO: 110305 - DNA, 788 bp, Homo sapiens
  misc_feature: GYAE6OF02HNCV6.10.28.C06.1.454.CMB.1.raw
  modified_base (165)..(165): a, c, t, g, unknown or other
  misc_feature (165)..(165): n is a, c, g, or t
  modified_base (186)..(186): a, c, t, g, unknown or other
  misc_feature (186)..(186): n is a, c, g, or t
tcagcatagtagtgcacgaccggtgctcgatttagagctcacgtattgggtttggggagagctctggggagtctgcactatggcttggaccccactcctcttcctcaccctcctcctccactgcacagggtctctctcccagcttgtgctgactcaatcgccctntgcctctgcctccctgggacnccgtcggtcaagctcatctgctactctgacgcaggtcggacaacgacgacctaaaccgtaccgcccagtccgactagtggctatcgacgcagcacgccaaggacggaacgggcccgttacggtacttaggacgtagtaaacggttaacgagtagacgtcggacgacgaccgaacgtaaccgggaaacgggggtacggtacctccgtaggtacgtttcggtttacgacgggtctacgtcgtcggtgggtcgtagcgcgtacccttaccgacctaacctacgttcccgtaccgtaaccgtcccgtaaccgtcgtacgtacggaacggtacgttcgggaacgtcgtaaccgttaacgtttacgttaaccggttaccggttaaccggacccgggttaaccgggttaaccggggtacccgttacggtttaacggggtttacgggtttacgggggtttttccggggtttaccggggaacccgggggttaaaccggggtaccggttaaaaccgggttcccgggttaaccggttaccccgggttaacccggttacggtaacccgggtaacccggtaaccccgggtaaccggtcccgttaaccccccgggg

SEQ ID NO: 110306 - DNA, 772 bp, Homo sapiens
  misc_feature: GYAE6OF02F93IU.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctcgccctcccgtgggacgccgtcggtcaagctcatctgcactctgagcaggtcgggacacgagaccaacctacgccatccgacagtggcatacgagcagcacgccgagaacggaacgggtccctacggtacttaggagtaggaacggttaacgagtagagtggacacgaccaaccggaaccgggaacgggggacggtaccttccgtacggttacgtttccggttttacggacgggttccgaacggtccgtcgggtcggggtccgtacggacggtccgtacccgtacccgtacccgaacccgttcgttacccctaccgtaccgtccccgtaccgtacggttccgtaacgggtacgggtacgttacgggacgggtccttaacgggttaacctttaacggttaccgttacggtacccgtacgggttacccgggttacgggtaccgttacgggtttagggtttacggtttcgggggttttaccggggtttaccgggggaaccggggttaaccggggtaaccgtacgggttacccggttacgggtaccccggttacggtacggttacccgaccggtaccccggtacgggtccccgtacccccggg

SEQ ID NO: 110307 - DNA, 688 bp, Homo sapiens
  misc_feature: GYAE6OF02HQJPT.10.28.C06.1.454.CMB.1.raw
  modified_base (228)..(228): a, c, t, g, unknown or other
  misc_feature (228)..(228): n is a, c, g, or t
tcagcatagtagtgcacgaccggtgctcgatttagagctcacgtattgggtttggggaaaaagagctctggggagtctgcaccatggcttggaccccactcctcttcctcaccctcctcctccactgcacaggtctctctcccagcttgtgctgactcaatcgccctctgcctctgcctccctgggacgcctcggtcaagctcatctgcactctgagcaggtggcacngacaactacgccatcgcatggcatcacgcagcagccaaggacggaacgggtcccctaggttactgaacgtaggtaaacgttaacgagttagagtcgggcacgaccaacgaaccggaaggggaccggactccgtgtaacgttcggttttacgacgggtccagtccgtcggtggggtactcggacgtccgtacccttacctacgaccctaacgtcccgtaccaaccggtccctaacccgtagttccgtaggtaacggtagttacggacggtacctacggttaacttacgtttaacgtacgtaccgtaccggtaccggtcggggtacctacggtttacggtttacgttgggtttaccggggttttcgggaccggggtaacgggtacccgtaaggtaccccgtttggacccggttaccggtaggttcccgaaccggtacccggtaacggccccgttacccccgg

SEQ ID NO: 110308 - DNA, 625 bp, Homo sapiens
  misc_feature: GYAE6OF02GUIME.10.28.C06.1.454.CMB.1.raw
  modified_base (348)..(348): a, c, t, g, unknown or other
  misc_feature (348)..(348): n is a, c, g, or t
tcagcatagtagtgcacgaccggtgctcgatttagagctcacgtattgggtttggggggggtctcaggaggcggcactctcgggacgtctccaccatggtctgggctctgctcctcctcagcctcctcactcagggcacaggatcctgggctcagtctgcccctgactcagcctcgctcagtgtccgggtctcctgggcagtcagtcaccatctcctgcactggaaccagcagtgatggttggtggttatgactttgtctcctggtaccaacagcagccaggcgaacgccccaaattcatgatttatgatgtcagtgccgcggccgtcggggtccctgatcgctttcncgtggctccaagtctcggcaacgaccggcctccctgacccatctctcggccctccgacgtcccgagtaggagttcggaagtaccgttggtaatttaacgtttaccgtttacggtttcgtaccttctaacttaagttcgaccgtacggggtaccggttaacccgtcgggttttacggggttcgggtttacggggaccggggtacggggtaacccgtaacggtccggtacggtaccccggttaccggttaaccgggtacccgtacgacccgtaaccggg

SEQ ID NO: 110309 - DNA, 654 bp, Homo sapiens
  misc_feature: GYAE6OF02H5BGJ.10.28.C06.1.454.CMB.1.raw
  modified_base (312)..(312): a, c, t, g, unknown or other
  misc_feature (312)..(312): n is a, c, g, or t
  modified_base (348)..(348): a, c, t, g, unknown or other
  misc_feature (348)..(348): n is a, c, g, or t
tcagcatagtagtgcacgaccggtgctcgatttagagctcacgtattggggtttggggggggtctcaggaggcggccctctcgggacgtctccaccatggcctgggctctgctattcctcacccctcctcactcagggcacgagggtcctgggcccagtctgccctgactcagcctgcctccgtgtctgggtcctccgtggacagtccatcaccatctcctgcactcggacccacagttacattaggtaataatgaattatgtctcctggtaccaacacgtaccaggcaacgccccaaatgatagactttangatgtacagtaactccgacccttcgacggggtttcngtactcgtcttcgtttcgcccgtacctaagtctggacgaacgaccgtccctccctagaccctaactccgttcggtcggccttacccgatactggaacggacggaggcgtagtaattttactcgtcgactagtcctaacgaactaacgtacgaaggtccggcgtacggtcgggtttacgggtcgggtttacggggaccggggacctaccgtacgtcgtaccccggtcggttacggccgaccggtacccgaacggtcccgttcccggacccccgtggtccctaccggttcccgtcccggttacccccc

SEQ ID NO: 110310 - DNA, 666 bp, Homo sapiens
  misc_feature: GYAE6OF02FYQKU.10.28.C06.1.454.CMB.1.raw
  modified_base (187)..(187): a, c, t, g, unknown or other
  misc_feature (187)..(187): n is a, c, g, or t
tcagcatagtagtgcacgaccggtgctcgatttagagctcacgtattggggtttggggagagctctggggagtctgcaccatggcttggaccccactcctcttcctcaccctcctcctccactgcacagggtctctctcccagcttgtgctgactcaatcgccctctgcctctgcctccctgggacnccgtcggtcaagctcatctgcactctgagcaggtggcacagcaactacgccatcgcatggcatcagcacgacacgccgagacggaacgggcccgtacggttacttgaagttacggtaaacggttaacaggtagaacgtcgggacacggaccaacgaaccggaacgggggacggtactcccgtagtacgtttcggttttacgacgggtccagtccgtcggttgggctggacgtccgacctacctacactactcctaccgacgtccctaccgacgttcgaggacggtgtacggacggtctacgtaacttacgttactcggtacgacggtacccggtggggtacctaggtttcggttagttcggggttttacgggtttaccggggaccggggtaacggaaccgtaacggtcccgttacggtaacccggtttaccggacgggttaccaacccgggtacccggacgggtcccgttacccccggg

SEQ ID NO: 110311 - DNA, 591 bp, Homo sapiens
  misc_feature: GYAE6OF02FK3W7.10.28.C06.1.454.CMB.1.raw
  modified_base (315)..(315): a, c, t, g, unknown or other
  misc_feature (315)..(315): n is a, c, g, or t
tcagcatagtagtgcacgaccggtgctcgatttagagctcacgtattgggtttgggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggacccaccagttacattggtaaataatgaatatgtctcctggtaccaacagtacccaggcaaacgaccccccaaaactgaatgtaatttangatgtcaagtaactccgaccctcgaggggttttctgatcgctttcttgccctacaagtctggacaacgccggccctcctcgaccatcctcgtggcctccagtactggaaggacgaggactagtattagttactcgacagtcctacaacataacgaagccggacgaggtcggggttgggttcgggtccgggccgggggaccacgtacgtcgaccgtcgtacggacacgaccgacggccgtccgccccgtcggtaccaccgttcgtccgttacccccg

SEQ ID NO: 110312 - DNA, 662 bp, Homo sapiens
  misc_feature: GYAE6OF02HFJ1N.10.28.C06.1.454.CMB.1.raw
  modified_base (188)..(188): a, c, t, g, unknown or other
  misc_feature (188)..(188): n is a, c, g, or t
  modified_base (213)..(213): a, c, t, g, unknown or other
  misc_feature (213)..(213): n is a, c, g, or t
tcagcatagtagtgcacgaccggtgctcgatttagagctcacgtattgggtttggggagagctctggggagtctgcaccaatggcttggaccccactcctcttcctcaccctcctcctccactgcacagggtctctctcccagcttgtgctgactcaatcgccctctgcctctcgcctccctgggacncctcggtcaagctcatctgcactcngagcacgtgggcacgagcaaactacgccatccgcaagtggactactcagaccagcacgaccaaggaaggaaccgggtccctacggtacttaggataggtaaacggtttaacaggttagagtcggacgacgaccgacgtaaccggaaggggacggtactcccgtagtactttcggtttacgacgggtccagtcgtcggtcggggtctggacgtccgacctaccacctaccacgttaccaccgtaccggtaccctacgtacgtcgtacggacgtacgtacgggacgtcgtagacctttacgttacgtcgtaccgtacggtaccggttacgggaccgtacggtttaggttacgttcggttcggggttttacgggacggtaacgggacaaccgggttcgtaccggtaccgttccggtaacggtccgaccggaacccggtagtcccgtacccgg

SEQ ID NO: 110313 - DNA, 644 bp, Homo sapiens
  misc_feature: GYAE6OF02FXMMY.10.28.C06.1.454.CMB.1.raw
  modified_base (166)..(166): a, c, t, g, unknown or other
  misc_feature (166)..(166): n is a, c, g, or t
  modified_base (421)..(421): a, c, t, g, unknown or other
  misc_feature (421)..(421): n is a, c, g, or t
tcagcatagtagtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatcgccctntgcctctgcctcccgtgggagcctcggtcaagctcatctgcactctgagcagtgggcacagcaactacgccatcgcatggcatcagcagcagccaggagaacgggccctcggtacttgatcggaaggttaacagtgatggcagccacgaccgaagggggacggactcccgtgattcggttttacgacgggtcagtctcgtgggctggagtcgctacctccacgtactctccacgccctcgtacgtcgtggacggntacgggagtcgtagactttacgtacgttcgtacgtacggtacccggttacggggtacctacggtttgggttaacgtttcgggtttacggggtttttaccggggccggggtaaacgggggttaacccgtaacgggtacccgttaccggggtaaccccgtttccgggttaaccgggtacccgtaaccgggtacccccggtaacgggtcccggttaaccccccggg

SEQ ID NO: 110314 - DNA, 609 bp, Homo sapiens
  misc_feature: GYAE6OF02G3CPO.10.28.C06.1.454.CMB.1.raw
  modified_base (295)..(295): a, c, t, g, unknown or other
  misc_feature (295)..(295): n is a, c, g, or t
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
  modified_base (443)..(443): a, c, t, g, unknown or other
  misc_feature (443)..(443): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtcggtcaccatctcctgcactggacccagcactgatggttgggctattataaccttgtctcctggtatcaacaacgcccagacaaacgcccccanactcttgatttatgaagtcagtaagccggccctgaggggtttctagtcgcttctctcncctcaagtctggcaacncggcctccctgactaactcctacgtcgggcctccgaggctgacgacgagctagtaatattactgctagtctanatatagtagagtggtacgtccgtttctttacgttaacgggttttcggacgggtacgggtacccgtacgggtaccgtaccggtaccggtaaccgttaacggccgtaaccggacccggtaacggttcccgtccgtaccccccggttacggtccctacccttaccccgg

SEQ ID NO: 110315 - DNA, 714 bp, Homo sapiens
  misc_feature: GYAE6OF02G3X35.10.28.C06.1.454.CMB.1.raw
  modified_base (190)..(190): a, c, t, g, unknown or other
  misc_feature (190)..(190): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctcgccctcccgtgggacnccgtcggtacaagcctcatcgtcgctactctggacgcgtaggtcggacacgacgacctaaaccgtaccgccaagtccgaccagtcgggacaacgtcgaacgacgacgccgaacgaccgaaggaacgggaaccgggtccccgttacgggttaaccttaggtaacgtaggtaaaacggttaaacgaggttacgagtacggaccgacgacccaacgaaccggggaaagggggaccgtactccgtacgtacgtttcggtttacgaacgggtccaggtcgtcgggtcgggcgtacggacgaccgtacctaaccgtccgaactcgtccgtaccgacggtccctaacgtcggtaccgtaggaacggtgtacgggcggtacttaggtaacttactttacggtcgtacgaccggtacggttcgggacttagttaggttcgttgggtttcgggttcggacgggtaacggtaaccgcggtcgtaccgtaccgttaccggtagtcccgaacggtaccgacggttcccctccccggg

SEQ ID NO: 110316 - DNA, 827 bp, Homo sapiens
  misc_feature: GYAE6OF02I3XFZ.10.28.C06.1.454.CMB.1.raw
  modified_base (554)..(554): a, c, t, g, unknown or other
  misc_feature (554)..(554): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaactccgccctctcgtcctctcgtccctcccgtgggcgtccgtcggtacaacgtcctctactctcgcctacgtcgtggacgcgtaggtcgggaccacgtacgaccaaccgtaccgacctacgtccgactacgtcggactactacgacgaccacggacacgaccgaacggaacgggaaccgggcccgttacggttactaggagtacggtaaacggttacgaggtacgagtcggacacggaccgaaccgaacggggaacggggtaccggtaacctccggttacgttacggttttaccggtttacggaccgggtaccgtacggtccggttacgggtacgggtcggtacggaccggtcccgtacccttacggttaaccccaccgttaacgttccccggtaacncccggtaccctaccggtacgtcggtaacggagtacggtacggtaccggtcgttacgttaaacctttcggtttaaccgcggtaacccgggtacggttacccgggggtcgttaaccgtaacgggttttgggttttaacgggttcggggttttacggggtacccgggggacggttaacccggggaaccttacgggtcccggttaccggtaccccgggtttcgaaccggggttacccgacccggtaacccgggttacggtcccccggtttccccggg

SEQ ID NO: 110317 - DNA, 625 bp, Homo sapiens
  misc_feature: GYAE6OF02G25Q0.10.28.C06.1.454.CMB.1.raw
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
  modified_base (440)..(440): a, c, t, g, unknown or other
  misc_feature (440)..(440): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgccctccccgtgggacgcctcggtcaagctcatctgcactctgacgcagtggcacagcaactacgccatcgcatggcatcagcagcagaccaggacgaacgggccctacggtactgataggaagttacagtgagtggcacgccacgaccgaaggggacgactccgngtactttcgtttcgacggtcagtcgtcgngggtctggacgccgtacctacccgtcaaccctacttccgtaccacgccctaccgtacgtcgtaggaggtacncggaacggtctaacgtacttagttacgtcgtaccgtacggtacccggtgggtaccttacggtttggttacggttcgggtttcgggttttacccggggacgggtaaccgggtaccaaacgggtccgtaccggtaacccggttccgtacgggtaccacccggtacccgtaccgggtcctcccccggg

SEQ ID NO: 110318 - DNA, 727 bp, Homo sapiens
  misc_feature: GYAE6OF02G957N.10.28.C06.1.454.CMB.1.raw
  modified_base (565)..(565): a, c, t, g, unknown or other
  misc_feature (565)..(565): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctcgccctcccgtgggacgccgtcggtcaacgctcactctgcctacttctggacgccgaggtgggccacgacgacctaaaccgtaccgccatccgacagtcggacactcgacgacgacgacacgaccgaaggaacggaaccgggtcccttacggtacttagacgtaggtaacggtaacaggtgagtcggacgacgaccgacgaacgggaacggggaccggactccgtagtacgtttcggtttacgacggttccgacgtcgtacgggtcggggtcgtaggtacgtccgtaccgtaacccgtccgtaaccgtaccgtaccctaccgaaccgttccctacgtacgtacgttacggacggtacgtggacggtacttacgtaacgtttagttaccggtntaccggtaacggtaccggtacggggtaacttacggttacgggttagtttcgggtttacggggtttacgggcggggtaaccggtaccgtaacggtccggttaaccggtaccggttaccggtacgggtacctaccgggacccgttacgggtcccgtcccccggg

SEQ ID NO: 110319 - DNA, 761 bp, Homo sapiens
  misc_feature: GYAE6OF02JXLOI.10.28.C06.1.454.CMB.1.raw
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatcctcctgcactcggaccccacagttacattggtaaatatagaatatgtctcctacggtaaccaacacgtacccgaggaccaaacgacccccaaatgactgtatttatgtatgtacgagtaactccgtacccgtcgtagggtttcctgtactcgtactttccttcgtacccttaccaaggttcctcggaccaacggtacccggtccctcccgttacggaaccctacttacccgttacgtcgggtcccttaccggacgtacgtacggacgggtaacggtacgggtacgtacggtaactttaacttacgtcgtacgtacgtaccaccctaacgtaacgtaacgaaccggacggtaccggtacgggttaccggggtttaggggtccggggtttaccggggggacccggggtaacccgacgggttacggtacccggtacccggttacccggtaacgggtccgtaaccgggtaaccccggtaaccggtcccgttacccggttcccccggtaccggttaccgtaccccgtttacccggttcccggttaccccccgg

SEQ ID NO: 110320 - DNA, 688 bp, Homo sapiens
  misc_feature: GYAE6OF02IUVWZ.10.28.C06.1.454.CMB.1.raw
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
  modified_base (269)..(269): a, c, t, g, unknown or other
  misc_feature (269)..(269): n is a, c, g, or t
  modified_base (470)..(470): a, c, t, g, unknown or other
  misc_feature (470)..(470): n is a, c, g, or t
  modified_base (486)..(486): a, c, t, g, unknown or other
  misc_feature (486)..(486): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctcgcctctcgccctcccgtgggacnccgtcggtcaacgctcatctgcnctctgagctaggtcggacacgagacaaacgtcgccatccgcagtcggacatccgngcacgcagccaggtacgaacggtcccgtacgtactgaataggaaggttacaggtcgagtcggacacgtaccgaacgaaccgggaaggggtaccgtacgtccgtagttacgtttccggtttacgacggtacctaggtccgtggtacgggtctcggtacgcgtccctaccgcgtaacctcttcccgacgaccgtcccgtacgngtacgtacggacgtancgggtacgtcgtactaacgtttactaccgtacgtacgtacccggtacgggttaccggtcgtcggtttacgggttacggtttcggggtttacggggttcgggaaccggggtaaccggtaacggttccggtaccggttaccggtacccgtacgggtttacggacccgtaccggtaacccggttccgggtaccccggttccccgg

SEQ ID NO: 110321 - DNA, 697 bp, Homo sapiens
  misc_feature: GYAE6OF02FQ7ZG.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgccctcccgtgggacgcctcggtcaagctcatctgccactctgagcaggtcgggcacagaccaaaccgtaccgccagtcgcagtggctactcagcagcagcgaggacggaacgggcccgttacggtacttaggagtaggtaacggttaacgagtagagtcggacgacgaccaacggaacggaacggggacggactccgtagtacgtttcggtttcgacggtcacgtcgtcggtgggtcgtacggacgtccgtacctaccgtaccgaacctacgtccctccgtaaccgtcccgttaccgtcggttacgacggtacggacgtcggacggtctacgactttagttacgttcgtacgacggtaccggtacggggtaccttacggttacggtttagttccggggttttacggggtttacccgggacggggtaaccgggtaaccgtaacgggttcccggtaaccgggttacccgttaccgggttaacggttaccggaccggtaaccccggtacgggtcccgttacccccgg

SEQ ID NO: 110322 - DNA, 1097 bp, Homo sapiens
  misc_feature: GYAE6OF02IPREV.10.28.C06.1.454.CMB.1.raw
  modified_base (369)..(369): a, c, t, g, unknown or other
  misc_feature (369)..(369): n is a, c, g, or t
tcagcatagtagtgcacgaccggtgctcgatttagagctcacgtattgggtttgggggggggtctcaggaggcagcgctctcaggacgtcaccaccatggcctgggcctctgcctccctcctaccctaccctcctacactacggacgggaccaacggtacgggtccgtccgggaccctacgttctccgcccgtacgacctaccgaccgtccccttccccgtcccggtcccgggttcccgggttccttccggtacggaacgtacgtacgtacgtaccaacctaccttcctccgtacgacctacggtaaccggaaaccacgtacgtacggttacgttacgttttggttacgttactttaaacttaacgttnttccgttacccgttaccggttaaccggtaacctaaccgaccccaaacccccgaaaccggaacggaaaaccccaaaacccccgtaacccccctttaaacgtttttcccggttttttggtttaacgggtaacggtaaccgtaaaagggtaccgggcccccggttacctagggtaaacgggttccccttaccgtcggtacgtttccgttctcctccgtaccctaaacgtacgttcgaacgtaaccacccgggtacccgttcccgttaccccggtacggttacccgttccgttacccggggtaccggttccccgttacccggtaaccgggtacgttacgggggaaactacgggttacgggtaccgtacggttaacttaaaccgttttaacccgttacgacccgtaacggtacccggtaccgtttaacttaaaccgtttaccgttaaaccccgggaaccccggtaaacccggttaaacgggggttttacgggggtttccgggggtttaacccgggggaaccgggggttaacgggttaaaacccgggtttaaaccgggtccccggggttaacccggggtttccgggtaaccgggtaccccggtaaacccggtaaccccggggtacccggttacccccggttcccccgggttaccccgggttaacccgttttcccgtacccccggtttccccggggtttcccccctttaccccccggtcccccttttaacccccg

SEQ ID NO: 110323 - DNA, 714 bp, Homo sapiens
  misc_feature: GYAE6OF02GTLFP.10.28.C06.1.454.CMB.1.raw
  modified_base (255)..(255): a, c, t, g, unknown or other
  misc_feature (255)..(255): n is a, c, g, or t
  modified_base (313)..(313): a, c, t, g, unknown or other
  misc_feature (313)..(313): n is a, c, g, or t
tcagcatagtagtgcacgaccggtgctcgatttagagctcacgtattgggtttgggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatcctctgcactcggacccacagttacattaggtaataatgaatntcgtctcctggtaaccaacacgtacccaggacaaacgacccccaaatgatgtatttangtatgtctaagtaactccgacctgtacgggtttctgactccgtctttcgtttccgtcctaccgtaagttccgtacggaccaaccgaccgtccctcccgtacgaacctcttccgtcggtcgggccctccgaacgtaccgtagggaacgggacggtagggtacttaggttaactttacgttacgtcgacgtacgtacctacactaactaacgacgggaccggtacgtaggggttccggggtttcggggtcgggttaccgggggaccggggtaaccctacggaccggttccggtaacccggtccggtaacggtcccggaaccggtacccggtaacggtcccggttacccggttcccccggttacggtacccctttaccggtcccgtttccccggttcccccccg

SEQ ID NO: 110324 - DNA, 579 bp, Homo sapiens
  misc_feature: GYAE6OF02I79XV.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctgccctcccgtgggacgcctcggtcaagctcatctgcactctgagcagtgggcacagcaactacgccatcgcatggcatcagcagcagccagagaacgggccctcggtacttgagtaggaaggttaacagtagatggcacgccaacgaaccggaagggggacggactcccgtgtacgttcgttttacgaggtccagctcggtgggctggacgcgtactacctcacctatcctacacgtcctaccgtagtcgtagacgtagtcgacgtctacgtaacttacgttaccgtgtacgtacgaccgtgggactacgttaggttacgttggttacgggtttcggacgggtacggtaaccgacgtcgtacgtaccgtacgtacggtccacggtcccgtacggtccgtaccccgg

SEQ ID NO: 110325 - DNA, 606 bp, Homo sapiens
  misc_feature: GYAE6OF02I8OPM.10.28.C06.1.454.CMB.1.raw
  modified_base (308)..(308): a, c, t, g, unknown or other
  misc_feature (308)..(308): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatggaagttaacagtcgatggcagccanaccgaaggggacggatccctgactcgttttacaggtccagctcgtgggctgagcgctaccgtcaccatctaccagtccctaccgagtccgtaggaggtacgtggacggtctacggtaacttacgttaaccgtagtaccgacggttacccgtaggggggtcctaaacgttacgggtttaacgttcgggtttacgggttttccgggtaccggggaagggtaacccgtaaaggtccgttaacggtaccccggttaccgtaacgggtccaaccggtaccccgtaagggcccttacccccggg

SEQ ID NO: 110326 - DNA, 713 bp, Homo sapiens
  misc_feature: GYAE6OF02I4QZV.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggacgccgtcggtacaagctcatctgcactctgagcagtgggcacgagacaaactaccgccatcgacatcggcatcagacagacacgaccgaaggacggaacgggccccgtcggttaacgttagaagtaggtaaaaggttaacgaaggtagagtggacaacgaccgaaccgaaccgggaaaggggaccggaactcccgtagtacgtttcgttttacggacgggtaccgacgtccgtacggtgggacgtcggacggtccggtacctacccgtaccaaccgtaccttaccgtaccgacgtccctaccgtacgttccgaggtacggagtacggtacgtccgtaagttacgttaaccttaacgttacggttaccgtaacgggtaccggtaccgggggtacctaacgggtttaagggtttacggtttacggtttacggggtttccggggacgggtaacgggtaccgaacggtacggttaccggtaccggttaccggtacggtaccgacccggtaccggaccggtcccggtaccccgg

SEQ ID NO: 110327 - DNA, 619 bp, Homo sapiens
  misc_feature: GYAE6OF02FWVPW.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtggcacagcaactacgccatcgcatggcatcagcagcagccagagaacggccctcggtacttgatagaaggttaacagtgatggcagccacgacgaaggggcggactccgtgtagttcgtttcgaggtccagtcgtcgtgggctggacgcgacctacctcacctactcctccacgtccctccgagtcgtaggaggtagtggaacgtctacgtacgttacgttacgtcgtaccgtaacggtaccggtaggggtacctacggttacgggtttacgttcgggtttcgggttttaccggggacggggtaacgggtaacccgtaagggttacccgttacggttaaccccggttacccggttaacgggtacccgtaacgggaccccgtaacgggtcccgttaccccggg

SEQ ID NO: 110328 - DNA, 844 bp, Homo sapiens
  misc_feature: GYAE6OF02G04EP.10.28.C06.1.454.CMB.1.raw
  modified_base (230)..(230): a, c, t, g, unknown or other
  misc_feature (230)..(230): n is a, c, g, or t
  modified_base (275)..(275): a, c, t, g, unknown or other
  misc_feature (275)..(275): n is a, c, g, or t
tcagcatagtagtgcacgaccggtgctcgatttagagctcacgtattgggtttggggggggtcgtcgaggaggcggccctctcgggacgtctccaccatggcctgggctctgctattcctcaccctcctcactcagggcacagggtcctgggcccaggtctgccctgactcagcccttcctccgtgtctgggtctcctggacagtccatcacatctctgcactggacccnccagttacatttggtaaatatagaatatgtcttcctggtaccaanacgtaccaggacaaacgccccaaactagactagtaactttatagtatgtactaacgtataccgtaccctacggttagggtttccgtagtacgtcggtctttctttcggtccctacaaagtttccgttacggaaccacgaaccgggtcccctacccgtacggaaccttaacctcgtttccgtacggggtcctacccgtaaggtaccgttagaacgggtaacggagggtccgtagttaaacgtttacggtttaaacctttacggcgttaacggtacccttaacgtaaccttaaaacgttaaccggaaaccgggtaaccgggtaaccgttaaccgggggttaccgggttttacggggggggttaaccgggtttccgggggggaacccgggggggtaaccccggtaacgtaccgggtttaacccggggtacccggtttacccggtaacccgggtttcggtaaccggaaccccgggtaaacggtccccggtaacccccgggttccccccccgggtacgggttaccccttaaccgggtttaccctttcccggttacccccccgtttaaccccccg

SEQ ID NO: 110329 - DNA, 642 bp, Homo sapiens
  misc_feature: GYAE6OF02HYL56.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcaccagggtctctctcccagcttgtgctgactcaatcgccctctgcctctgcctcccgtgggacgcctcggtcaagctcatctgcactctgagcaggtgggcacagcaactacgccatcgcagtggcactcagcagcacggaccaggaacggaacgggtccctacgggttacttaggagtaggtaaggttaacagtcggaagtcggacacgccgaacgaaccggtaaacgggggacggtactacccgtaggtaacgtttccgtttttacggaacgggttaccagtccgttcggtacggggcttcggacgtcgtaccctccaccacctactcctaccgctaccctccgaagttctggaacgtatacggacggtactacgtaacttactacgtcgtacacggtaccggtgtaccgtacgttggtttagtcggttttagggttacgggcggaacgggtaaccgtagtacctaccggtaccgttcggttacggtacctacggtaccgtacggtacctccccgg

SEQ ID NO: 110330 - DNA, 645 bp, Homo sapiens
  misc_feature: GYAE6OF02FTBUA.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcaggtggcacgagcaaccgtacgccatccgcatggacatcagcagcagccagagacgggccctcggtactgatagaaggttaacagtagagtcggcacgaccacgaccggaaggggaccggtatcccgtagtagtttcgtttacgacggtccgacgtcgtccggtagggtcgtacggacggcggtaccctacccgtccgtaaccgtacctccctaccgtacccgtcccgtacccgtacgtcggttacgacggtacgtcgacggtcgtaagtacttacgttacgttcgtacgtacggtaccggttgggacctacggttaggttagttcggttacgggttccgggacggggtaacggacgtaacggtcggttaccggtaccggttaccggtacggtacccgaccgggaacccggtaccggtccgtacccccggg

SEQ ID NO: 110331 - DNA, 761 bp, Homo sapiens
  misc_feature: GYAE6OF02JBONO.10.28.C06.1.454.CMB.1.raw
  modified_base (367)..(367): a, c, t, g, unknown or other
  misc_feature (367)..(367): n is a, c, g, or t
tcagcatagtagtgcacgaccggtgctcgatttagagctcacgtattggggtttgggggggggtctcaggaggcggccctctcgggacgtctccaccatggcctgggctctgctattcctcaccctcctcactcagggcacagggtcctgggcccagtctgccctgactcagcctccctccgcgtccgggtctcctggacagtcagtccaccatcctcctgcactacggaaccagcagtgtactttgttgtcttaataactatgtctcctgtaaccaacacgtacccaaggtaaaccgcccccaaatgatgtatttatgtatgtcaagtactccgaccctgtagggtttctgactcgtctttcttcncctacctagtctcggacaaccgacccggtccctccctacgacctacttccgtacggtcgggtcctaccgtacgtacggtaggaacgggtacggacggtacttaggtaatttacgttaccgtacgaccgtacgtccgtaccaacgtaacgtaaccggaaccggaccgggtacggtaccgggttcgggggtttcgggggttccggggttaccgggggggacccgggggttaacccaaccggttaccgttaccgggtaaccccggttaccggtaccgggtaccggaacccggtaaccccggtaacggtccccgtaccccgttccccccggttaccgggtacccgttacccgtttaccccggttaccccgttaccccccgtaccccccttacccccgg

SEQ ID NO: 110332 - DNA, 634 bp, Homo sapiens
  misc_feature: GYAE6OF02GDJGG.10.28.C06.1.454.CMB.1.raw
  modified_base (165)..(165): a, c, t, g, unknown or other
  misc_feature (165)..(165): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctntgcctctgcctcccgtgggacgccgtcggtacaagctcatctgcactctgagcaggtggcacgagacaactacgccatcgcagtggcatcgagcagcagccgagacggaacgggtcctacggtacttgagtaggaaacggttaacaggtagagtggacacgaccgacgaaccggaacggggacggactccgtgtacgtttcgttttacgacggtcgagtcgtcggtcgggctggacggacgtccgtaccgtacaaccgtctaccgtaccgacgtcccttacgtacggttccgtaggtaaggtcggtaggtacggtcttacgaacgtttacgttacgtcgtacgtacggtaccggtgggtacctacggttggttagttacgggtttcgggttacgggacgggtacggaaccgtaggtccgtaccggtaccggttcgtacggtaccgacgtacccgtaggtccgtccccgg

SEQ ID NO: 110333 - DNA, 712 bp, Homo sapiens
  misc_feature: GYAE6OF02IIHO2.10.28.C06.1.454.CMB.1.raw
  modified_base (192)..(192): a, c, t, g, unknown or other
  misc_feature (192)..(192): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacaggtctctctcccagcttgtgctgactcaactcgccctctcgccttctgcccttcccgtggggacnccgtcggtacaacgctcatcgtgacactcgtgagcaggtgggacacgagcaaacctccgcatccgcagtcggacatcacgcacgtacacgccgaaggaacgggaaccgggtcccgttacggttaacgttacggtaagtaacggtaaacggttaacgaggtacgtaggtcggacacggacccaacggaccgggaacgggggaccggacttccgtacgtacgtttcggtttacggacgggttcctacggtcggtcggtacggggcgtacggacgccgtactacccgtccaaccttcgtcctacaccgtcctacccgtagtaccggttgaacgggttagcgtacggtcctacggtacttagttaccttcggtaaccggtacggtcccgggttagggacttacgggtggtttaccgttgggtttacgggttccgggacgggtaacggtaaccgacggttccggtaggtaccccggtttcgaaccggtaccgacggtacccggtaccggtcccgttacccccggg

SEQ ID NO: 110334 - DNA, 692 bp, Homo sapiens
  misc_feature: GYAE6OF02F2NKT.10.28.C06.1.454.CMB.1.raw
  modified_base (192)..(192): a, c, t, g, unknown or other
  misc_feature (192)..(192): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctcgcctctcgcccttcccgtgggacncctcggtcaagctcatctgcactctgagcaggtcgggcacagcaaacgtacgccatccgcagtcggacatcagcagcgacgccgagacggaacgggcccgtacggtacttgagtaggaacggttaacaggtagagtgggacacggaccaacgaaccggaaggggaccggtactccgtagtacgtttcgtttacgacggtccagtcgttcggtacggggctcggacgtacccggtcctacccgtcaacccgtcttacccgttcccgaccgtaccccttacccggtagttccgttacgggaacggtcgttacgggacgtccgtacgtaacgttaacgttcgtacggtcgtaacggacggttcgggaacctcgggtttaggttcgtttcggggtttacggtttaccggggacggtaaccgggtaaccgaacggtccgttacggtacccggttaccggtacggtacccggacggtaacccccggtacgggtcccttaccccggg

SEQ ID NO: 110335 - DNA, 719 bp, Homo sapiens
  misc_feature: GYAE6OF02HEBF0.10.28.C06.1.454.CMB.1.raw
tcagcatagtagtgcacgaccggtgctcgatttagagctcacgtattggggtttggggagagctctggggagtctgcaccatggcttggaccccactcctcttcctcaccctcctcctccactgcacaggtctctctcccagcttgtgctgactcaatcgccctctgcctctgccctccgtggagcctcggtcaagctcatctgcactctgagcagtcgggcacgagacaactcgccatcgcatggcatcagcacgcacgccgaaggaacggaacgggtccccgtacggttaacgttggaacgttaggtaaaggttaaccgaggtagaagtggacgtacgaccaacgaaccggaaaggggaccggtaacgtcccgtaggtacgtttccggttttacgacgggttacccgtagtccgtcggttacggggtcctagggaccgtccggtaccctaaccgttacccgaacccgtactacccgttacccgaccgtccccgttaccgacgttcgtacggaacgggtacgtacgggtaacgtccgtacgtaacttacgttaccgtacggtaaccgtacggtaccggtacgggtccgtacgttagggtttacgttagggtttcggggtttaccggggtaccgggtaacgggacccgttaaggtccgttaccggacccgttacccgtaggttacccgaccggacccggtacgtcccggttacccccgg

SEQ ID NO: 110336 - DNA, 882 bp, Homo sapiens
  misc_feature: GYAE6OF02FFDPO.10.28.C06.1.454.CMB.1.raw
tcagcatagtagtgcacgaccggtgctcgatttagagctcacgtattgggtttggggagagctctgggagtctgcaccatggcttggaccccactcctctcctcaccctcctcctcactgcacagggtctctctcccagcttgtgctgactcaactccgccctctcgcctctcgccctccgtgggactccgtcggtcaacgctcatcctgcctctcgtgacgtcgtacggtcggcacgtacgacctaaaccgtcgaccctagtccgagtacgtcggactacgtaccgaacgccgaacgccgaaccggtaccgaacggaaccgggtacccgggtccccgtttaacggttaacgtttacggaagttaacgggtaaaacggttttaaaccgacggttacggtaacgttaccgggtaccgaacccgtaacccggaaaccggggaaaccggggtaaccgggggtacccgtaccggtttccgttacggttttaccggtttaccggttttaaccgggaccggttaccgtaacggttcccgtcggggtttaccggggaccttacgggaacccgtacccgtacccttaaccgtccccaaaccggtttcccttaccccgagtaccccgttccgaccgtagtaccggtaggaacggttacgcggtaacgttaccgttaacgttacgtttaacggtccgttacgaccgggttacggttaccgggtacgtacttacggggtttttgtaccgggtttgggggtttaccgggaaccgggtaccggggtaacggacccggttaaggttacccccgggttacggtaaccccggttacccggggttacgaaacccggtcccggttaacccggggtacccgttccccggttaacccccggg

SEQ ID NO: 110337 - DNA, 760 bp, Homo sapiens
  misc_feature: GYAE6OF02HU3W1.10.28.C06.1.454.CMB.1.raw
  modified_base (495)..(495): a, c, t, g, unknown or other
  misc_feature (495)..(495): n is a, c, g, or t
tcagcatagtagtgcacgaccggtgctcgatttagagctcacgtattggggtttgggggagagctctggggagtctgcaccatggcttgaccccactcctcttcctcaccctcctcctccactgcacagggtctctctcccagcttgtgctgactcaactccgccctctcgcctctcgtccctcccgtggggactccgtcggtacaagcctacactcgtgcctactcgtagagacgacggtggacacgagacaactaccgaccaactcgacagtacgacacgtacacggacacgaccgaacgaccgtaaggaacggtaacccggggtacccctttaggttaacgtaggtaaagttaacggtaaaacggttaacgaggttacgacgttacggaccacggaacccgaacggaaaccggggaacggggacgtaccttaccgtaggttacgttttacggttacgacggtctacgtcggttcgggtaggacgtacggacncggtaccctacaccacgtaccttccgtaccgtccgtacctccgtaacgtcgtaggtacgacgttaggacgtcttaacgtcttaacgtacgtacgaccgtggtaaccgggtacgggttactaacggttagggttagttccggggtttacggggtttaccgggaacggggtaacggttaaacccgagggttacccggtaaccggttaccccggttacggtaacggtacccgggtaccgaaccccgggtacgccccggttaccccggg

SEQ ID NO: 110338 - DNA, 823 bp, Homo sapiens
  misc_feature: GYAE6OF02G76PE.10.28.C06.1.454.CMB.1.raw
  modified_base (232)..(232): a, c, t, g, unknown or other
  misc_feature (232)..(232): n is a, c, g, or t
tcagcatagtagtgcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgccctgactcagccctccctccgccggtccgggtctccgtggacagtcagtcaccatcctctgcactggaaccngcagtgtacttttgtcgactttaatactatcgttctccgtcggtacctagccacccacccgacggaccaaaccgaccccctaaaactttccgttttaggtttttacggagggttacaacggtaacgccgggtacccctcgtacgggtaccgtccccgtaggtacgttccggtttcctcgttccgtccctaccgtaaggtccgtcggaacctaaccgacccggtccctaccccgtcggtacccgttccgttacggtcgggtccctacccgagggtcgttacggaaggtcggtacgggtacggtcgttaacgtaacgtttaccgtaacgttcgaccgttacggaccgttactaacgttacgtacccgaaccgggtaacccccgtaagggtaccgggggtttggtttaccggggaccggggttacccggggtaacggtaacgggttacccgggtaccggtttacccgggtacgggttaccgaacccgggtacccggtaacggggtccccgttcccccgggttacccccggttacgggttaccccgttaccggtttaccccgtttaccccggttccccctacccccgttaccccg

SEQ ID NO: 110339 - DNA, 868 bp, Homo sapiens
  misc_feature: GYAE6OF02H69VA.10.28.C06.1.454.CMB.1.raw
tcagcatagtagtgcacgaccggtgctcgatttagagctcacgtattgggtttgggagagctctggggagtctgcaccatggcttggaccccactccctcttccctcaccctcctcctccactgcacagggtctctctcccagcttgtgctgactcaactccgccctctcgcctctcgccctcccgtgggacgccgtcggtacaacgtctcactctcgacctactcgtgaagcgaggtcggaccaacgacgacctaactaccggactacgtccgaccgagtcggacacgtacgacgacgacgccgaacggaccgaacggaacgggtaacccgggtcccgttaccggttaacgttacggaaggttaacggtaaacggttaacgaggttagacggtcggaccgacgaccgaaccggtaaccggggaacgggaccggtaccgttccgtacgttaccgtttacggttttacggaacgggtccgtacgttaccggtcgggttacgggcgtcgggaccgtaccgttacccctacccgtacccgtaccgtccgtaccgtacccgaacccgtcccgtaccggtacgttaccgggttaacggacggttcgtaccgggtcgtaccggtacgttaacgttttaacgtaccggttaccgtaccggtaccgggtaaccgggttcgggtaaccgtttagggtttaaccggttttacggggtttccggggttttaccggggtttaacccgggggtaccgggggtaaacggttaacccggttaacgggtaccccggttaacccggttacccgggttaccggtacccggtaacccgggttaaccccgggtaccgttaccccggggtcccccggttaccccccggg

SEQ ID NO: 110340 - DNA, 676 bp, Homo sapiens
  misc_feature: GYAE6OF02JCWQO.10.28.C06.1.454.CMB.1.raw
  modified_base (167)..(167): a, c, t, g, unknown or other
  misc_feature (167)..(167): n is a, c, g, or t
tcagcatagtagtgcacgaccggtgctcgatttagagctcacgtattgggtttggggagagctctggggagtctgcaccatggcttggaccccactcctcgttcctcaccctcctcctccactgcacagggtctctctcccagcttgtgctgactcaatccgccctntgcctctgccctcccgtgggagcctcggtcaagcctcatcctgcactctgagcaggtgggcaacgagaccaaactaccgccatcgcagtggctatcagtcacgcacgaccgagagaacggccctggtacgttgagtagaaggttaactagtcgagtcggacagaccacgaaccggaacggggacggtactcccgtacgtacgttccggttttacgacgggtccaaggcgttacggtggggtctacgggacgtccgtactacccgtacaacccgtagttcccgtaccgtacgtacccttcccgtacgttaccggtacgggtaacggtagttaccggaacgggtcctacggtaaccttacgttaccgtacgtaaccgtaccggtaccggtcgggtaccgtacggttcgggtttaacgttcgggttacgggttcgggacgggtacggaccgtacggtaccgtccggtacgtccgtacggtcctaaccggacccggtacggtcccgtccccgg

SEQ ID NO: 110341 - DNA, 723 bp, Homo sapiens
  misc_feature: GYAE6OF02IXXO7.10.28.C06.1.454.CMB.1.raw
  modified_base (188)..(188): a, c, t, g, unknown or other
  misc_feature (188)..(188): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctgcctcccgtgggacncctcggtcaagctcatctgcactctgacgcagtcgggcacagcaactcgacctatcgcatcggctatcagcacgcgaacgccgaagacggaaccgggccccgttacggtacttggtaagtacggtaaaacggtttaaccgagggttgaacgttcgggaccgacgaccccgaacggaacccgggaaaggggggaccgggtaaccgtcccggttagtacggttttcggttttacggacgggttaccgacgtccgtcgggtgggctggacgcccgtaccgtaccctcgaacccgtacttcccgtaccgacctcccgttccgacgttaccgttaggacggtagtcggacggtctacgtaacgttagtttaccgtggtaccgtacggtaccggtggggtacctacggtttacgggttaagttcgggtttcgggtttccgggaaccggggtaacggtaacccggtagtcccggttacggtaacccggttaccggttaacggtacccgtaaccggcccgtaccgggtcccttaacccccggg

SEQ ID NO: 110342 - DNA, 801 bp, Homo sapiens
  misc_feature: GYAE6OF02JJLU9.10.28.C06.1.454.CMB.1.raw
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatccaccatcctcctgcactcggacccaccagttacagttggtaaataatgaatatgtctcctaggtaccaacacgtaacccaggacaaaccgacccccaaatgatagtactttatgattgtacagtaactccgaaccctcggtaggggtttctgactcgtcctttcgtttcgcctccgtaagtctacgggactaaccaccggtcccctaccctcggaacccctacgttacccgttcccggttacggggtaccctacccgaacggtaccggtagggtacgggaaacgggtcgggaccgttagtaagtttaaccgtttacggttacgcgtaacgtcctaccctaacgaaccgttaacgaacgggtacccggtaccggtacggggttaccggggttttacgggggtttaccggggttacccgggggggtacccgggggggtaaccctaaccggttacccgttaccgggtaaccccgggttacccgggttaaccgggtaaccgttaacccggaaccccggtaccgggtaccccggtcccgggtacccccccggttccgggtaccctacccggtttccccgtttccccggttaacccccccg

SEQ ID NO: 110343 - DNA, 637 bp, Homo sapiens
  misc_feature: GYAE6OF02HM202.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctcccgtgggagcctcggtcaagctcatctgcactctgagcagtgggcacagacaactacgccatcgcatggcatcagcagcagccaggagacgggccctcgtactgatggaagttaacaggtagagtggcacgccaacgaaccggaacggggacggactcccgtagtacgtttcgtttacgacgggtcaagtctcggtcgggctggacgcgtacctacctcaccctatcctaccgacgtccctacgtagtctagggacggtactacgggacgtctacggaacttagttaccgtcggtaccgaccggtaccggtcggggaaccttacgttacggggtttacgttggggttttcggggtttacgggaccggggtaagggtaacccgtaaggttccggtaccggtacccggttacggttaacgggtaccgaaccgggtacccggtaacggtcccgttaccccggg

SEQ ID NO: 110344 - DNA, 795 bp, Homo sapiens
  misc_feature: GYAE6OF02GI6KF.10.28.C06.1.454.CMB.1.raw
  modified_base (166)..(166): a, c, t, g, unknown or other
  misc_feature (166)..(166): n is a, c, g, or t
  modified_base (271)..(271): a, c, t, g, unknown or other
  misc_feature (271)..(271): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctntcgcctctcgcccttcccgtgggacgccctcggtacaagctcatctgccactcgtagacgcgaggtcgggcacgacgccaacctacgccagtcgcagtcgactanaccgagcgacgcacgaccgaaggaacggaacgggtccccttacggtacttaggagttaggtaaaggttaacgaggtagagtcggacaacgacccaacgggaaccgggaacgggggtacgtacgtcccgtaggttacgttttccggtttacggacgggttccgtaaggtccgttcgggtcggggtactacgggtacggcccgttacctacccggttaccaccgttaccttcccgtacccgaccgttaccccttaccggtacggttacggtaacgggaacgggttacgttacggaccggttaccgttacggttaaaccgtttacgtttacgttcggtaccgtacgggttacccggttaggggtaaccttacgggttttacgggtttaccggttttcggggtttaccggggttaccggggaacggggttaacccgggaaccgtacgggttaccgttacccgggtacccggttaccggtacgggttacccgaacccggtaccggtacccggttccggtaaccccccgg

SEQ ID NO: 110345 - DNA, 729 bp, Homo sapiens
  misc_feature: GYAE6OF02I97Y3.10.28.C06.1.454.CMB.1.raw
  modified_base (191)..(191): a, c, t, g, unknown or other
  misc_feature (191)..(191): n is a, c, g, or t
tcagcatagtagtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatccgccctctgcctctcgccctcccgtgggacnccgtcggtacaagctcatctgcactcgtgacgcaggtcgggcacacgcaaaccgtcgccatcgcagtggcactcagacacgcgaacgcccgaaaggaacgggaaccggggtccccgttaccggttacgtttaggaacgtagggtaaacggttaaccgaggttagacgttaggaccgaccggacccgacggaaccgggtaacgggggggaaccggtacgttaccggttacggtactttttaccgggtttttcgaaccggggttacctacgggtccgtcgggttcggggtacgttacggcccggtacgttacccgtacccgtaccgaaccccgtacgttccccgtaccgtacccggtaccttacccggtacgttacgtacgggtacgtacgttacggacggttagtaccgttaacgttactttacgtcgcgtaacggcggtacggtactcggttagttagttcggtttcgggttcggacggtaacgggctacgtcgtcgtaccgtcgtacggtacgaccgccggtacgtccgtaccccgg

SEQ ID NO: 110346 - DNA, 617 bp, Homo sapiens
  misc_feature: GYAE6OF02FZJWZ.10.28.C06.1.454.CMB.1.raw
  modified_base (165)..(165): a, c, t, g, unknown or other
  misc_feature (165)..(165): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctntgcctctgccctcccgtgggacgcctcggtcaagctcatctgcactctgagcaggtgggcacagacaactacgccatcgcagtggcatcagcagcacgccgagaggaacggccctcggtactcgagtaggaaggttaacgagtagagtggacacgaccaacgaaccggaaggggacggactccgtagtacgttcgtttacgacggtcagtcgtcggtgggtctaggacgtccgtcctacctcacctactcctaccgacgtccctaccgagtcgtggagtacgtagacgtctacgtacttataccgtagaccgtacggtacggtcgggtacttaggttcggttacggttggtttcgggttaccgggacggtaacgggtaacctaacgggtccgttaacggtacccgtacggtacggtacccgaccggtacccggtaccggtcccttaccccgg

SEQ ID NO: 110347 - DNA, 750 bp, Homo sapiens
  misc_feature: GYAE6OF02IDCNG.10.28.C06.1.454.CMB.1.raw
  modified_base (193)..(193): a, c, t, g, unknown or other
  misc_feature (193)..(193): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagtcttgtgctgactcaatccgccctctcgcctctcgccctcccgtggggacnccgtcggtacaacgctcatctgccactcgtgacgctagggtcggacacgaacgaccgaaccgtaccgcctactccgacctagtcggactactacgacggaccgaagccacgaccgaaacggaagggtaacccgggtcccgttaccgggttaacgttaggaagtaaggtaaacggttaacacggttagaagtcggaccacgaccgaacggaaccgggaaacggggccggtactacccggtacggttactttacggtttacggacggtaccgacgtcgttacgggtcggcgtacggaccgacgtaccgtaccctaccgtaaccgtactacccgtaccgaccgtacccgtacgttacgtacgtaacgggtagacgtacgggtaacgcgtaacgtaacgtttacttacgtactacggtaccggtacgggtacgggtacttacggtaggtttacgttagggttcggttttacggggacgggtaaccggacgtaacggtccgttaccggtaaccggtccggtaacgggtccgtaccggaacccggtagggtaccctaccccgg

SEQ ID NO: 110348 - DNA, 723 bp, Homo sapiens
  misc_feature: GYAE6OF02FNACU.10.28.C06.1.454.CMB.1.raw
  modified_base (491)..(491): a, c, t, g, unknown or other
  misc_feature (491)..(491): n is a, c, g, or t
  modified_base (577)..(577): a, c, t, g, unknown or other
  misc_feature (577)..(577): n is a, c, g, or t
  modified_base (692)..(692): a, c, t, g, unknown or other
  misc_feature (692)..(692): n is a, c, g, or t
  modified_base (709)..(709): a, c, t, g, unknown or other
  misc_feature (709)..(709): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacaggtctctctcccagcttgtgctgactcaactccgccctctcgcctctcgcctccgtgggacgccgtcggtcaagtctcacttcgtgcctactcgtgacgtcgtaggtcgggacaacgacgacctaaaccgtaccgtaccacgtccgacgtacgtacggactacgaccgaacgacgacgaccgaacggtacccgaacgggaaccgggtacccgggtacccgttacggttacgttaacggtaagtaacggtaaacggttaacgaggtacggaggtacggaccgtacggaccgaacggaacggggaacggtacgtactcgtacgttacgtttcggttacgacggtacgtacgtcgtgggtcggtacncggtcctacgttacctaccgactactccgtccacgtcccgacgtcgacgtcggttaagctagtcgacgttctacgtacgttacgtntacggtacgaccggttacgggtagttccttaagggtttgtacgggtttcgggttaccggggccggtaaggtcccgacggttacccgtcgtaccggttaagtccgcgggtaacccnccgggttaaccgtcccnccccggttacccgg

SEQ ID NO: 110349 - DNA, 644 bp, Homo sapiens
  misc_feature: GYAE6OF02JSO3O.10.28.C06.1.454.CMB.1.raw
  modified_base (296)..(296): a, c, t, g, unknown or other
  misc_feature (296)..(296): n is a, c, g, or t
tcagcatagtagtgcacgaccggtgctcgatttagagctcacgtattgggtttgggggggtcgtcaggaggcggccctctcgggacgtctccaccatggcctgggctctgctattcctcaccctcctcactcaggcacaggtcctggcccagtctgccctgactcagcctgcctccgtgtctgggtctcctggcagtccatcaccatctcctgcactgacccaccagtacattggtaataatgaatatgtctctcgtacaacactaccagcaaacgaccccaatgatgtaacttanagtatcgtacataactcgaccctacgtacgggttctgtactcgtcttcttcgtcctacgtaagtcgttagaccgtaaccgacggtccctacccgtacgaacctacttccttacggttcggaccttacccgtagaccgttcggaacgggacgtacggtactaggtacttacgttacgagtaccacgcctcgtacaacgtacaacggacgtacgtagggtcggttcgggtcggttacggggcggggtaacctacggccgtaaccggtccgtaccgtacgggtacctaccgggtccgaacgggcccttccgggccccgtacgtaccgtacccgttcgtaccccttcccccg

SEQ ID NO: 110350 - DNA, 721 bp, Homo sapiens
  misc_feature: GYAE6OF02IV54N.10.28.C06.1.454.CMB.1.raw
tcagcatagtagtgcacgaccggtgctcgatttagagctcacgtattgggtttgggggggggtctcaggaggcggccctctcgggacgtctccaccatggcctgggctctgctattcctcacccctcctcactcagggcacagggtcctgggcccagtctgccctgactcagcctgcctcgtgtctgggtctcctggacagtccatcaccatctctgcactcggacccacagttacagttaggtaataagtgaatatgtctccgtaggtaaccaacacgtacccaggaccaaaccgcccccaaatcgaatgtaatttagtgtattcgtactagtaactcccgacccgtcgttaggggtttctaggtacttcgttcctttcgtttacgccctaccgtaacgttcgtacggacccgtaaaccgtacccggtaccctcccgtaccgaccctacgttcctccggtcgggtaccctacccgacgtaccgttagggaacgggtaaccggtaggtccgttagttaacgtttaactttaccgttacgaccgtacgtaccttaccgactaacggttaccgaaggcccggtacgtacgggtcggggtttacgggtcgggttaccggggaccggggtaaccacgtaccgtccggtaccggttaccgtcggtaccgacgccgacggtcccgtcccgtccccgtccgtcctacccgttccgttcccgtcccccg

SEQ ID NO: 110351 - DNA, 710 bp, Homo sapiens
  misc_feature: GYAE6OF02IFOCW.10.28.C06.1.454.CMB.1.raw
  modified_base (165)..(165): a, c, t, g, unknown or other
  misc_feature (165)..(165): n is a, c, g, or t
  modified_base (172)..(172): a, c, t, g, unknown or other
  misc_feature (172)..(172): n is a, c, g, or t
  modified_base (186)..(186): a, c, t, g, unknown or other
  misc_feature (186)..(186): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctntgcctcngcctccgtgggacncctcggtcaagctcatctgcactctagacgcgaggtcgggcacgacgacaacgtacgccaatcgacagtcggactataccgagctacggacaacggccgaggaacggaaccggggcccttacggtaacgttgaacgtacggtaaacgggtttaacagggttagacgtaggacaacgaccgaaccgaaccgggtaaggggaccgggtacttaccggtacgttacgttttacggttttaccggacgggttaccacggtccgtacgggtcggggtacctagggaccgtccgtaccctaacccgactaccgtacttacctccgaactcccttaccgacgttcgacggtaggacgtacggaccggtactacggaactttagttaaccgtcggttaccgacggtaccggtcgggtactacggtttacggttacgttagggttccgggtttaaggccgggtaacggaacctaggtccgtaccgttaccgtacgtaacggtcccaacggcccggtaacgtcccgtaccccgg

SEQ ID NO: 110352 - DNA, 675 bp, Homo sapiens
  misc_feature: GYAE6OF02J0TAL.10.28.C06.1.454.CMB.1.raw
  modified_base (160)..(160): a, c, t, g, unknown or other
  misc_feature (160)..(160): n is a, c, g, or t
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (323)..(323): a, c, t, g, unknown or other
  misc_feature (323)..(323): n is a, c, g, or t
  modified_base (371)..(371): a, c, t, g, unknown or other
  misc_feature (371)..(371): n is a, c, g, or t
  modified_base (460)..(460): a, c, t, g, unknown or other
  misc_feature (460)..(460): n is a, c, g, or t
tcagcatagtagtgcacgaccggtgctcgatttagagctcacgtattgggtttggggaggagctctggggagtctgcaccatggcttggacccactcctcttcctcaccctcctcctccactgcacaggtctcgtctccgagcgtgtgctgactcaatcnccctctgcctctcgcctcccgtgggacgccgtcggtaccaagcctcactctgccacttcgtgaagcgagtggggcacagacctaacncgcatccgcagtgacntcncgtcagcagacgaggacgacgggtccgtgtaactgaacgtaggaaacgttagtacgngtaaagcggacacggaccaaccggaacgggtaacggggccggttaacncccgtcggttagtttccgtttcggacggtacgtcgtcggttcggacggggtctagaccgcgtcctaacgtacaaccgattcccgaaacncggtccctataacggtcgttaggacggtagtcgggtagtcgtacgttacttagttacggtcggtacgtaacgggtaccggttcgggactttacggtgtttaacggttcggtttaaccggggttgggacccggggttaaaaggccgtaaacgttccggacggtacccggttaggtaccggtacccgcgggttaacccgacgtcccgggttcccccg

SEQ ID NO: 110353 - DNA, 708 bp, Homo sapiens
  misc_feature: GYAE6OF02FIWMG.10.28.C06.1.454.CMB.1.raw
  modified_base (255)..(255): a, c, t, g, unknown or other
  misc_feature (255)..(255): n is a, c, g, or t
  modified_base (309)..(309): a, c, t, g, unknown or other
  misc_feature (309)..(309): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggacccacctagttacattggtaataatgaatntgtctcctggtaccaacacgtacccaggcaaacgcccccaaatgatgtatttangatgtcaagtactccgaccctcgtagggtttctgtacttcgtcttttcttcgtcctacctaacgttcgtcggacaacgtccggccctcccgtagaccctagttcctcggtcgggctaccgagtacgtaggaacgggacgacggtcgtagtaactttaacgttacttcgactacggtcctaccaactaactaacggaacgtacgggacgtacgggtcggggtttcggggtttcggggttacggggtaccggggggtaacccacggtaccgttacgggtacccggttccggtaaccgggtacccgtaaccgggtaaccccgtaacgggttccccgttaccccggttacccccgtacccgggttaccctaccccggtttccgttccccgtttaacccccccg

SEQ ID NO: 110354 - DNA, 666 bp, Homo sapiens
  misc_feature: GYAE6OF02I2Z3R.10.28.C06.1.454.CMB.1.raw
  modified_base (187)..(187): a, c, t, g, unknown or other
  misc_feature (187)..(187): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgcctcccgtgggancctcggtcaagcctcatcctgcactctgagctaggtgggaccacacgtcaaactcgccatcgacagtcggcatcaagcagcagaccgagacggaacggcccgtcggtactgataggtaaacgtaacaggtgatggcacgaccaacgaacggaacggggacgacttacccgtgtacgtttacgttttacggacggtaccagtcgtcgggtacggggtacgtcggaacgccgtaaccctacctaccgaaccgtactaccgtaccgtacgtacccgtacccgacgttcgtaagacggtagtcggaacgtctacggtaacttacgttaaccgtcgtacgacgtaccggttacgggtcctacggtttaggttaagttcgggtttgggtttaccggggaacgggtaccggaaccgtaacggtccgttaccggtaccggttaccgtacggtacccgaccggtacccgtaccggtccgtacccccgg

SEQ ID NO: 110355 - DNA, 802 bp, Homo sapiens
  misc_feature: GYAE6OF02JBONH.10.28.C06.1.454.CMB.1.raw
  modified_base (210)..(210): a, c, t, g, unknown or other
  misc_feature (210)..(210): n is a, c, g, or t
  modified_base (276)..(276): a, c, t, g, unknown or other
  misc_feature (276)..(276): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaactccgccctctcgccttctgccctccgtgggacgccgtcggtcaagctcatcngcactcgtagagcgagtcgggcacacgaccaacgtaccgaccacgtccgctaacgtggaccttaanaccgaggccaacggccgaacgaccgaaggtaaccgggaaccggggtccccgttaccgggttacgttaggtaacggtaaggttaaaccggttaacgtaaggtcgtaagtcggacgtacgacccgtaaccgaaccggggaaggggaaccggacgttacccgtaggttaccgttttaccgggttttacggtaaccgggttacgacgttccggttaccgggtcgggtaccgtaggtacggtaccgtaacccgtaccgtaccgacccggtaccttaccgttccgtacggtccccttacgtaccggttacggttacgggacgtaagggtcggtacgtacggttaccttaacttacgttacgtacgtaccgtaccggcggttacgggttaccgtacggttttcggtttagggttcgggtttacgggttacggggtaacgggttacgggaacggtaccggggtcgtaccggttaacccggtaccggttaccggtaaccggtcccggaacccggtacccggtccggtacccccgg

SEQ ID NO: 110356 - DNA, 681 bp, Homo sapiens
  misc_feature: GYAE6OF02ICLKD.10.28.C06.1.454.CMB.1.raw
  modified_base (206)..(206): a, c, t, g, unknown or other
  misc_feature (206)..(206): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
tcagcatagtagtgcacgaccggtgctcgatttagagctcacgtattgggtttgggggggggtctcaggaggcggcgctctcaggacgtcaccaccatggcctgggctctgctcctcctcaccctcctcactcagggcacagggtcctgggcccagtctcgccctgactcagtccctccctccggcggtccgggtctcctaggacngtcagtcacctatcctcctagcactggaaccngctagtntactttgttcncttataatctcgtctccgtgtacctanccaaccnccgaggacaaaccgtccccctaaactttccgtttgttttacgacggtactaagtacggtcgccctagagtctccctgtacgtcggttctcgcgccctaccagttcgtacgacaaacgtccgccttccgtcgtaccgtcgtcggtcggcctacgacgctaggagtacgtgggcgtacgtcgtaacttacacgtcggactaagggcctaccgtaagtactccggtaacgacccgtaaagggtcgggtttggtacgggcgggtaacgggtaacggttacggtacgtcccggtaggttcccggaacgacgggaacccgtaaggtccccggttaccgtacccggtccgttaccggccttccgttaacccggtcccccttacccgtccgttaacccg

SEQ ID NO: 110357 - DNA, 781 bp, Homo sapiens
  misc_feature: GYAE6OF02G7I0Z.10.28.C06.1.454.CMB.1.raw
  modified_base (287)..(287): a, c, t, g, unknown or other
  misc_feature (287)..(287): n is a, c, g, or t
  modified_base (516)..(516): a, c, t, g, unknown or other
  misc_feature (516)..(516): n is a, c, g, or t
tcagcatagtagtgcacgaccggtgctcgatttagagctcacgtattgggtttggggagagctctggggagtctgcaccatggcttggaccccactcctcttcctcaccctctcctccactgccacacgggtctcctctccacgcttgtgactgacttacgatccgccctcgtcgcctcgtcgacccgttacccggtgggaacctcccgttccgggtaccaaacggtcctcgaacgttcctcgaccttaacgtccgtggaacggtccaggggttaccgggaccctanaaccggtctaaaaccgtacggtcccagttccgaacgtacggtacggtacacttcggacgaccttaggccgtaacgccgtaaacgggacgggaccggttaacccgtcggttaaccgttaggtaacgtaaagtaaacgggtttaacaggggttaacgacgaggtacctacgaccgttaaacggaaacggtaacggggacgacctctagttaccgtcgttaacggacggtcnggtacttgggacggttacgtcaccgtacgtacgtaccgtacactacgtcgtacgtaccgccgttaacgcttaacggtcggacgttacgacggtacgtaacggtaccgtaccttaaggtaaccgtttaccgaacgtaaccggaccgttaggggacccttagttacggttacgtcggttacggttaccggacggtaaccggtaaccaggttacccgacggtaccgtacgtacggttaaccgccggtaactaccggtccgtaacccgg

SEQ ID NO: 110358 - DNA, 813 bp, Homo sapiens
  misc_feature: GYAE6OF02GUVI9.10.28.C06.1.454.CMB.1.raw
  modified_base (192)..(192): a, c, t, g, unknown or other
  misc_feature (192)..(192): n is a, c, g, or t
tcagcatagtagtgcacgaccggtgctcgatttagagctcacgtattgggtttgggggagagctctggggagtctgcaccatggcttggaccccactcctcttcctcaccctcctcctccactgcacagggtctctctcccagcttgtgctgactcaatccgccctctgccctctgccctcccgtggggacncccgtcgggtcaacgtcctcacgtctcgccaccttctggagccgagggtcggggaccaacgacgacctaaaccgtaccgacccacgtccgtcaacgttgggaccaactaccaggaccacggcaagccccgaagaacgggaaacccgggggtcccccgttaccgggttaactttacgggaagttacgggaaaacggttttaaaccggaggttaacggtagttaccgggactaaccggacccgaaccgaaacccgggggaaaagggggggtaacccggacgtttaccccgggtagttaaccgtttttaccgggttttacggtaccggggttaccgaacggtccggttcggggtacggggtccgtagggtaccgccggtaaccctcctaacccgacttaacgtccctacgacccgtcccgtaccgtacgtcggttacggacggtagttcggacgtcgtacgtacttagtaccgttcgtacgaaccggttcggacgggtactacgttaggtttgttagggttttccgggtacgggtccggggaaggtaaccggtccggttacggcggttaccccggtacgttacggggtacccacggtacccggtaccggtccgtaccccccggg

SEQ ID NO: 110359 - DNA, 758 bp, Homo sapiens
  misc_feature: GYAE6OF02JYJBU.10.28.C06.1.454.CMB.1.raw
  modified_base (176)..(176): a, c, t, g, unknown or other
  misc_feature (176)..(176): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaactccgccctctcgccttcncgtccctcccgtgggacgcctcggtcaagcctcactctcgcctactcctgacgacaggtcgggcaacgacgtaccaaacgtaccgccgtactccgacacgtggcaactcacgacgtacgacctacgaccgaggaacgggaaaccgggtcccctaggttaaccgttagacgttacggtaaaacggttaacgaaggtgaacgtcggccaacggacccaaacggaaccggggaacgggggacgggtaaccttacccgttagggtacgtttttaccggttttacgggaacgggtttccaacgggttccgttaaccgggttcggggtaacgttacggaccggtacccgtacccttaaccgtacccgtaacctcgtacccgtcccgacgtacccgtcgaacggttcgtaaggacggtacgttcgggacgttcgtaacgtatttcgttaaccgtggaacccgttggtacccgtgggtactaacggtttggttacgtcggggtttggtaaccggacgggtaacggtactaggtccttaccgggccgtttacgacggtaccgtaccggcccgttacggtcccggtaccccg

SEQ ID NO: 110360 - DNA, 846 bp, Homo sapiens
  misc_feature: GYAE6OF02G6A5B.10.28.C06.1.454.CMB.1.raw
  modified_base (191)..(191): a, c, t, g, unknown or other
  misc_feature (191)..(191): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctcgcctctcgccctcccgtgggacnccgtcggtcaacgctcatctgcctactctagacgcgtaggtcgggaccacgacgacctaaaccgtaccgaccctagtccgactaagtcggacacgtacgacgacgacgccacggaccaaggtaacggaaccgggtcccgttacggttacgttaggaacgttaacggtaaacggttaacgtaggttagacgttacggaccgaacgaccgaaccgaaccggggaaacgggggaacggtaccgttaccggtagttacgttttaccggttttacggacggttaccgtacgtaccggttcgggtacgggtcgtacgacgggttaccgtcccttaacctcccgtaaacctctacccgtaccgtacccgtccgtaccggtacgttcggaacgggtaacggtcgtacgtacgggtacttaacggtaacgtttaaccttaacggtcgtaaccggtaaccgggttaaccgggtcgggttaaccgttaacgggttttaacgggttggtttttaccgggggttttccgggtttaaccggggggacccgggttaaaggggttaaacccgtaacgggttccccggtaaacggggttttaacccgtaccggggttaaacccggaccgggttacccggaaccccggttacgggtccccggttccccccggg

SEQ ID NO: 110361 - DNA, 800 bp, Homo sapiens
  misc_feature: GYAE6OF02I5Y9K.10.28.C06.1.454.CMB.1.raw
  modified_base (139)..(139): a, c, t, g, unknown or other
  misc_feature (139)..(139): n is a, c, g, or t
  modified_base (586)..(586): a, c, t, g, unknown or other
  misc_feature (586)..(586): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctctcactcaggcacgngggtcctgggcccagtctgccctgactcacgcctgcctccgtgtctgggtctcgtgacagtccatcacctatcctctgctaccgtcggacccctacctaagttactagtttaggtaaataagtagtaaaattcgtcgttaccttcccgtcggtaaacccaaacgtacgtaaccccgaggtaaccgaaaaccccggtaccccccaaacgttacgtaagttaacgtaagttttaacgtggaactttacggtacgtaaacggttaaacctccccggtaaaccccgttacgggttaacgggggtttccttacggttaacttccggtttccttttaccgtttcccgtacccttaccgtaacgtttccgaccgggtaaccctaaccggtacccgtcccgtacccctcggtacccgttcgtccggtccggtccgtacgacgggtcgtaggtagngttcggacgtcgtacgttaagtctaacgtcgacgacgtcctacgtatacgtaccgtaccgtaacccgtacgggtgggtttcgtaggggccgggtaacggaacgttaacgggaccgtaccggttacggtaggtaaccgtcggaccggttaaccgccgttaccccggtcccgtcgtaccgtaccgttcccggtaccttcccccggtccctacccgg

SEQ ID NO: 110362 - DNA, 610 bp, Homo sapiens
  misc_feature: GYAE6OF02FWG20.10.28.C06.1.454.CMB.1.raw
  modified_base (147)..(147): a, c, t, g, unknown or other
  misc_feature (147)..(147): n is a, c, g, or t
  modified_base (166)..(166): a, c, t, g, unknown or other
  misc_feature (166)..(166): n is a, c, g, or t
  modified_base (188)..(188): a, c, t, g, unknown or other
  misc_feature (188)..(188): n is a, c, g, or t
  modified_base (235)..(235): a, c, t, g, unknown or other
  misc_feature (235)..(235): n is a, c, g, or t
  modified_base (399)..(399): a, c, t, g, unknown or other
  misc_feature (399)..(399): n is a, c, g, or t
  modified_base (441)..(441): a, c, t, g, unknown or other
  misc_feature (441)..(441): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
  modified_base (512)..(512): a, c, t, g, unknown or other
  misc_feature (512)..(512): n is a, c, g, or t
  modified_base (525)..(525): a, c, t, g, unknown or other
  misc_feature (525)..(525): n is a, c, g, or t
tcagcatagtagtgcacgaccggtgctcgatttagagctcacgtattgggtttggggagagctctggggagtctgcaccatggcttggaccccatcctctcctcaccctcctcctcacctgcacagggtctctacgtcccagcttgngctgactcaatccgccctngcctctcgccctccgtgggacnccgtcggtcaagctcatctgcatctgagcaggtcggcacagctaacncgtcacgtcgacatcgggactataccgtagcgaacgacgagaccgtaacgacggtaaacgggccccttaggtaacgtgtaaccgtaggtaacgtttaacagtacggtacctagggtacctacggtaaccaccggaacggtaacggggtacggtacttaccggtntaacgtttcgtttacgacggtcgaactcgtaggtcgtaacgnttcggacttacggaccaggtacatccggactgggactacgtcgancngctagntancgtagtacgcacgtntgtaccgtgtacngtagtacgtacgtagtacgacggtacggtacgtacgtacgtacgtacggttacgtacgtacgtacggtacgtaccggtacgtacg

SEQ ID NO: 110363 - DNA, 779 bp, Homo sapiens
  misc_feature: GYAE6OF02HCHWO.10.28.C06.1.454.CMB.1.raw
tcagcatagtagtgcacgaccggtgctcgatttagagctcacgtattgggtttggggagagctctggggagtctgcaccatggcttggaccccactcctcttcctcaccctcctcctccactgctacgagggtctctctcccagcttgtcgctcggactcaatccgcctgtcgcctcgtcgtccctccgtagggctccgtacggtacaacgtcgtcatcgtcactactcgtggacgtacgtagggtcgaccgagaccggactaaacctcgacaacgtcggacctaggtcggactaacgtcacgaccgacgacacggtacgaaggacgggtaaccggtcccggtaggttacgtaggacggtaaggtaaacggtacgacggttagacgtcgggaactaccggaccgaaccgggtacgggaacggggacgtacccttcggtacttacggtttaccggtttaacgacggttaccgtacgtcgggtggtacgaccgaggtacctaaccggttccacgtacctaccgtcccttaccggacgttaccgtacccggtatccgggtaaggtaggtaacggttcggacgtacgttacgttaaacctcgttaacggtccgacgtcggtaacggtcggtaccgttaaggtttcggacggtttacggggttcggtacgggtaccggtaaaccggcggtaaaccggttcccggtaacggtttacccgtccggggtaaacggttcccgaaaccccgggttacggtaccccgtttacccggtaccccggtccccg

SEQ ID NO: 110364 - DNA, 745 bp, Homo sapiens
  misc_feature: GYAE6OF02GE3CQ.10.28.C06.1.454.CMB.1.raw
  modified_base (648)..(648): a, c, t, g, unknown or other
  misc_feature (648)..(648): n is a, c, g, or t
tcagcatagtagtgcacgaccggtgctcgatttagagctcacgtattggggtttggggggggtctcaggaggcggccctctcgggacgtctccaccatggcctgggctctgctattcctccaccctcctcactcgagggcacgagggtcctgggcccaggtctcgccctgactcagcctgcctcgtgtcgtgggtctccgtggacagtccatccaccatcctcctgactacgtacggacccactagtactattaggtaaataatagtaatatcgtctaccgtacgtaaccaactacgtaaccgaaggaccaaaccgaccccctaaaatcggtaattacgttaatttagtcgtagttagtacgtaagtaacgtaccgtaccgttacggttaacggggttttcacggttacgttccgttccgttttccgtttacgacccttaaccgtaaacgggttccgttacgggaaccccgtaacccggtacccggtacccttaccccgtacgtaaaccctagttcccgtcggtaccgggtacctaccggtaaggaccgtaggacgggacgtagtcgtataactttactgctagtactcgacactagaacgacggcggtgagggttcgggttgggtacggtaccggggacggtaaccnggaccgtccggtaaccgtacggttaacgaccgccgaccggaacggtcctaccccggtcccgtaccggttcctacccggttacccgtcccctaacccg

SEQ ID NO: 110365 - DNA, 722 bp, Homo sapiens
  misc_feature: GYAE6OF02F48K8.10.28.C06.1.454.CMB.1.raw
  modified_base (188)..(188): a, c, t, g, unknown or other
  misc_feature (188)..(188): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctcgcctcccgtgggacnccgtcggtcaagctcatctagcactctgacgcaggtcggcacagaccaacgtaccgccagtcgacagtcggcatacagcagcagccagagacggcctacggtactgaataggtaaaggttaacaggtagagtagacacgccaacgaaccggaaggggacgtactccgtagtacgtttacgtttacgacggtaccagtcgtacggtcgggtactcggacgtaccgtaccttaccgtaccgaacctacgttaccctaccgtaccgtacccttaccgaacgttcggtaggtaacggtacgttacgggacgttcctaaacgttaccgttaagtttacggacgtaccgtacgggtacccgggttacggggtaccttaacgggtttcggttaaggtttcggggtttaccgggggtttaaccggggaccggggtaaacgggaaccgttaaccgggtccggttaacccgttacccgggttacccggttaacggggacccgtaacccggtaccggtaacccgggttccccggttaccccccgg

SEQ ID NO: 110366 - DNA, 699 bp, Homo sapiens
  misc_feature: GYAE6OF02GLR3L.10.28.C06.1.454.CMB.1.raw
  modified_base (448)..(448): a, c, t, g, unknown or other
  misc_feature (448)..(448): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggacgcctcggtcaagctcatctgcactctgagcaggtcgggacacacgaccaactacgccatccgcatggcatcagcagcagaccagacggaacgggcccgtacggtacttagagttacggaaaggttaacgagtaggaagtcgggacctacgacccgaaccgaaccggaacgggggaccggacgtacccgtagtacgtttccgttttacggacgggtcctacggtcctcggtacgggtcgtacggacggtccgtaccgttacccnccgtaaccctacgtacccgtacccgaccggtccctaccgtacggttcgtacggtacggtacgtcggacgtacgtacgtaacgtttacgttacgttacggtaccgtaacgggtaccgggttgggtacccttaggtttggtttacgttggggttttcgggttaccgggtacggggtaacggtaaccggacgttaccggtacgttacccggtacggttacggtccacggtacccggacgtcccgttacccccgg

SEQ ID NO: 110367 - DNA, 722 bp, Homo sapiens
  misc_feature: GYAE6OF02JGLHP.10.28.C06.1.454.CMB.1.raw
  modified_base (263)..(263): a, c, t, g, unknown or other
  misc_feature (263)..(263): n is a, c, g, or t
tcagcatagtagtgcacgaccggtgctcgatttagagctcacgtattggggtttggggagagctctggggagtctgcaccatggcttggaccccactcctcttcctcaccctcctcctccactgcacagggtctctctcccagcttgtgctgactcaatcgccctctgcctctgccctcccgtgggagcctcggtcaagctcatctgcactctgagctagtgggcacagccaactacgccatcgcaagtggacactacacggnacgcacgacagacgtaacgggccctcggtacttaggactaggtaaggtaacgaggtagactggacacggccaacgaccggaaggggggaccgacgtcccgtagtaatttcggttttacgacgggttccagcgtcgtggggactggacgccgtaccgtacctccaaccgattccgacctactcccgtaccgtagtacgttcggaggtacgtacggtacgtacgtcgtaaccttaaacgtttaccgtacggttacaaccgggtaccggttacggggtaacccttacggtttaacgggtttaacggtttacggggttttaggggtttttacccgggggaaccgggggtaaacggggtaccctaaaacgggtccgtaccggggtttaaaccccggtccggggtttaacgggtacccgtaacccgggtaacccggttaccgggttaccccggttaccccccggg

SEQ ID NO: 110368 - DNA, 693 bp, Homo sapiens
  misc_feature: GYAE6OF02IO0J7.10.28.C06.1.454.CMB.1.raw
  modified_base (192)..(192): a, c, t, g, unknown or other
  misc_feature (192)..(192): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacgagggtctctctcccagcttgtgctgactcaatccgccctctgcctctcgccctcccgtggggacnccgtcgggtacaaacgcgtacatccgtcgcctactccgtgacgcgtaggtcgggccaacgagaccaacgtaccgcctagtccgacctaagtcggactactacgacgacgacgcacgccgaaggacggtaccggtcccgtcgggttacttgaacgtaggtaaaacggttacgaggtagacggtacggaccacggtaccgaaccggacggaaacggggcgtacgtccgttagtacgttttcggttcgaacgggtcacgtcgtcggtgggactggacgtcctacgtaccacgtacacgtcctccgaacgttccctacggacgttcggtaggaacggtactacgggacgttcgaccgttaacgttaacgtccgaggtacgaccgggttacgcggggtaactttacggtaggtttcgtttcgggttcggtttaacggggcggtaaacggtccctaaggcccgtacggtaccggttcgacgcgtaccggctaccggtcctccccggg

SEQ ID NO: 110369 - DNA, 705 bp, Homo sapiens
  misc_feature: GYAE6OF02GBWJQ.10.28.C06.1.454.CMB.1.raw
  modified_base (491)..(491): a, c, t, g, unknown or other
  misc_feature (491)..(491): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaactccgccctctcgcctctgccctccgtgggacgtcctcggtcaagctcatctgcactctagacgcaggtcggacactacgactaactaccgaccatcgctagtggactatcgagcacgacacgaccgagaacggaaccgggtcccgtacggttacttgactaggtaaacggttaacgaggtcgagtacgggactacggaccgtaaccggaacgggaacggggtaccggtactcccgtaggttacggttttaccggtttacggacgggtacctacggtccgttacgggtggggtctacggtacgccgtaaccctccgtacaaccctacttacccnccgtaccgtccctacgacgttacgtaaggtacggacgtacggtaaggtctacgttacttaacgtacgttacgtacggaaccgtcgggttacgggtcccttaagggtttggttacgttcggggttacggttccggggaggtaacggtaacgacggttccgtacgtaacccggttccggtacgaccgtacccgtaccggtacggtccgtaccccgg

SEQ ID NO: 110370 - DNA, 794 bp, Homo sapiens
  misc_feature: GYAE6OF02JMK2D.10.28.C06.1.454.CMB.1.raw
  modified_base (270)..(270): a, c, t, g, unknown or other
  misc_feature (270)..(270): n is a, c, g, or t
  modified_base (343)..(343): a, c, t, g, unknown or other
  misc_feature (343)..(343): n is a, c, g, or t
tcagcatagtagtgcacgaccggtgctcgatttagagctcacgtattgggtttggggggggtctcaggaggcggccctctcgggacgtctccaccatggcctgggctctgctatcctcaccctcctcactcaggcacagggtcctgggcccagtctgccctgactcagcctgcctccgtgtcgtggtctcctggacagtccatccacctatcctcctgcctacgtcggacccacaagttacagttaggtaaaattacgagtaaatcgttntcctcgtcggtaaccaacgtacgttacccaggaccaaacgaacccccctaaaactcgaattcggtaattttancgtaattcgtactagtaaacgtcccgtaccctacggttacggggtttactcggtaacttccggttccttttccgtttcacccgttacctaaaggttcctacggtacctaaaacgtccggtacccttacccacggttaacctacttcgtccgtacgggtcctaccgaacgtacgtacggacgggtaacggtcgggtaacttaggttaaatttccgtaaattccggacgactcccgtacgttaaaccaacgttaaccgaaaggtccgtaacgttccgggtgggggtttacgggttacggggtttaccgggggaccgggggtaaaccgccggttaacctaccgggtttaccggaacccggttacgggttaaccggacccggtacccggaacggtttccgacccgggttccccgtaccgtaccctcgtttaccccggtcccggttttccccccgg

SEQ ID NO: 110371 - DNA, 907 bp, Homo sapiens
  misc_feature: GYAE6OF02JM0JN.10.28.C06.1.454.CMB.1.raw
  modified_base (264)..(264): a, c, t, g, unknown or other
  misc_feature (264)..(264): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacaggtctctctcccagcttgtgctgactcaatccgccctctcgcctctcgcctccgtgggacgtccgtcggtcaacgtctcatctcgcactctgacggtacgaggtcgggcaacgacgacgtaaacctaccgcctaacnccggactaacgtcggactacgtcgaacgccaggaccgacgaccgtaacgaacgggtaaccgggtccccgtcggttaacttaggactaaggtaacggttaacgagtaggaacgtcgaccgacgtaccgaaccggtaacggggaacggggtacggaccgttaccgttacggttacgttttaccggttttcggaaccgggttaccctacgttaccggttcgggtaacggggtccgttaacgggtacccggcccgtttaaacccgttacccgaaccccgtaccgttaccgttaccccgttacccgaaacccgggttccccgttaaacggtccggttaaccgggtacgggtaccggggttaacggtaccgggtaacggtacccggtaacgggtttaacccttaaccggtttaaccggtccgggtaaacccgtacccggggtaaccgggtttcgggtaaaccgtttaccggtttacggggtttacgggttttaccggggttttcccggggtttacgggaaaccccgggggttacggggtaaacctaccggggttccgttaaacccggggttccccggttaaccgggtttaaccgtcccgggttaaaccccgggtacccggttaaccgggtcccccgttaaccccccggg

SEQ ID NO: 110372 - DNA, 769 bp, Homo sapiens
  misc_feature: GYAE6OF02F9A1V.10.28.C06.1.454.CMB.1.raw
  modified_base (218)..(218): a, c, t, g, unknown or other
  misc_feature (218)..(218): n is a, c, g, or t
  modified_base (266)..(266): a, c, t, g, unknown or other
  misc_feature (266)..(266): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgccctccgtgtcgtgggtcctccgtggactacgtccatccaccntcctcctgcacgtcgacccactagttacagttagtaataatagaactntcgtctctacgaacactacgtacccaggacaaaccacccctaacttcctttggttttgaggtcagtacggccggcctgaggttctttcgtagttccgtctttccgtcgtccgtcctacgtaacgtccgtacggaccaaaccgaccgggtcccttaccgtacgaaacctagttccgtcgtcggccctagcggtctacgacgacggcgaccttaagaactttcgttaaccgcgtctacgtctaacgttcgttaaagttcgggtaacggttacgttcggttacccgttacctttttaccgggttttaccgggttaacggggttttcccggggaggggtaacccgggaaaccggttcgggtaccgtaccgggtttaccccgttaacggttaccggtaaccgtaacccgtacccggtaacggttccccccgttacccggttacccccgggttaccgttcccggttaccccgtttaccccggtttccccggttacccccccgtcccccc

SEQ ID NO: 110373 - DNA, 691 bp, Homo sapiens
  misc_feature: GYAE6OF02I5BN5.10.28.C06.1.454.CMB.1.raw
  modified_base (189)..(189): a, c, t, g, unknown or other
  misc_feature (189)..(189): n is a, c, g, or t
  modified_base (393)..(393): a, c, t, g, unknown or other
  misc_feature (393)..(393): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacaggtctctctccagcttgtgctgactcaacgtccgccttctgccttctgccctccgtgggacnccgttcggacaacgcttacacgttcgtcgctacgtcgtacggacgtcgacggtggaccaacgtacgacctaaacgaccggcctaagtccgaccgtagtcggtacaacgttcgaacggccaggaccacgaccgaaggtaacggtaacccgggtccgttacggttacgtagtacgtaagtaaacggtaacgagtagtacgtcgacncgaaccgaacgtaaccgggaacggaacggtactaccgtagtacgtttacggtttcgacggtcgacgtcgtacggtacggtcacggacgtcgtacttaccgacgaaccttcgtacccgttaccacggttccctacggtaggtaccgtagggtacgaacgtcgacggttacgtacggttattaaccgttacgtagacgtcggaccgttgtaacgtcgtttacgtaggtcggttacgttcgggacggtacgaacgtcgacgtccgtacggtgtaaccgcgttaccggctacgtcccgtccg

SEQ ID NO: 110374 - DNA, 1008 bp, Homo sapiens
  misc_feature: GYAE6OF02HRT0H.10.28.C06.1.454.CMB.1.raw
tcagcatagtagtgcacgaccggtgctcgatttagagctcacgtattgggtttgggggggggtctcaggaggcggccctctcgggacgtctccaccatggcctgggctctgctattcctcaccctcctcactcagggcacgagggtcctgggcccagtctcgccctgactcagcctgcctccgtgtcgttcgggtctccgtaggacctacgtccatccaacctatcctccgtcgactacgtaccggaccctaccgtaagttaactacttaacggttaaatagtagtaatacgtcgttcctaccgtaggtaaacccaacctaacgtaaccccgaggaacctaaacccgacccccctaaagtaggtaacttacgttaattttaacgcgtacgttacgtaacgtaaacgttaaccgtacccggtaacccttacgggttacggggttttcctacgttaccgttcggttcttttaaccgtttccggtcccgttaaccgtaacgggttaccgttacgggaaacccttaaaacccggtcccgggttacccttaacccggtacggtaacccttcgttcccggttcggttacccggggtaccttaccggtaacggttaccgggttacggggaaccggggtaaccggtaacggttaccgttaaacgggttaaaacttttaacgtttaccgggacggttaaccccgtaacgggtttacaacggttaaagttttacggtttaacggtaaacgggtttaccggttcgggttttaaccccgggttcttttttaacccgggggttttaacgttttaaccgggggggtttcccgggaaaccggggggtttaacccggggtacggttacccgggttacccggttaaccgggtttaaccccgggttaacccggtaaacccgggtcccggaaaaccccgggttaacccgggttaccgggtacccccgttacccccggttacccccccgggttttaggtaccccccgtttaacccggttttcccccgg

SEQ ID NO: 110375 - DNA, 955 bp, Homo sapiens
  misc_feature: GYAE6OF02GCPGD.10.28.C06.1.454.CMB.1.raw
  modified_base (147)..(147): a, c, t, g, unknown or other
  misc_feature (147)..(147): n is a, c, g, or t
  modified_base (188)..(188): a, c, t, g, unknown or other
  misc_feature (188)..(188): n is a, c, g, or t
  modified_base (207)..(207): a, c, t, g, unknown or other
  misc_feature (207)..(207): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacgaggtctctctcccagcttgngctgactcaatccgccctctgcctctgccctccctgggacncctcggtcaagctcatctnccactctgacgcacggtggcacgtagccaaccgtacgacctagtcgactagtcggactactacgaacgcacgccgaacggaccgaaggaaccggaaaccggggtccccgttacggttaaccgtttaggaacgttaacgggtaaaacggtttaaacgtaggttacggtaacggttaccggaccgaaaccggacccgaaaacccggtaaccgggggaaacgggggggtaaccggttacccgttaccccggttacggttaaccggtttttccggttttaccggaacgggttaccctacggttccggttaccgggttcggggtacgtaacgggtaccgggtcccgtaccgtaaccccgtacccgtaaacccgtacccgtttacccgtacccggtaacccggtaccccgttacccgttaacgggtttaccggttaaaccgggtaacggttaaaccggttaccgggtaacggttaccgtttaaaccggttacccttttaaccgtttaaccggttacccgttaaccgggtaacccgggttaccccgggttaggggtaacccctttacggggtttttacggtttaccggggtttaccgggtttttaccgggggtttaccgggggtaaacccggggtaaccgggttaaacccggttaaccgggttcccgtttaacccggggttaacccggttaccggttaaccgggtaccccggtacccgtaaccccgggtacggtccccggttaacccccccgggg

SEQ ID NO: 110376 - DNA, 751 bp, Homo sapiens
  misc_feature: GYAE6OF02FKCDK.10.28.C06.1.454.CMB.1.raw
tcagcatagtagtgcacgaccggtgctcgatttagagctcacgtattgggtttgggggagagctctggggagtctgcaccatggattggaccccactcctcttcctcaccctcctcctccactgcacagggtctctctcccagcttgtgctgactcaatcgccctctgcctctgcctccctgggacgcctcggtcaagctcatctgcacctctgagcaggtggccacagcaactcgccatcgcatggcatcagcacgcacgccagacgacggtccctgtacttgatagtaacgtacagtgacgtcgacacgccaacgaccggaacgggggacgactccgtaggtacgtttcgttttacggacgggtaccctaacggtccgttccgggtcgggggtacctacgggacgtacccgttacccgttaacccgtccaaacccccgttacgttacccgtacccgtaaccgggtcccccttaccgtaaccggttcgtacgggaacgttacgtacggtaacgggtaccgttacgttaaaccgtttaacgttaccgttaccggttaccggtaaacggtaccccggggtttacgggggacccttaacgggtttagggtttaaccgtttcggggttttaccggggtttaccggggaccggggtaaaccgggtaacccgaagggttcccgtaccgggtaaccccggttaccggtacccgtaccggtaccccggtaacccggtacggtccccgttacccccggg

SEQ ID NO: 110377 - DNA, 1125 bp, Homo sapiens
  misc_feature: GYAE6OF02IZKNI.10.28.C06.1.454.CMB.1.raw
tcagcatagtagtgcacgaccggtgctcgatttagagctcacgtattgggtttggggagagctctggggagtctgcaccatggcttggacccactcctcttcctcaccctcctcctccactcgcacgaggtctctcctacccagtcgttgtgctagacctacgaactccgcccctctcggccttctcgtcccgtcccgtgggaccgtcccgttcgggtaccaacgccttactaacttcctcggaccgttaacctcgtacggacgtaccgtaggggtcgggacccaaacggaccggtaaccaaaccgttcccgaccgttaacgttccggaacgtacggtacggaccaacgttacggaacggcgaaccggaccaacggaccggtaaacggtaacggggtaaaccccggggtcccccggttttacgggttaaaccttagggtaaaccgggtttaaacggtaaaaaccgggttttaaaccgaggtttacgggaacggtacggtaaccggaccgtaacccggaaaacccggggaaacggggggttaaaaccggggggtaccggttaaccccgtttaacccgttacggggttttaccggtttttaacccgggttttaacccggggacgggttttaccccaacggggttcccgggggtttaaccggggttaccgggggttccggttacgggtaaaacccggggtccccgttttaaaccccggtttaacccccgttaccgggtaaaacccctttcccggtttaccccggtcccgggtaaaaccccgtttccccggtttaccggtaaacggttaaccggttaaacgggggacgtttacccggggaggtttaaaccgtacggtttaaacccgtttccggttaaaacgtttcccgttaacccggggtaaccggtttaccgggtacccggggtttaacccggggttaggtttaaaccggttttggggttttaacggtttcccggggggttttaccggggggtttaaacccgggtacggggtaaaccgggtaaccgggttaaccgggttccgttaacccggggttacccgttaaccgggttacccggtaccgggacccccggtaaggttaacccccggttccggggttaaccccccgg

SEQ ID NO: 110378 - DNA, 597 bp, Homo sapiens
  misc_feature: GYAE6OF02FNI3Y.10.28.C06.1.454.CMB.1.raw
  modified_base (190)..(190): a, c, t, g, unknown or other
  misc_feature (190)..(190): n is a, c, g, or t
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
  modified_base (306)..(306): a, c, t, g, unknown or other
  misc_feature (306)..(306): n is a, c, g, or t
  modified_base (406)..(406): a, c, t, g, unknown or other
  misc_feature (406)..(406): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagtcttgtgctgactcaatccgccctctgccctctcgcctccctgggacnccttcggtcaagctcatcgtagcactcngagcaggtcggnacagcaactcgccatcgnatggacatcagccancagccaaggagaacggcccgtgtactagactaggaaggttacngtcgagtgacacgtaccacggaaccggaaggggacggactccgagtactttcgtttacgacgggtcctaggtcctcggtgggctcggacgtccgctaccnctacacgtctccacgtcctacgtacgtcgtggagtagtacggacgtcgtagtacgtaacgtatcgtacgtacggtacggtcgggactagttacggttagttggtttccgggttacgggacgggtagggaccgtacggtccgtacggtaccgttcggtcggttacgaccggtaccgacggtccgtaccccgg

SEQ ID NO: 110379 - DNA, 853 bp, Homo sapiens
  misc_feature: GYAE6OF02JJUAU.10.28.C06.1.454.CMB.1.raw
  modified_base (172)..(172): a, c, t, g, unknown or other
  misc_feature (172)..(172): n is a, c, g, or t
  modified_base (408)..(408): a, c, t, g, unknown or other
  misc_feature (408)..(408): n is a, c, g, or t
  modified_base (578)..(578): a, c, t, g, unknown or other
  misc_feature (578)..(578): n is a, c, g, or t
tcagcatagtagtgcacgaccggtgctcgatttagagctcacgtattggggtttggggagagctcgtggggagtctgcaccatggcttggaccccactcctcttcctcaccctcctcctccactgcacgagggtctctctcccagtcttgtgctgactcaacgtccgccctntcgcctctcgcccttcccgtgggacgtccctcggtacaacgtctacatccgtagcctacgtcgtggagccgtagggtcgggccaacgacgacctaaaccgtccgaccagttccggactaaggtcggactacgtcgaacggctacggaccgaacggtacccgaaggggaaacggtaccccgggggttcccttacgggttaacgttacggtacgttaaaggggtaaaccggttaaccngggttacgaggtccggaccaccgtaccgaaaccgggaaccgggggtaaaggggtacccggtaccttaccggtaggtttaaccgtttttcgggttaaacgggtaccggtaacacggtccggttcggggtaccgggtacggacgtaccgggtccgttaacccgttaaacccncggtaacccctaggtttaccctccgaccctaccgttaccggtacgtaccggtagggtaaggttacgcggttaccgtactaaccgttaacgtttaccggttaccgacggtacccgtaacggggttccgggtacggtacgtttaaccgggtttgttaacgggtttccggggttaccggggttacggaaccggggtaactacgggtacgttcccggaccggttacccggttacgtaggtcccgtaaccggtacggttccccggtaccgttcccccggg

SEQ ID NO: 110380 - DNA, 779 bp, Homo sapiens
  misc_feature: GYAE6OF02HLPQF.10.28.C06.1.454.CMB.1.raw
  modified_base (166)..(166): a, c, t, g, unknown or other
  misc_feature (166)..(166): n is a, c, g, or t
  modified_base (186)..(186): a, c, t, g, unknown or other
  misc_feature (186)..(186): n is a, c, g, or t
  modified_base (226)..(226): a, c, t, g, unknown or other
  misc_feature (226)..(226): n is a, c, g, or t
tcagcatagtagtgcacgaccggtgctcgatttagagctcacgtattgggtttggggagagctctggggagtctgcaccatggcttggaccccactcctcttcctcaccctcctcctccgactgcacagggtctctctcccagcttgtgctgactcaatcgccctntgcctctgcctccctgggancctcggtcgaagctacactctgcactctgagcagtggcanagcaactacgcaatcgacagtgcatcagcagcgacgccaaggacggaacggccctacggtactgagtaggaaaggttaacgaggtgagtggacacgaccgaacgaaccggaaacggggacgacgtccgtaggtagtttcggttttacgacgggttaccacgtcgttcgggtacgggtccgtaggaccgtacccggtacccttaacccccgacgtaaccgtacccgttacccgaaccgtccctacccggtacgttaccgtaacgggtaacggtacgttacgggaaccgggtaccgttacggtaaactttaacgtttacccgttaggtacccgtaaacgggttacccggttaggggtacccttaaacgggtttcggttaacggtttacggggttttccggggttttaccggggggaaccggggtttaaccgggtaacccggtaaccgggttcccgggttaaccggtaaccccgggttttccggttaacgggtacccgggtaacccgtaaccccgggttaacccgggtcccggttacccccggttaaccccccggg

SEQ ID NO: 110381 - DNA, 816 bp, Homo sapiens
  misc_feature: GYAE6OF02GCB0D.10.28.C06.1.454.CMB.1.raw
  modified_base (206)..(206): a, c, t, g, unknown or other
  misc_feature (206)..(206): n is a, c, g, or t
  modified_base (229)..(229): a, c, t, g, unknown or other
  misc_feature (229)..(229): n is a, c, g, or t
  modified_base (374)..(374): a, c, t, g, unknown or other
  misc_feature (374)..(374): n is a, c, g, or t
tcagcatagtagtgcacgaccggtgctcgatttagagctcacgtattgggtttgggggggtctcaggaggcggcgctctcaggacgtcaccaccatggcctgggctctgctcctcctcaccctcctcactcagggcacagggtcctgggcccagtctgccctgactcagccctcctcgcgtccggtctcctggacagtcagtcacntctcctgcatggaaccagcagtnactttgtgctaatactatgtctctggtaccagtccaaccgacccaggccaaacggcccccctaaaattcccgttttagttttacggaggtctaacggtaacgtccgggcctacgaacggtacgtccccgtagacgtttccggttntaccgtcgcccttcaaacggtcgtacgggacaaaccgtccgggtccctacccggttacgtaccccggttcttccggtcggggaccttacccgtacgggtccgttagggaacgggtaccgtgggtacgggtacgttacggtaacgttaccgttaacgtcggtacgtacggtaccgtaccgtaacttaaaccgttttaccgaacccgggtacccgttaaacgggtacgggtttccggggtttaccgggtaccgggggtaccggggttaaccgggttaaaccgggtaccgggtacccgttacccgggttacgggttaccggtacccggtaacccgggtaaccggttacccgggttaaccccgtccccccggttacggttaccccggtaacccgttccccggtttacccggtttcccccggttccccctaccccgtttaacccccg

SEQ ID NO: 110382 - DNA, 853 bp, Homo sapiens
  misc_feature: GYAE6OF02IWXNH.10.28.C06.1.454.CMB.1.raw
  modified_base (143)..(143): a, c, t, g, unknown or other
  misc_feature (143)..(143): n is a, c, g, or t
  modified_base (150)..(150): a, c, t, g, unknown or other
  misc_feature (150)..(150): n is a, c, g, or t
tcagcatagtagtgcacgaccggtgctcgatttagagctcacgtattggggtttggggagagctctggggagtctgcaccatggcttggaccccactcctcttcctcaccctcctcctccactcgcacgaggtctctctcccngcttgtnctgactcaacgtccgccctctcgccctcgtcgccctccgtggggacgtcccgtcggtacaacggtctaccagttcctacgcctaaccttcgaggacgacgtacgggtcggggaccaacgaacgtaccaaacccgtaccggacctaatccgactaagcgacctaagtcaggccacgacgacggacccaagggtaccgggaaccggtccccgttggttaacgttaggtaacggttaaggttaaaacggttaacgaggtgtaaaccgcgggtacaccgtaccgaaccggtaacggggaacggggtcgacctccggttagttcgtttcgttacggacggtcgtcgtcgtcgggacggtcgtacggcgtaccctacctacccgacgtaactcctacccgtacccgtaccgtccgttaccgtacgtcgtaccgggtaaccgtagggaccgttccgttaacgtaccggtttagttttaaccgtaaacggttccggttaaccgaccgggtaccgggttccggttaaaccgggttacggtttttacgggttacccgggtttttgggggtttaccgggggtttaacccgggggacccgggttaaaagggtaaccccctttagggtacccccgggttaaggtttacccccgggttaggtaaccggtttacccccgggaccgtaaacccgggttcccggtccccggtaacccccg

SEQ ID NO: 110383 - DNA, 952 bp, Homo sapiens
  misc_feature: GYAE6OF02H6PB6.10.28.C06.1.454.CMB.1.raw
tcagcatagtagtgcacgaccggtgctcgatttagagctcacgtattggggtttggggggggtctcaggaggcggccctctcgggacgtctccaccatggcctgggctctgctattcctcaccctcctcactcagggcacgagggtcctgggcccagtctcgccctgactcagcctgccttccgtgtcgtcgggtcctcctggaccagtccatccaacctatccgtcctgaccacgtccggaccccacgtattacagttaagtaataagtgaatattcgtctaccgtaggtaaccaactacgtaacccaggaaccaaaccgacccccaaaacttcgtaacgttagtaattttactagtagttgtaccgtaagtaacctaccgtaccccgttacggttacgggtttaccgtagtaccgttccgttaccgtttctttcgtacccgttaaccgtaacggttaccgaggtaaccccaaacggtaccccgtaccccccgttaacccgtacccgtaacccgttacgtcccgttttaccgggtacccgggttacctaaccccggtaacgtaacccgggttaagggtaaaccggggaccggtaacggttacggtttaaacgggttaactttttaaaccgttacgttaacccgtacgtacccgtaaaccgtactaaacccgtaaaagtacccggttaaacgggacccgggttaaccggtacgggggtttaccgggggtttaacggggggttttacccggggtttacccggggggaacccggggggtaaaccccttacccgggaaccgtttaacccggtccccgggtttaaacccgggttacggtaacccggtaaccggttacccccgggtaaaccgggtccccttaccccccgggttaacccccggttccggttacccccttaacccggtttcccccgtttaacccccgttaacccccccg

SEQ ID NO: 110384 - DNA, 805 bp, Homo sapiens
  misc_feature: GYAE6OF02JS0BK.10.28.C06.1.454.CMB.1.raw
  modified_base (171)..(171): a, c, t, g, unknown or other
  misc_feature (171)..(171): n is a, c, g, or t
  modified_base (276)..(276): a, c, t, g, unknown or other
  misc_feature (276)..(276): n is a, c, g, or t
  modified_base (371)..(371): a, c, t, g, unknown or other
  misc_feature (371)..(371): n is a, c, g, or t
  modified_base (559)..(559): a, c, t, g, unknown or other
  misc_feature (559)..(559): n is a, c, g, or t
tcagcatagtagtgcacgaccggtgctcgatttagagctcacgtattgggtttggggagagctctggggagtctgcaccatgcttggacccactcctcttcctcaccctcctcctccactgcacaggtctctctcccagcttgtgctgactcaatccgccctctcgcctcncgtccctcccgtgggacgtccgtcggtacaaagcctctactcgtgccacttccgtggaacgtcgtagggtcgggaccacacggccaaaccgtaccggcccttaanccgcctaagtcggacactaccgacgacgacgtacgacgcgaacggtacgggaaccgggtcccgttacggtagttgaagtaggtaaaggttaacgnggtcgtagcggtacacggtaaccgacggaaccggggtaaacggggacggtactaccggttcggttacgttttaccggtttacgacggttccaggtccgttcgggtcggacgtgaccgtccgtaccctaccgtaccactaaccgttcccgcggtacccgttaccgtaccgtagtccggtaggtaaccgngtacgggtcgtaccgttacgtaacgtttaccggtccgtttaacgggccgttaaccgggtaccgggtacgggtttaccgtttacgggttacgggttttaggttaccggggttttacggggttacccgggacggggggtaaacccgtaccgggttaaacggtccggttaacccgggtttacccggtaaacggtttccgggaaccgggtaacccgtaacccggttcgggttcccccggttaaccccggg

SEQ ID NO: 110385 - DNA, 756 bp, Homo sapiens
  misc_feature: GYAE6OF02I2PYD.10.28.C06.1.454.CMB.1.raw
tcagcatagtagtgcacgaccggtgctcgatttagagctcacgtattgggtttgggggagagctctgggggagtctgcaccatggcttggaccccactcctcttcctcaccctcctcctccactgcacagggtctctctcccagcttgtgctacgactcaactccgccctctcgcctctcgccctccgtgggacgtccgtcggtcaacgctcatctacgcctactcgtagacgcgtagggtcggactaacgaacgaccaaacctaccgccctagtccgacagcggtacactacgacgaccgaacgcaaccggacgaaggaacgggaaccggttcccgttacggttacgtaggtacgtaaggtaaacggttagtaggtaggtacggacgacacgaccgaacggacggggaacgggacgtacctcggtagttcgtttcggttacggacggtcgtacgtcggttgggtacggacgtcgaccgtccggtaccttaccgaccgtaaccgttccgtccctaccgccgtaccctacgacggtaccgtgggacggtacggacggttacgactttacgttaacgttaccgttacgtcgtaaccgggtacggtaaccgggtgtaacgttacggtttacgggttagggttcgggtttaccgggggcgggtacgggtaaccggtacccgttaggtcccgggtaaccggttacccgttacgggtacggaacccggtccggtaacccggtacggtccccgttacccccgg

SEQ ID NO: 110386 - DNA, 775 bp, Homo sapiens
  misc_feature: GYAE6OF02GNE4G.10.28.C06.1.454.CMB.1.raw
  modified_base (330)..(330): a, c, t, g, unknown or other
  misc_feature (330)..(330): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctctcgccctccctggggacgccgtcggtacaagcctcatctgccactctggagcgaggtcggcacacgccaaaccgtacgccagtcgccagtggccatacacgcaagcacgccgaaggacggaacggtcccgtacggtacttggactagaaaggttaacngtagatgggcacgaccgacgaaccggaagggggacgtaccgtccgtagtacggtttcgttttacggacggtaccgagtccgtgggtgggtccgtagaccgtccgtaaccctaccctacctaccacttcccgacctaccggtccctaccggtaccgtagttacgggagttacgtaccgggtagttaccgtacgttaaacgtttaacgtttaaccggttacggtacccgtaaaccgggttaccggggtaccggggttaacgttaccgggttttagggtttaaccgggtttcggggggtttttacccgggtttacggggggaccgggttaaaaccgggtaacccggtaccgggttacccgggtttaaccccgggtaccggttacccggggttaaccggtcccggtaaccccgggaacccgttaccgggtacccccggttccccccggg

SEQ ID NO: 110387 - DNA, 895 bp, Homo sapiens
  misc_feature: GYAE6OF02HZ76O.10.28.C06.1.454.CMB.1.raw
tcagcatagtagtgcacgaccggtgctcgatttagagctcacgtattggggtttggggagagctctggggagtctgcaccatggcttggaccccactcctcttcctcaccctcctcctccactgcacgagggtctctcctcccagcttgtgctgctacaatccgccctctgtcctcgtcgccctcccgtgggacgtccgtcgggtacaagtccttacaacttccgtcgacctacgttccgttaggaacgccgtaggtcgggaccaaccgtagacctaaacgtaccgacctaacgtcgaccacggtcggactacgtacgacgacgacgacgaccgaaccgaaggaacgggacccgggtccccgtaacggttacgttacggtaacgttaacgggtaaaacggttaaacgacggttaggaacggttacgggaccgtaaacccggtaacccggaaaccgggaacccggggaaacgggggtacccggtacctttacccggttacgtttaccgggttttaccgttttaacgggacccgggttaccgtaggttaccgttcgggggttacgggccgtttacggggaccgtaccgttccccgttaacctaacccgttaccgtacttaccccgtacgggtaaccccgtcccgttaacggtacggttacggaacggttaccggtacggtcgggtaaccggttcgttaaaccgtttaccgtttaaccggttaacgggtccttaaccggggaaccgttcccggggtacggttacgttacgggtttttacgttcggtttacggtttacgggggtttaacccggacggtaacggaaccgtttcggtccgtttaacccgccgggttaccgaaccggtccgacccggtaacggcccggttcccgttccccgg

SEQ ID NO: 110388 - DNA, 1027 bp, Homo sapiens
  misc_feature: GYAE6OF02GBIOI.10.28.C06.1.454.CMB.1.raw
  modified_base (188)..(188): a, c, t, g, unknown or other
  misc_feature (188)..(188): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctcccgtggggacncctcggtcaagctcatctgcactctgagcaggtgggcacagaccaacgtaccgccatccgacaagttcggacatacgagacacggcagacccgaaggaacggtaaacggggtccccgttacgggttaccttaggaacgttaacgggtaaaacggttttaaacgacggttaggtaacggtacgggaccgtaaaccggacccgaaaaccgggtaaaccccggggaaaacggggggggtaacccggtaaccgtttacccggttaacggttaacggtttttcccgggtttttaaccgggaaccggggttacccgtaacgggtcccggttaccggggttcgggggtacccgttacgggtaccggtaccccggtttacccggtaaacccccttaccgtaacccccgggttaaaccttccccgtaccccggtacccggttaacccccttacccggttaacggttcccgggttaagggtaaaccggggttaacggttaccggggtaacgggttaccgtttaaaccgggttaaccgttttaacgttaaaccggtttccggtaaccggtaaacccggggtttaccccgggtaaggggggttaacccgtttaaccggggtttttaacggggtttttaacggggttttccggggggtttttaccggggggtttttaccgggggggaaccccgggggttaaaaccgggggtaaccccgggttaaacggggttaccccggttaaccccggggggtttaaccccgggtttaccggttaacccgggggttaaccccggtaaaacccgggttacccggggtaaacccggggttcccccgttaaccccccccggggg

SEQ ID NO: 110389 - DNA, 768 bp, Homo sapiens
  misc_feature: GYAE6OF02JKAL6.10.28.C06.1.454.CMB.1.raw
  modified_base (167)..(167): a, c, t, g, unknown or other
  misc_feature (167)..(167): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacgagggtctctctcccagcttgtgctgactcaatccgccctntcgcctctcgccctcccgtgggacgtcccgtcggtacaatcctcacgtctcgcctacctcgtgacgtcgtaggtcgggaccaacgtacgacctaacctaccgcctacgtccgacgaagtcggacgactcgacgtcgacgtacgaccgaccgaaggaacggaccggggttcccctacggttacttacggtaagtacgggtaaacggttaacgtacggtaggtactacggccgtaaccgacccgaaccgtaaccggggaaggggaccgtacccgtacggtcggttaccgttttccggttaacggtaccggtccgtacgtccggtcgggtgggtccacgggccgtaccggtaccctacctaaccgaccgtacgttcccgactaccggtcccctacggtacggttacggtaagtccggtaaagtcgggaccgttcgtaacgttaacttaccggttacgaccgttacgggaccggtaccgggtcggtaccgttaacggttggttaccgggttgtttaccgggggtcggaacggtaccggtaaccgtcgtacccggttacgtacccggtgtaaccgcgaaacccggtccgtacggtccctacccggg

SEQ ID NO: 110390 - DNA, 743 bp, Homo sapiens
  misc_feature: GYAE6OF02G6B6R.10.28.C06.1.454.CMB.1.raw
  modified_base (216)..(216): a, c, t, g, unknown or other
  misc_feature (216)..(216): n is a, c, g, or t
  modified_base (298)..(298): a, c, t, g, unknown or other
  misc_feature (298)..(298): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctggtctcctggacagtccatcaccatctctncactcgacccacagttacattaggtaataatgaatatgtctcctggtaccaacagtacccagacaaacgccccaaactgatnaatttatgatgtactagtaatccgacctcgtaggggtttctagattcgtctttccgtttcgccctaccgtaacgtcgtacggaccgaaaccgacccggtcctaccccgtagaaccctagttccttacggtcgggacccttaccaacggtacgttacggaacgggtaaccggaggtaccgttaacgtaattttacgttaaccgttggacctacggtcctaccaagtaactaaccgaacgggtccggacgtacggggttaccggggtttggggttcgggttacccgggggggaacggggaaccctaaccggtaccgttcccgggtaacccggttaaccgtccgggggttaacccaaccggtaacccgggtaaccggtcccggtaaccccgggtcccccgttaccggggtcccttaacccgttccgttaaccccgtttaccccccccg

SEQ ID NO: 110391 - DNA, 833 bp, Homo sapiens
  misc_feature: GYAE6OF02JOE2G.10.28.C06.1.454.CMB.1.raw
  modified_base (191)..(191): a, c, t, g, unknown or other
  misc_feature (191)..(191): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatccgccctctgcctcgtgccctcccgtagggacncccgtcggtcaagtctcactctgctactctgagctaggtcggacaacgacgaccaaacgtaccgccagtccgctacgtggacctatcgagcagacgacgccgaaggaacggtaaccgggtcccgtacggttacgtagtaacgtaggtaaacggtttaacgaggttacggacggttacggaccgaaccggacccggtaaccggaaaccggggtaaaccggggggtaaccggtaaccgttacccgtacggtttaaccggttttaccgggtttttaccgggaaccgggttacccgtaacggttccggttaccgggttacggggggtaccgttaccgggaacccgggtacccgttaacccgttaaccccgttaccgtaaaccccgttccgttacccgtaaccgtaacccgttcccgtaaccgtacggttaccgacgggttacgggtaacgtcgggaacgttctaccggtttaactacggttacctaccgtcgaacggtaccgtacgggtaaccggtacgttacgggtttaacggtttccgtttacggggtttcgggttaaccggggacgggtaccggtacgtacggtacccggtcgttacccgttaccgggtacgtaccggtaccggtaccggtaccggtacccgg

SEQ ID NO: 110392 - DNA, 803 bp, Homo sapiens
  misc_feature: GYAE6OF02FKPNW.10.28.C06.1.454.CMB.1.raw
  modified_base (198)..(198): a, c, t, g, unknown or other
  misc_feature (198)..(198): n is a, c, g, or t
  modified_base (337)..(337): a, c, t, g, unknown or other
  misc_feature (337)..(337): n is a, c, g, or t
  modified_base (487)..(487): a, c, t, g, unknown or other
  misc_feature (487)..(487): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctggtctctggacngtccatcaccatctccgtgccagtcggacccacctagttacattggtaaattatagtaatcgtcgttcctccgtaggtaacccaacgtacgtaaccccagggaccaaaacgcccccctaaaagtgactagtattttagngtacgttgtacgtaagttaactcccggtaacccctcggttaacggggttttctacggtacgtttcccgtcgtttttacgtttcccgtacccgttacgtaaacggttccggttacggaacccaaccgtaacccgggtcccctacccgttanacccttcgttccgtcggtacggtccctacacggtacttcgggaacggtacgaggtactgttaacttacgtttacgctacgtacgtctacgtactaacggaaccgaacggtacgggtaccgaggggtttccgggggtttacgggttaccgggggttccggggaaccgggggggtaaccctaccgtaccgggttacccggtacccggtaacccggtttcgggaacccgacccggtacccggtaaccggtccccggttacccgtacccccggttccgggttaaacccctcggtttaccccgtttacccgttaacccccc

SEQ ID NO: 110393 - DNA, 749 bp, Homo sapiens
  misc_feature: GYAE6OF02GF8QU.10.28.C06.1.454.CMB.1.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagtcttgtgctgactcaatccgccctctcgcctctcgccctcccgtgggacnccgtcggtcaagctcatctgctactntgagcaggtggacacacgacaacctaccgccatccgacagtcggacactcacgctagcacgcgaggacggaccgggtcccgtcgttacgtgacgtaggtaaggttaacaggtagacgtggacacgacccgaacgaccggggaacgggtacggacctccggtagttacggttttcggtttacggacggttaccgtaacgtcggtacggggtcacgggcgtccgtacccgttaacccgtcccgaacttctcccgttaccgaccgttccctaccgtacggttcctaagggtacggtacgtaacggtcgtctaccgtaacgtttactttacggtaccggtacgtaaccgggtacccgggtacggttaccgttaacgggtttacggtttacggtttcggggtttcgggggttttaccggggaacgggttaaccggtaacccgggtacgttaccgggtaaccgttaccccggtttcgggtaaccgtacccgggaccgggttaaccctccgggttacccgtcccccgggttaccccgg

SEQ ID NO: 110394 - DNA, 803 bp, Homo sapiens
  misc_feature: GYAE6OF02GNK21.10.28.C06.1.454.CMB.1.raw
  modified_base (190)..(190): a, c, t, g, unknown or other
  misc_feature (190)..(190): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctatctcccagcttgtgctgactcaactcgccctctgcctctcgccctcccgtgggacnccgtcggtcaagctcatctcgcactctgacgcgaggtcgggaccacgacgaccaaaccgtaccgcctacgtccgaccgtagtcggacctacgtacacggaccacggccgaacggacccgaaggaaccggggtaacccgggtccccgttacgggttacttaggaagttaacggtaaacggttaaacgtaggtaggtaacgtacgggacacgaacccgaacggaaccggggaacggggtacccggtaccgttaccgtagtacgttttcggtttacggaccgggtacgtacgtccggttcgggtacgggtccgtacggacggtcccgtacctaccgtaccaccgtaccttcccgtaccgtaccggtaccctccgtacggtaccgtagggacgtagttcggacgttacttacggtaactttcgtacgttacggtaccgaacggttacccgggtgggttaaccttaggttttaagggttacgttttaccggggtttcggggtttaacccggggacggggtaaaccggtacccggttaaccggtcccgttaaccgggtaccccggttacgttaccgggacccgtaacggtaccccgggtacggttccccgttaccccgg

SEQ ID NO: 110395 - DNA, 918 bp, Homo sapiens
  misc_feature: GYAE6OF02F7B7T.10.28.C06.1.454.CMB.1.raw
  modified_base (147)..(147): a, c, t, g, unknown or other
  misc_feature (147)..(147): n is a, c, g, or t
  modified_base (166)..(166): a, c, t, g, unknown or other
  misc_feature (166)..(166): n is a, c, g, or t
  modified_base (189)..(189): a, c, t, g, unknown or other
  misc_feature (189)..(189): n is a, c, g, or t
  modified_base (207)..(207): a, c, t, g, unknown or other
  misc_feature (207)..(207): n is a, c, g, or t
  modified_base (240)..(240): a, c, t, g, unknown or other
  misc_feature (240)..(240): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacagggtctctctcccagcttgngctgactcaatccgccctntgcctcgcgccctccgtgggacncctcggtcaagctcatcncgcactctgacgcaggtggcacagacaacgtcnctatcgcagtgcagtccagctacgcgacgacccaggacggtaaaccgggtccccgttacggtaccgttagtaacgtaggtaaaacgggttaaccgtggtaagtacgtcgggacctaacggacccaacggtaaaccggtaaggggggaccgtaccgtcccgttaggtaacgttttccggtttacggtacgggtacctacggtcgttcgggtgggtccgtagaccggtccgtaaacctcccgtaacgaccgtaactcccgtaccgtaacgttcccctaaccgtaaccggtttacggtacggtaaacggttactaaccgggggtactttaccggttaacgggttaaaccgtttttacccggttaaacggtttacccgggttaaaacccgttacccgggggttaccccgggggttaacggggtttaaccccgttttacggggttttttaaaacccgggtcgggggttttttaccgggggtttttcccggggggttaaaccgggggtaaccgggggttttaaaccccgggggaaaaccgtttttaacccgggggtacccgggttttaaacccccggggtttaaaccccgggttttcccgggaaaccgggggtttaaccccgggaaccccggggttaaacccccggtttaccccggggttaacccccggttacccccccccggg

SEQ ID NO: 110396 - DNA, 781 bp, Homo sapiens
  misc_feature: GYAE6OF02FWA0X.10.28.C06.1.454.CMB.1.raw
tcagcatagtagtgcacgaccggtgctcgatttagagctcacgtattgggtttgggggggggtctcaggaggcggccctctcgggacgtctccaccatggcctgggctctgctattcctcaccctcctcactcagggcacgagggtcctcgggccctgtctcggccctgactcacgcctgcctccgtgtctgggtcctcgtggacaggtccgtcacctatcctctgaccacgtcgacccagacacgtgagttggttcgggactaactttaacttaacccgttcggtccttccgttacggttaactaccaaaccgaaacccgtacccaagaaacccgtaaacccgacccccctaactaccttccgtttacgtaagtttttaacgaggttaacggtacctaaacggtaacgggacccgggtaccccgttcggttaaacgggggttttacctaccggttcggtcctttcgtacgttccgttacccgtactacgtccgtacggacgtaaccgtaccggtcctttcccgactaccctacgttccggtcccgggtactccgacgtcggtcggaacggacggacgttacgtacgtactttactcgtacgcgtaccgtactctaacgtacctaccggacccggtacgggacctacggttccgtaggttacgacgttccggtaccggacgggtacgggtcctagggtactaccggtcgttaccgtacgtaaccgaccgtaacccggtacggtaccctcccggtacccgtcccgttcctcgtttaccccgg

SEQ ID NO: 110397 - DNA, 765 bp, Homo sapiens
  misc_feature: GYAE6OF02HNV4J.10.28.C06.1.454.CMB.1.raw
  modified_base (146)..(146): a, c, t, g, unknown or other
  misc_feature (146)..(146): n is a, c, g, or t
tcagcatagtagtgcacgaccggtgctcgatttagagctcacgtattgggtttggggagagctctggggagtctgcaccatggcttggaccccactcctcttcctcaccctcctcctccactgcacaggtctctctccagcttgtnctgactacaactccgccctctcgcctctcgccctccgtgggacgccgtcggtacaacgctcactcgtcgacctacgtcgagacgcgtaggtcggacaacgacgacctaactaccgacacgtaccggactacgtcggactaacgtacgaacgacgacgaccgaacgaaccggaaaggaccgggtaaccgggccccgttacggttaacgttaggaacggttaacggttaaacggtaacggtaggtacggtaacggtacggaccgaaccgtaccggaaaccggaaaccggggtaaacgggggtaccgtaaccgttacccggtaacggttacggtttttaccgtttacgggtaccggtaccgtacgtaccggttccgggtcgggtacgtacgggtaccggtacccgtacccgtacccgtacccgtacgtacctcccgtacgtaccgtaccgtacgtacgtcggtaacgacggtagttcggacgtacgtacttacttagtacgtcgtacggaccgtcggtcggtactacggttagttcgtttgggttcggtacgggtacgggtacgtaccggcgtaccgtaccggtaccgtacgcgaaccggtccgaaccgcgtacccgtccgg

SEQ ID NO: 110398 - DNA, 773 bp, Homo sapiens
  misc_feature: GYAE6OF02H0EVR.10.28.C06.1.454.CMB.1.raw
  modified_base (582)..(582): a, c, t, g, unknown or other
  misc_feature (582)..(582): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcgagggcacgacgggtcctcgggcccagttctcgccctgacctcagcctcgccctcgtgtcgtgggtcctccgtggactgtacctatccacctatcctcctgactacgtaccggacccctactagttactagttaaggttaaataatagtaaattcgttcgtccttaccgtacgtaaccaactacggtaaccgaggaaccgtaaacccgaccccctaaagtacgtattagttactttaagtagtacgtagtaacgaacgttaccgtccgtacccgttaggttacgggttctgtaccgtcgttctttaccgttcgtcccgtacgtacgtcgtacggaaccgtaaccggtcccgtccccgtaccgtaccgacctacgttccgtcggtccggtaccgaccacggtaacgtcggaagggtacgagtcgtagttacttaagtcgtacggactacnccgttaacacgtaacgaacgtaccggacggtacgtcgggttccgggttgggtttacgggcccgggggacggaaccctacgtaccggtacccgtaccggtacggtaccgtaccgggaacaacccgggttaccggcccgtttcccggaccccggttcgtaaccccgttcgttacccgtaccccgttacccccc

SEQ ID NO: 110399 - DNA, 404 bp, Homo sapiens
  misc_feature: GYAE6OF01AVE7D.1.64.F09.1.454.CMB.1.raw
  modified_base (402)..(404): a, c, t, g, unknown or other
  misc_feature (402)..(404): n is a, c, g, or t
tcagacgagtgcgtcacgaccggtgctcgatttagcgcgtatacaaagggaaagagccaccctctcctgcagggccagtcagagtgttaggagcaagttagcctggtaccagcagaaacctggccaggctcccagactcctcatctatcttgcatccaccagggccactggtatccccgccaggttcagtggcagtgggtctgggacagagttcactctcaccatcagcagcctgcagtctgaagactttgcagtttattactgtcagcagtataatgactggcctccgggtttggccaggggaccaagctggagatcaaaacgaactgtggctgcaccatctgtcttcatcttcccgccatctgaacgcactcgtctgagcgggctggcaaggcgcatagnnn

SEQ ID NO: 110400 - DNA, 409 bp, Homo sapiens
  misc_feature: GYAE6OF01CBWQ9.1.64.F09.1.454.CMB.1.raw
  modified_base (402)..(409): a, c, t, g, unknown or other
  misc_feature (402)..(409): n is a, c, g, or t
tcagacgagtgcgtcacgaccggtgctcgatttagcgcgtatacaaagggaaagggccaccctctcctgcagggccagtcagagtgttaggagcaagttagcctggtaccagcagaaacctggccaggctcccagactcctcatctatcttgcatccaccagggccactggtatccccgccaggttcagtggcagtgggtctgggacagagttcactctcaccatcagcagcctgcagtctgaagactttgcagtttattactgtcagcagtataatgactggcctccggggtttggccgaggggaccaagctggagatcgaaacgactgtggctgcacatctgtcttcatccttcccgcatctgaacgcactcgtctggagcgggctggcaggcgcatagnnnnnnnn

SEQ ID NO: 110401 - DNA, 458 bp, Homo sapiens
  misc_feature: GYAE6OF01CQGFE.1.64.F09.1.454.CMB.1.raw
  modified_base (441)..(458): a, c, t, g, unknown or other
  misc_feature (441)..(458): n is a, c, g, or t
tcagacgagtgcgtcacgaccggtgctcgatttagcgcgtatacaaagggaaagggccaccctctcctgcagggccagtcagagtgttaggagcaagttagccgtggtaccagcagaaacctggccaggctcccagactcctcatctatcttgcatccaccagggccacgtggtactccccgcaggttcagtggcagtgggtctgggacagagttcactctcaccatcagcagcctgcagtctgaagtctttgctagttttatactgtcagctagtataatgactggccgttcgggttgccgtacgggaccaaggcgtggagatacgaaacgacgtgtaggctcgacacctattctgttccttacacttccttccccgactatacgtagaaccgcctacgtcgtcgtaggacggcggtacgtcggacgaaggcgcaatcgnnnnnnnnnnnnnnnnnn

SEQ ID NO: 110402 - DNA, 401 bp, Homo sapiens
  misc_feature: GYAE6OF02I3006.1.64.F09.1.454.CMB.1.raw
  modified_base (390)..(390): a, c, t, g, unknown or other
  misc_feature (390)..(390): n is a, c, g, or t
  modified_base (395)..(401): a, c, t, g, unknown or other
  misc_feature (395)..(401): n is a, c, g, or t
tcagacgagtgcgtcacgaccggtgctcgatttagcgcgtatacaaagggaaagagccaccctctcctgcagggccagtcagagtgttaggagcaagttagcctggtaccagcagaaacctggccaggctcccagactcctcatctatcttgcatccaccagggccactggtatccccgccaggttcagtggcagtgggtctgggacagagttcactctcaccatcagcagcctgcagtctgaagactttgcagtttattactgtcagcagtataatgactggcctcggggttgccagggaccaagctggagatcaaacgactgtggctgcacatctgtcttcatcttcccaccctcctcacgcactcgtctgagcgggctggcaaggcncatgnnnnnnn

SEQ ID NO: 110403 - DNA, 424 bp, Homo sapiens
  misc_feature: GYAE6OF02IPCHH.1.64.F09.1.454.CMB.1.raw
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
  modified_base (407)..(424): a, c, t, g, unknown or other
  misc_feature (407)..(424): n is a, c, g, or t
tcagacgagtgcgtcacgaccggtgctcgatttagcgcgtatacaaagggaaagagccaccctctcctgcagggccagtcagagtgttaggagcaagttagcctggtaccagcagaaacctggccaggctcccagactcctcatctatcttacatccaccagggccactggtatccccgcaggttcagtggcagtgggtctgggacagagttcactctcaccatcagcagtcctgcagtctgaagtctttgcagttttatactgtcagcagtataatgactggcctcgggtttgccagggaccaagctgganatcaaaacgactgtggctgcaccatctgtcttnattcttcccgcccttcctcaccgctactcgtactgacgcggctggctaaaggcgacatagcnnnnnnnnnnnnnnnnnn

SEQ ID NO: 110404 - DNA, 412 bp, Homo sapiens
  misc_feature: GYAE6OF02IHNMK.1.64.F09.1.454.CMB.1.raw
  modified_base (372)..(372): a, c, t, g, unknown or other
  misc_feature (372)..(372): n is a, c, g, or t
  modified_base (403)..(412): a, c, t, g, unknown or other
  misc_feature (403)..(412): n is a, c, g, or t
tcagacgagtgcgtcacgaccggtgctcgatttagcgcgtatacaaagggaaagagccaccctctcctgcagggccagtcagagtgttaggagcaagttagcctggtaccagcagaaacctggccaggctcccagactcctcatctatcttgcatccaccagggccactggtatccccgcaggttcagtggcagtgggtctgggacagagttcactctcaccatcaccagtctgcagtctgaagattttgctagtttattactgtcagcagtataatgactggcctccgatcaccttcggccaagggcagactggatattagacgaactgtggctgcaccatctgtcttcatcttcccaccctcctcacgcnctcgtctgagcgggctggcaaggcgcatagnnnnnnnnnn

SEQ ID NO: 110405 - DNA, 525 bp, Homo sapiens
  misc_feature: GYAE6OF02JCNFK.1.64.F09.1.454.CMB.1.raw
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
  modified_base (332)..(332): a, c, t, g, unknown or other
  misc_feature (332)..(332): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
tcagacgagtgcgtcacgaccggtgctcgatttagcgcgtatacaaagggaaagagccaccctctcctgcagggccagtcagagtgttaggagcaagttagcctggtaccagcagaaacctggccaggctcccagactcctcatctatcttgcatccaccagggccactggtatccccgccaggttcagtggcaggtggtctgggacagagttcactctcaccatcagcagcctgcagtctgaagtcttgactagtttattactcgtacagcagtataatgactggaccttcgggttgcagggacaggntggacngtanaacgatgtgctcncaccatctgtactctatccctaccaccctcctcaccgctactcgtactcgacggtacggtctacggacgaacggcgtacaagtacggactagtcganactacganacaganactactananacgtacgtacacgtacacatacgtagtatacgacgacgtacgtagacgtacgtacgactactacgagtaacg

SEQ ID NO: 110406 - DNA, 559 bp, Homo sapiens
  misc_feature: GYAE6OF01C5MVG.15.8.A08.1.454.CMB.1.raw
  modified_base (259)..(259): a, c, t, g, unknown or other
  misc_feature (259)..(259): n is a, c, g, or t
  modified_base (347)..(347): a, c, t, g, unknown or other
  misc_feature (347)..(347): n is a, c, g, or t
  modified_base (377)..(377): a, c, t, g, unknown or other
  misc_feature (377)..(377): n is a, c, g, or t
tcagtctacgtagccacgaccggtgctcgatttagcatactctacagggtcttcgtggctcacgtccaccaccacgcatgtgacctcaggggtccctgagactctcctgtgccgcctctggagcagagtctgaattcaccttcatgcactttgccatgagctgggtccgccaggctccggggaaggggctggagtgcgtcggcatgtataactaaaaggtggaagacatcacactctacgcagactccgtgaagggccncttcaccatctccagagacaaatccaaagaacacgctgtccctggagatgaacagcctgagagccgaggacacggtccaatttatacngtgacgaaagagtagtcggggaataattancgaagaatactatttagactcgtgggctagggacgccgtcgtcgacgtcgtcctcacgcctccaaccgaacggcccacgtccgtccttcccccgtcggtaccctacccgtcctaccgaacgaccgacaccgtcgtcggggcacgacgccggacccgtcgggactgccgtggtcgtaaaccgg

SEQ ID NO: 110407 - DNA, 594 bp, Homo sapiens
  misc_feature: GYAE6OF01EJLUA.15.8.A08.1.454.CMB.1.raw
  modified_base (312)..(312): a, c, t, g, unknown or other
  misc_feature (312)..(312): n is a, c, g, or t
  modified_base (555)..(555): a, c, t, g, unknown or other
  misc_feature (555)..(555): n is a, c, g, or t
tcagtctacgtagccacgaccggtgctcgatttagcatactctacagggtcttcgtggctcacgtccaccaccacgcatgtgacctcaggggtccctgagactctcctgtgccgcctctggagcagagtctgaattcaccttcatgcactttgccatgagctgggtccgccaggcgtccggggaaggggctggagtgcgtcgcatgtaataaactaaaagtggagacatcacactctacgcagactccgtgaaggccgcttcaccatctccagagacaactccaagaacacgctgtcccgtggagatgaacngcctgagagccgaggacacggcctattatactgtgacgaaagataggttcgggaataagttatacgagtaattacttatttagacttcgtggggaccgagggacgtcccgtggtccgaccgttacctccgtccaccgtccctaccgaacccgaacgggcccctacgtacccggttcccttcccccgtcggtccctacccgtaccctaccgaacgtaccgcctacccgtcgggtcggggacacncggcccggacccgtgggcctacgccgtgtcgtaaaccgg

SEQ ID NO: 110408 - DNA, 566 bp, Homo sapiens
  misc_feature: GYAE6OF01BNL8F.15.8.A08.1.454.CMB.1.raw
  modified_base (366)..(366): a, c, t, g, unknown or other
  misc_feature (366)..(366): n is a, c, g, or t
  modified_base (497)..(497): a, c, t, g, unknown or other
  misc_feature (497)..(497): n is a, c, g, or t
  modified_base (504)..(504): a, c, t, g, unknown or other
  misc_feature (504)..(504): n is a, c, g, or t
  modified_base (512)..(512): a, c, t, g, unknown or other
  misc_feature (512)..(512): n is a, c, g, or t
  modified_base (532)..(532): a, c, t, g, unknown or other
  misc_feature (532)..(532): n is a, c, g, or t
tcagtctacgtagccacgaccggtgctcgatttagcatactctacagggtcttcgtggctcacgtccaccaccacgcatgtgacctcaggggtccctgagactctcctgtgccgcctctggagcagagtctgaattcaccttcatgcactttgccatgagctgggtccgccaggctccggggaaggggctggagtgcgtcgcatgtataaactaaaagtggagacatcacactctacgcagactccgtgaagggccgcttcaccatctccagagacaactccaagaacacgctcgtccctggagatcggaaacacgcctggacgagccggaggacacggcctaatttacttactgtagacgaaagntagggttacggggattaattagtacgaagtaatacttatttagtactccgtcgggccgagggcgtcccgtggtcaccgtctcctcacgcctccgaccgacggcccacgtccgtcccttccccgtcggtccnccctccnccacgacnccgtaccgtcggtggggccncgacgccggccctcgggctgcctggtcgtaacgg

SEQ ID NO: 110409 - DNA, 712 bp, Homo sapiens
  misc_feature: GYAE6OF01BR9GV.15.8.A08.1.454.CMB.1.raw
  modified_base (265)..(265): a, c, t, g, unknown or other
  misc_feature (265)..(265): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
tcagtctacgtagccacgaccggtgctcgatttagcatactctacagggtcttcgtggctcacgtccaccaccacgcatgtgacctcaggggtccctgagactctcctgtgccgcctctggagcagagtctgaattcaccttcatgcactttgccatgagcgtgggtccgccaggccgtccgggggaaggggctggagtgcgtcgcatgtaataaactaaaagtggaagacatcacactctacgcagacctcgtggaacgggccncttccaccatcctacagacacaactccaanacncgctctccgngganatcgaacncgcgtagagacgccggaggaccaccggcttaatttacgtactggtacggacgtaaagtacggttagggttacggggaagttaaacgtttaagacggtaagtaacgtttaactttagttttacgtaccgtcccgggttaggggacccggtacggggaaccgtcccggttcgggtacccgtcccgttccgttccgtaccgtaccgtccccctaaccgaacccggaaccgggtccccgtaccggttcccgttccccccgtttcccccgccggtaccccctaccccgttcccgtaaccgaaccgtaccgacccgtaaccccgggtcgggtaaccgggccgtaccggaccggcccgggtacccgtcgggctaccggtccgtcggtaccggtaaccgg

SEQ ID NO: 110410 - DNA, 681 bp, Homo sapiens
  misc_feature: GYAE6OF01EB8OP.15.8.A08.1.454.CMB.1.raw
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
tcagtctacgtagccacgaccggtgctcgatttagcatactctacagggtcttcgtggctcacgtccaccaccacgcatgtgacctcaggggtccctgagactctcctgtgccgcctctggagcagagtctgaattcaccttcatgcactttgccatgagctggtccgcaggcgtccggggaagggctggagtgcgtcgcatgtataactaaagtggagacatcacactctacgcagactcgtgaacgggccgcttcaccatctccagacgacaacctccaagaacncgctcgtccccngganagtcgaacagcctgagacgccgaggacacggctatttatcgtgcgaacgaagattagggtcgggtaataattagtacgaagtaattactttagttttacgacgttccggtacggggaccgtaggggtaccgtcccggttagggtaccctaccccggttccttacccgtaccgtaccgtccccgtaacccaaccggaacccgggtaccccctacgttaccccgggttcccctttccccccggtcggacccctacccccttcccgtaaccccgtagaccgtaccctaccccgttccgggtaccgggggacccaaccggaccgggccccgggtacccggtcggggtacctccgggttcccggtacggtccgtaaacccggg

SEQ ID NO: 110411 - DNA, 341 bp, Homo sapiens
  misc_feature: GYAE6OF01BLENW.7.14.B03.1.454.CMB.1.raw
  modified_base (338)..(341): a, c, t, g, unknown or other
  misc_feature (338)..(341): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttccccctggcaccctcctccaagagcacctctgggggcacagcggccctgggctgcctggtcaaggactacttcctagagacacgctgagcgggctggcaaggcgcatagnnnn

SEQ ID NO: 110412 - DNA, 361 bp, Homo sapiens
  misc_feature: GYAE6OF01BLKJP.7.14.B03.1.454.CMB.1.raw
  modified_base (338)..(339): a, c, t, g, unknown or other
  misc_feature (338)..(339): n is a, c, g, or t
  modified_base (341)..(361): a, c, t, g, unknown or other
  misc_feature (341)..(361): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttccccctggcaccctcctccaagagcacctctgggggcacagcggccctgggctgcctggtcaaggactacttcctagagacacgctgagcgggctggcaaggcgcatagnngnnnnnnnnnnnnnnnnnnnnn

SEQ ID NO: 110413 - DNA, 338 bp, Homo sapiens
  misc_feature: GYAE6OF01CR5H0.7.14.B03.1.454.CMB.1.raw
  modified_base (335)..(338): a, c, t, g, unknown or other
  misc_feature (335)..(338): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggcccatcggtcttccccctggcaccctcctccaagagcacctctgggggcacagcggcctgggctgcctggtcaaggactactcctagagacacgctgagcgggctggcaaggcgcatagnnnn

SEQ ID NO: 110414 - DNA, 342 bp, Homo sapiens
  misc_feature: GYAE6OF01B65QJ.7.14.B03.1.454.CMB.1.raw
  modified_base (338)..(342): a, c, t, g, unknown or other
  misc_feature (338)..(342): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttccccctggcaccctcctccaagagcacctctgggggcacagcggccctgggctgcctggtcaaggactacttcctagagacacgctgagcgggctggcaaggcgcatagnnnnn

SEQ ID NO: 110415 - DNA, 346 bp, Homo sapiens
  misc_feature: GYAE6OF01B6PWQ.7.14.B03.1.454.CMB.1.raw
  modified_base (338)..(346): a, c, t, g, unknown or other
  misc_feature (338)..(346): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttccccctggcaccctcctccaagagcacctctgggggcacagcggccctgggctgcctggtcaaggactacttcctagagacacgctgagcgggctggcaaggcgcatagnnnnnnnnn

SEQ ID NO: 110416 - DNA, 371 bp, Homo sapiens
  misc_feature: GYAE6OF01BFD48.7.14.B03.1.454.CMB.1.raw
  modified_base (349)..(371): a, c, t, g, unknown or other
  misc_feature (349)..(371): n is a, c, g, or t
tcagcgtgtctctacacgaccggtgctcgatttagtgtgagtagtttgggtttgtcgttctccatggatacctctgtcgggacggcttatctgcagataaccaaccttcaacctgacgacactgccgtttatttttgtacgagagtcttcgtctgtcagttggaattgactacttggggccaggggaaccctggtcaccgtctcctcagcctccaccaagggcccagtcggtcttccccctggcaccctcctccaacgagcacctctggggcacagcggccctgggctgccctggtcaaggactacttcctagagacacgctgagcgggctgggcaaggcgcgataggnnnnnnnnnnnnnnnnnnnnnnn

SEQ ID NO: 110417 - DNA, 342 bp, Homo sapiens; identical to SEQ ID NO: 110414
  misc_feature: GYAE6OF01BTVRB.7.14.B03.1.454.CMB.1.raw
  modified_base (338)..(342): a, c, t, g, unknown or other
  misc_feature (338)..(342): n is a, c, g, or t

SEQ ID NO: 110418 - DNA, 344 bp, Homo sapiens
  misc_feature: GYAE6OF01ANYWT.7.14.B03.1.454.CMB.1.raw
  modified_base (338)..(344): a, c, t, g, unknown or other
  misc_feature (338)..(344): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttccccctggcaccctcctccaagagcacctctgggggcacagcggccctgggctgcctggtcaaggactacttcctagagacacgctgagcgggctggcaaggcgcatagnnnnnnn

SEQ ID NO: 110419 - DNA, 341 bp, Homo sapiens
  misc_feature: GYAE6OF01D1X34.7.14.B03.1.454.CMB.1.raw
  modified_base (336)..(341): a, c, t, g, unknown or other
  misc_feature (336)..(341): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtccttccccctggcaccctcctccaagagcacctctgggggcacagcggcctggctgcctggtcaaggctacttcctagagacacgctgagcgggctggcaaggcgcatagnnnnnn

SEQ ID NO: 110420 - DNA, 343 bp, Homo sapiens
  misc_feature: GYAE6OF01AWOUF.7.14.B03.1.454.CMB.1.raw
  modified_base (336)..(343): a, c, t, g, unknown or other
  misc_feature (336)..(343): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggcccatcgtcttccccctgcaccctcctccaagagcacctctggggcacagcggccctgggctgcctggtcaaggactacttcctagagacacgctgagcgggctggcaaggcgcaatagnnnnnnnn

SEQ ID NO: 110421 - DNA, 344 bp, Homo sapiens; identical to SEQ ID NO: 110418
  misc_feature: GYAE6OF01EC7WP.7.14.B03.1.454.CMB.1.raw
  modified_base (338)..(344): a, c, t, g, unknown or other
  misc_feature (338)..(344): n is a, c, g, or t

SEQ ID NO: 110422 - DNA, 886 bp, Homo sapiens
  misc_feature: GYAE6OF01DAQV4.7.14.B03.1.454.CMB.1.raw
tcagcgtgtctctacacgaccggtgctcgatttagtgtgagtagttagggttaggggacccaacaaccgacaccctcctaagtaagaagccctagaccacgaaggctccacgaccagtggacctggaccctggaggattccctcgttcttggtgtcagtagcaacaggtcgcccactacccaggtgcgagctaggtacaggtctgggtctgaattgagtacgtcgtgggacttagagtcgagcgtgactgcaagtctgagatacgagtcttgactacgttacttcgtgtcgtaacgttcgggtaccgaccgtacggtcccccgttggaccgaacggtcccgttacgtaaccgttacgaagttcggggtaatgggtacgttcgaaacctaccggtaactaccgtacgggaaacccccaccgtacgtcggaccccgtacggtacccgttccggaaacggacggggttcggtttcggtacgttccggttaccctaggttacggtaacttacccggttacgtacgggttaccggggtacggttaccgttaacttacccggttaggaccgtaaccggtaaccgttaaaccctaacccgttttaccggaaacccggttacgggtaacccgtaaccgtacccgtaccggttttaacccggtttttaacttttttaccggaaccgggtaaacggttaaccgtaacccgggttacccgttacgttaacccggttacccgttaaggtttacggtaaaacgtttccgggtaaaaccttacgggttaaccggggacccgttaaaccgggggtaccccttagggtaccctaaaccgggttccgtacccgttaaccgacccggttacccctaccccgtaacccgtaacgggttacccccg

SEQ ID NO: 110423 - DNA, 369 bp, Homo sapiens
  misc_feature: GYAE6OF01CLUX6.7.14.B03.1.454.CMB.1.raw
  modified_base (276)..(276): a, c, t, g, unknown or other
  misc_feature (276)..(276): n is a, c, g, or t
  modified_base (349)..(369): a, c, t, g, unknown or other
  misc_feature (349)..(369): n is a, c, g, or t
tcagcgtgtctctacacgaccggtgctcgatttagtgtgagtagtttggggtttgtcttctccatggatacctctggtcgggacggcttatcctgcagataaccaacctttcaacctgacgacactgccttttatttttgtacgagagcgtcgtctgtcagtggaattgactactggggccagggaacccctggtcaccgtctcctcagcctccaccaagggcccatcggtccttccccctggcaccctcctccaagagcacctcgtgggggcacngcggccctggggctgcctggtcaaggacctacttcctagagcaacgctgacgcggctggcaaggcgcatacgnnnnnnnnnnnnnnnnnnnnn

SEQ ID NO: 110424 - DNA, 378 bp, Homo sapiens
  misc_feature: GYAE6OF01C7407.7.14.B03.1.454.CMB.1.raw
  modified_base (368)..(378): a, c, t, g, unknown or other
  misc_feature (368)..(378): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccacccaaagggcccacgtccggtccttccccctggccaccctcctaccaagcgccaccctcgtcgggggccacgacggccggccgtcgggctcgcccgtggtccgaaggtacctacttcctaagagaccacgctggacgcgggctggcaaggcgacatagnnnnnnnnnnn

SEQ ID NO: 110425 - DNA, 341 bp, Homo sapiens; identical to SEQ ID NO: 110411
  misc_feature: GYAE6OF01B84AF.7.14.B03.1.454.CMB.1.raw
  modified_base (338)..(341): a, c, t, g, unknown or other
  misc_feature (338)..(341): n is a, c, g, or t

SEQ ID NO: 110426 - DNA, 343 bp, Homo sapiens
  misc_feature: GYAE6OF01DLHDX.7.14.B03.1.454.CMB.1.raw
  modified_base (337)..(343): a, c, t, g, unknown or other
  misc_feature (337)..(343): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttccccctggcaccctcctccaagagcacctctgggggcacagcggcctgggctgcctggtcaaggactacttcctagagacacgctgagcgggctggcaaggcgcatagnnnnnnn

SEQ ID NO: 110427 - DNA, 347 bp, Homo sapiens
  misc_feature: GYAE6OF01DL104.7.14.B03.1.454.CMB.1.raw
  modified_base (334)..(347): a, c, t, g, unknown or other
  misc_feature (334)..(347): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctctcagcctccaccaagggtccatcggtcttccccctggcaccctcctccaagagcactcgtggggcacagcggcctggctgcctggtcaaggactatcctagagacacgctgagcggctggacaaggcgcaatagnnnnnnnnnnnnnn

SEQ ID NO: 110428 - DNA, 359 bp, Homo sapiens
  misc_feature: GYAE6OF01DDGUD.7.14.B03.1.454.CMB.1.raw
  modified_base (352)..(359): a, c, t, g, unknown or other
  misc_feature (352)..(359): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtccttccccctggccaccctcctccaagacgccacctcgtgggggcacgagccggcctgggctcgccgtggtacaaggcttactccgtagacgacacgctggacggcgggctggcgaaggcgcatagnnnnnnnn

SEQ ID NO: 110429 - DNA, 343 bp, Homo sapiens
  misc_feature: GYAE6OF01EI0IU.7.14.B03.1.454.CMB.1.raw
  modified_base (338)..(343): a, c, t, g, unknown or other
  misc_feature (338)..(343): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttccccctggcaccctcctccaagagcacctctggggcacagcggccctgggctgcctggtcaaggactacttcctagagacacgctgagcgggctggcaaggcgcatagnnnnnn

SEQ ID NO: 110430 - DNA, 539 bp, Homo sapiens
  misc_feature: GYAE6OF01EZ95M.7.14.B03.1.454.CMB.1.raw
  modified_base (165)..(165): a, c, t, g, unknown or other
  misc_feature (165)..(165): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (481)..(485): a, c, t, g, unknown or other
  misc_feature (481)..(485): n is a, c, g, or t
  modified_base (487)..(539): a, c, t, g, unknown or other
  misc_feature (487)..(539): n is a, c, g, or t
tcagcgtgtctctacacgaccggtgctcgattttagtgtgagtagttttggggttttgtctttctccatggataccctctgtcggggacggcttatctgcagataacccaaccttcaacctgacgacactgccgttttatttttgtacgagagcgtcgtctgtcngtggaattgactacgtggggccagggaccctggccaccgtctcctcagccctccaccaacgggccccagtccggttccctttccccccgtgggccctacccccttccctaccgaaacgacgaccctacccgtcggtcggggggccacggaccggcccgggccccgtcgggtccgtccggtccggtacgggtaaccgaacggttaccttaccgttaccggtaaggaccgtaaccgtaccggtcggtagggacggggtccggggtacggtacgggaaccggaacgggccgtaacgtaagtcgcgncgcnagcngnagnnnnncnnnnnnnnnnnnnnnnnnnnnnnnnnnnnnnnnnnnnnnnnnnnnnnnnnnnn

SEQ ID NO: 110431 - DNA, 359 bp, Homo sapiens
  misc_feature: GYAE6OF01DV6OW.7.14.B03.1.454.CMB.1.raw
  modified_base (95)..(95): a, c, t, g, unknown or other
  misc_feature (95)..(95): n is a, c, g, or t
  modified_base (348)..(359): a, c, t, g, unknown or other
  misc_feature (348)..(359): n is a, c, g, or t
tcagcgtgtctctacacgaccggtgctcgatttagtgtgagtagtttgggtttgtcttctccatggatacctctgtcgggacggcttatctgcanaggggtaaccaaccttcaacctgacgacactgccgtttattttgtacgagagcgtcgtctgtcagtggaattgactactggggccagggaaccctggtcaccgtctcctcagcctccaccaagggcccatcggtccttccccctggccaccctcctccaagacgccacctcgtgggggccacgagcggccctgggctgcctggtcaaggactacttcctagagacacgctgagcgggctggcaaggcgcatgnnnnnnnnnnnn

SEQ ID NO: 110432 - DNA, 767 bp, Homo sapiens
  misc_feature: GYAE6OF01BBDZ7.7.14.B03.1.454.CMB.1.raw
  modified_base (105)..(105): a, c, t, g, unknown or other
  misc_feature (105)..(105): n is a, c, g, or t
tcagcgtgtctctacacgaccggtgctcgatttagtgtgagtagtttgggtttaggggacccaacaaccacacccctcctaagaacgaacgcccctagaccacanctccacaccagtggactggaccgtggaggatcctcttcttggtggcagtagcaacaggtcgcccactcccaggtgcagctaggtacagtcgtgggtctgaattgaggagccgtggggcgtgagtgagcgttgcctgacaagccttacgtggaactactatcttcacttactttattcgtgtactaagttcggtaccacgtaccgtccccgtggaacgtaacggtccttcgacctacgagtagggatggtactaccgaaccgtaccgacgaccggtaccgggtaaacccccaccgttagtcccgcccgtaaccggtcccgttaaccgacggtacgggttcggtttcgttccttaccgtaccgtagtacgtacttaccgtcgtcggtccggggacgttcttacgtcgtagactaacgtaaccttaaccctaaccttccgaaaccgtcgtaaccaccgtactttccgtttacgtttttagtttaccggaacgtaggtacgtccgttacgttcgtacgtacggttaaggtagttaacgttcggtacccgtaggtaccggggtacccgtaacgggttaccccggtacggtccccgttaaccgggttccctaccccgttacggacccctacccggtaccccccgtaaaacgggtccccgggtaacccc

SEQ ID NO: 110433 - DNA, 342 bp, Homo sapiens
  misc_feature: GYAE6OF02JBPFJ.7.14.B03.1.454.CMB.1.raw
  modified_base (337)..(342): a, c, t, g, unknown or other
  misc_feature (337)..(342): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttccccctggcaccctcctccaagagcacctctggggcacagcggccctgggctgcctggtcaaggactacttcctagagacacgctgagcgggctggcaaggcgcatagnnnnnn

SEQ ID NO: 110434 - DNA, 354 bp, Homo sapiens
  misc_feature: GYAE6OF02FWVWU.7.14.B03.1.454.CMB.1.raw
  modified_base (338)..(354): a, c, t, g, unknown or other
  misc_feature (338)..(354): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttccccctggcaccctcctccaagagcacctctgggggcacagcggccctgggctgcctggtcaaggactacttcctagagacacgctgagcggctggcaaggcgcatagnnnnnnnnnnnnnnnnn

SEQ ID NO: 110435 - DNA, 344 bp, Homo sapiens
  misc_feature: GYAE6OF02IKQJO.7.14.B03.1.454.CMB.1.raw
  modified_base (337)..(344): a, c, t, g, unknown or other
  misc_feature (337)..(344): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttccccctggcaccctcctccaagagcacctctgggggcacagcggcctgggctgactggtcaaggactactcctagagacacgctgagcgggctggcaaggcgcatagnnnnnnnn

SEQ ID NO: 110436 - DNA, 342 bp, Homo sapiens
  misc_feature: GYAE6OF02H64OF.7.14.B03.1.454.CMB.1.raw
  modified_base (305)..(305): a, c, t, g, unknown or other
  misc_feature (305)..(305): n is a, c, g, or t
  modified_base (331)..(331): a, c, t, g, unknown or other
  misc_feature (331)..(331): n is a, c, g, or t
  modified_base (337)..(342): a, c, t, g, unknown or other
  misc_feature (337)..(342): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttccccctggcaccctcctccaagagcacctctgggggcacagcggccctgggctgcctggtcaaggactactcctagngacacgctgagcgggctggcaaggcncatagnnnnnn

SEQ ID NO: 110437 - DNA, 735 bp, Homo sapiens
  misc_feature: GYAE6OF02G0JAB.7.14.B03.1.454.CMB.1.raw
  modified_base (338)..(338): a, c, t, g, unknown or other
  misc_feature (338)..(338): n is a, c, g, or t
tcagcgtgtctctacacgaccggtgctcgatttagtgtgagtagtttaggggtttaggggacccaacaaccacacccctcctaaagaagaagcccctagaccacagctccacaccatggacctcggacctggaggatcctcttcttggtggcagtagcaacaggtgcccactcccaggtgcagctggtacagtctgggtctgaattgaggagccgtggggcgtcagtgagcgttgcctgcaagccttctgatacatcttcactacttattctgtctaagttgggtccacgacggcccctggacaaggccttgactacatgggatggatcaacaccganacgtcggaaccccactatcgcccaggccttacacgagggtcggtttgtaccttctcagtcggacttaccctcgtacggtccggggtacggtcttactcgtgactaagaactaaacccgtaacctttacaacccgtagaacccgtaactaccgttacggttacccgttttttaagtttttacggaacgtaacgtaacggttcccgtttacgtttccgttacggttacgttaacggggttacggtaaacggttttccgaaccggtttaccgggtacgggggtacccggtaaacccggggttaaacccggttcggggttaccctaaccccgggtttcccttcccgttacccgtaaccggttccccttaaaccccggacccggtaacccgggttacccccg

SEQ ID NO: 110438 - DNA, 346 bp, Homo sapiens
  misc_feature: GYAE6OF02G7OJ3.7.14.B03.1.454.CMB.1.raw
  modified_base (339)..(346): a, c, t, g, unknown or other
  misc_feature (339)..(346): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttccccctggcaccctcctccaagagcacctctgggggcacagcggcctgggctgcctggtcaaggactacttcctagagacacgctgaggcgggctggcaaggcgcatagnnnnnnnn

SEQ ID NO: 110439 - DNA, 405 bp, Homo sapiens
  misc_feature: GYAE6OF02GXJIO.7.14.B03.1.454.CMB.1.raw
  modified_base (315)..(315): a, c, t, g, unknown or other
  misc_feature (315)..(315): n is a, c, g, or t
  modified_base (351)..(351): a, c, t, g, unknown or other
  misc_feature (351)..(351): n is a, c, g, or t
  modified_base (353)..(354): a, c, t, g, unknown or other
  misc_feature (353)..(354): n is a, c, g, or t
  modified_base (356)..(405): a, c, t, g, unknown or other
  misc_feature (356)..(405): n is a, c, g, or t
tcagcgtgtctctacacgaccggtgctcgatttagtgtgagtagtttgggtttgtcttctccatggatacctctgtcgggacggcttatctgcagataaccaaccttcaacctgacgacactgccgtttattttgtacgagagcgtcgtctgtcagtggaattgactactggggcagggaaccctggtcaccgtctcctcagcctccaccaacgggcccatcggtccttccccctggccaccctcctccaagacgccacctcgtcgggggcacgacgcggccctgggctgcctggtcaaggactacttcctaganactacgctgaggcggcgtggaccgaaggcgcatagnanngnnnnnnnnnnnnnnnnnnnnnnnnnnnnnnnnnnnnnnnnnnnnnnnnnn

SEQ ID NO: 110440 - DNA, 417 bp, Homo sapiens
  misc_feature: GYAE6OF02GY8CC.7.14.B03.1.454.CMB.1.raw
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (241)..(241): a, c, t, g, unknown or other
  misc_feature (241)..(241): n is a, c, g, or t
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
  modified_base (375)..(417): a, c, t, g, unknown or other
  misc_feature (375)..(417): n is a, c, g, or t
tcagcgtgtctctacacgaccggtgctcgatttagtgtgagtagtttgggtttgtcttctccatggatacctctgtcgggacggcttatctgcagataaaccaaccttcaacctgacgacactgtccgttttattttgtacgagagcgtcgtctgtcagtggaattgactacgtggggccagggaaccctggcaccgtctcctcncncctccaccgaacggcccatcggtccttcccccgngcccaccctcctaccaagacgccacctcggtggggcacgagccggccgtgggcctgcccgtgggtacaaggtcctacttcctaggacgacacgctaggcggcgggtactcggnaaagggccctagagtagcngnnnnnnnnnnnnnnnnnnnnnnnnnnnnnnnnnnnnnnnnnnn

SEQ ID NO: 110441 - DNA, 515 bp, Homo sapiens
  misc_feature: GYAE6OF01BD03M.53.10.A10.1.454.CMB.1.raw
  modified_base (309)..(309): a, c, t, g, unknown or other
  misc_feature (309)..(309): n is a, c, g, or t
  modified_base (352)..(352): a, c, t, g, unknown or other
  misc_feature (352)..(352): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctntgttggtcatgtatcaagataacaagcgccctctggcatcccngggcattctctggctccactctgggaacacacgccactctcgaccatcacgccgggacccagactagtggatgaggctagactattactgtcaggcagtcgggacagcgtaaagttggacggttcggtccggggacgggggaaccaacgtcggaccggtaccg

SEQ ID NO: 110442 - DNA, 627 bp, Homo sapiens
  misc_feature: GYAE6OF01DLW26.53.10.A10.1.454.CMB.1.raw
  modified_base (253)..(253): a, c, t, g, unknown or other
  misc_feature (253)..(253): n is a, c, g, or t
  modified_base (263)..(263): a, c, t, g, unknown or other
  misc_feature (263)..(263): n is a, c, g, or t
  modified_base (285)..(285): a, c, t, g, unknown or other
  misc_feature (285)..(285): n is a, c, g, or t
  modified_base (306)..(306): a, c, t, g, unknown or other
  misc_feature (306)..(306): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagcccaccctcactgtccgtgtccccaggacagacagccaccatcacttgttctgganataactgganaccaagtatattgtgtatcaanagaggccaggcctgtcccctntgttgtcatgtatacaagataacgaagccggccctctggccactcccgtgggcctatttcctcgtggcctacccaactcgtacgggaacacacgaccctaactcctacgaccactccgacggacccggggaacccaacgaccgttagtacggagtaggagggtcgtacgtacttaacgttaccgttacggtaccgtaaggccgtaggtacgggaaaccgtagggaacggtaaagttcgggtaccggggtttacggggttaccggggggacccgggggggtaaccctaaaaccgggttccgggtaaccccggttaacccggg

SEQ ID NO: 110443 - DNA, 536 bp, Homo sapiens
  misc_feature: GYAE6OF01B6XMQ.53.10.A10.1.454.CMB.1.raw
  modified_base (251)..(251): a, c, t, g, unknown or other
  misc_feature (251)..(251): n is a, c, g, or t
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgtctgganataaactggagaccaagtatatttgtggtatcaacngagccaggcctgtcccctntgttggtcatgtatcaagataacaagccggcctcgtggcagtccctggggcatttcctctgggcctccaactctagggaacacacgccactctcgacctatccgacgccgggacccagacctagtggatggaggtctagactagttactgtacaggcagtcgggacaggacgtaaagttcggcgggttcggtccggggacgggggaaccaacggtcggaccgttacccgg

SEQ ID NO: 110444 - DNA, 580 bp, Homo sapiens
  misc_feature: GYAE6OF01B6WD2.53.10.A10.1.454.CMB.1.raw
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtcgtccccaggacagacagccacatcacttgttctgganataactgganacaagtntattgtgtatcaacagagccaggcctcgtccctntgtggtcattgtatacaagataaacgagccggccctcgtcggaccacgtccccgtgggcctacttccgtcgttcggtcctacccgtaaccgtccgtacgggaaaccacgacgcccactccacgacctacgtccgacggaccgggaacccagtacctagtcggataggacggtctagtactattaccgtgtcgacggcaggtcggacgtaggacgtaaagttcggtacgggttcggttaccggggacggggaacctaacggtcggtacccggtaccgg

SEQ ID NO: 110445 - DNA, 551 bp, Homo sapiens
  misc_feature: GYAE6OF01BC3YH.53.10.A10.1.454.CMB.1.raw
  modified_base (167)..(167): a, c, t, g, unknown or other
  misc_feature (167)..(167): n is a, c, g, or t
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (319)..(319): a, c, t, g, unknown or other
  misc_feature (319)..(319): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacnggatccgtggcctcctatgagttgactcagccaccctcactgtccgtgtccccaggacngacagccaccatcacttgttctgganataactgganaccaagtatatttgtagtatcaanagagccaggcctgtcccctntgttgtcatgtancaagataacaacgcggacctcgtgcacgtccctgggctattctacgtcggcctaccgaactcgtagggaacacacgaccgactcgtaccgacctacgtcacggaccggaccgagtacctagcggacgtggagtcgtagtacttaacgtactgtcgagctaggcggtacaggacgtaagtccggtaggtcggtccggggacgggggaacctaacggtcggacccggttaccgg

SEQ ID NO: 110446 - DNA, 676 bp, Homo sapiens
  misc_feature: GYAE6OF01CU8WU.53.10.A10.1.454.CMB.1.raw
  modified_base (251)..(251): a, c, t, g, unknown or other
  misc_feature (251)..(251): n is a, c, g, or t
  modified_base (286)..(286): a, c, t, g, unknown or other
  misc_feature (286)..(286): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgtctgganataacgtggagaccaagtatattgttggtatcaangaggccaggcctgtccctgtgttggtcatgtatacaagataaacaacgccggccctcgtcggcacgtcccgtagggctattcctcgtcggccttcccaacgttccgtagggaaccaccgacgtaccctactccgttcgaaccctacgtacgaccggtacccgggaaccccgacggtaaccttagtcgggtaacttagggacgggtaccgttacggtaacctttaacgtttacccgttaggttaccgtaacgggtaccgtaaggttacggggaaacgtacgggaaccggttaaacggtttcgggtacccggggtttacggggttacccgggggtacccggggggggtaaacctaaaacccgggtccgggttaacccccggttaaccccggg

SEQ ID NO: 110447 - DNA, 601 bp, Homo sapiens
  misc_feature: GYAE6OF01DJSGB.53.10.A10.1.454.CMB.1.raw
  modified_base (264)..(264): a, c, t, g, unknown or other
  misc_feature (264)..(264): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcacgccaccctcactgtccgtgtccccaggacagacacgccacatcacttgttctggagataaactgganaccaagtatntttgtgtatcaangagcagcctgtcccctntgtgtcatgtatcaagataacagccgccctgtgctacgtcccgtgggctatttcacgttcggacctccctaactcgtacgggaacacgacgcccaactccgtacgacccataccgacggcccgggaacccagacttacggaggtacgtaggacggtactacggtaacttacttacgtcgttaccgaggtcaagggtcgggaactaagggacgtaaagttgggtaccggggttacggggtttaccgggggaccggggggtaaccctaaaccgggttggtaaccccgggttaacccggg

SEQ ID NO: 110448 - DNA, 676 bp, Homo sapiens
  misc_feature: GYAE6OF01EDB74.53.10.A10.1.454.CMB.1.raw
  modified_base (119)..(119): a, c, t, g, unknown or other
  misc_feature (119)..(119): n is a, c, g, or t
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (257)..(257): a, c, t, g, unknown or other
  misc_feature (257)..(257): n is a, c, g, or t
tcagcgcgtatacacacgaccggtgctcgatttagcgtcgatctcagggcacgaccggtgctcgatttagcgtcgatctcgaggggctgggcctcaggaagcagcatcggaggtgcctnagccatggacatggactccctctcttccgtcggcgtccttgctactgcacaggactccggtgcctcctatgagttgactcacgccacctnactcgtccgtcgcccgagacacgacncgccacatcacttgtctagganataaacgtggaacacctaagttacttagtttggttagtactacgaagtaggacgccgaggtcctcggttcccctagttggttacgtactagttacgtactagtaaacggactaaaacgacgggtcccgtaccgtacgtcgggacctaaccgtcccggtacgggtaccgtactttccgtacggtacgggtacccttccgtaaacgttccgggtaacgggaaaccacgtaaccggtacctaacgttacaccggaactacgttacgaccgggaaccggtactacggaacttacgtgggaatacggtacgtactaaggtactttaacgtacgttcgagacggacctaagtcgggaacagtacgttaaggtcgggccggttagggtcccggggaacgggtaaccctaagtcggacccgttacgg

SEQ ID NO: 110449 - DNA, 852 bp, Homo sapiens
  misc_feature: GYAE6OF01CUKZJ.53.10.A10.1.454.CMB.1.raw
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggactccgtggcctcctagtgtagttgactcacgcccaccctcacttcgtccgtcgtaccccgaggacacgaccacgaccacactctacttgtactaggaataactaacgtggaactaacctaagttattagtttggttaggtaactacgaacgaggaccggaccgacggtcccttcgtccccgttgttcggttcggtactagttacgtactaacgaaagtaactaaacgaacggcccgtcctacgtcggacctacgttccccggtaggtccgttacgttccgtaccgttcggtaccctaccccgtaacgttaccgggtaacggaaaccacccgtaaccggtaccctaaacccgttcccggttaacccgaaccgtttaaccggtacccgggaaacccggggtacccccggggtaaacccctaaacggggttaacccgttaagggttaacgggttaaccgttaaggggtaaccgggtttccgttaaacggttaaaccccgttttaaggtttaccggtaccgggttaaaccggacgggtaccgtaacgggggttaacccgggaaactaaacggggttaaaccgttaaaggggtttccggggtaccgggggtttacggggtaccccgggggggaaaccgggttaaaccccgtaaccggtacccgggtttaaccccgggttaacccggg

SEQ ID NO: 110450 - DNA, 796 bp, Homo sapiens
  misc_feature: GYAE6OF01DURES.53.10.A10.1.454.CMB.1.raw
  modified_base (262)..(262): a, c, t, g, unknown or other
  misc_feature (262)..(262): n is a, c, g, or t
  modified_base (273)..(273): a, c, t, g, unknown or other
  misc_feature (273)..(273): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccggtggcctcctagtgtagttgactcacgcccacctcactcgtccgtcgtcccaggacagacacgccacactctacttgttcgtaggaanaacttaaacgnggaagaacctaagttattattttggttaggtaattacgaaacgtagggacggacccgtacggtccccttcggttcccccttgtttggtttcggtactagttacgtaactaacgaaacgaaacttaaacggaaaccgggtcccggtcccgttcggtaccggtccctaacggttcccccggtggggtaccgttaccttttccgtccgtttacgggaccccttacccggtaaccttccgggtacggaaacccacccgtaccgtacccgtaacccttccgtaccgaccttaaccgtaccggaaccgggaccccgggaaccgtaacgtaacggttacggtacggaacggttacggaacgttccggttaacgtaaactttacgttaacggttcggtacgtaccgggaaccgtagggtaacggggaactaacgggtaaccggttaaagggttcccggggtacgggttccgggggttaacccgggggacccggggtaaaccgtaaccggtccgggtcccggttaaccgggg

SEQ ID NO: 110451 - DNA, 810 bp, Homo sapiens
  misc_feature: GYAE6OF01C2CMJ.53.10.A10.1.454.CMB.1.raw
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggactccctctcttcctcggcgtccttgcttactgcacaggatccgtcggcctcctatgagttgactcacgccaccctcactcgtccgtcgtcccgaggacagacacgccacactctacttgtctaggaagtaactaaacgtggaaactaaccgaaagttacgttagttttaggttaggttaactaaccgaaacgtacggaacggtacccgacgggtccctttccggttccccctgtttacggtttacggtactagttacgtactaacgaaacgtaaacgtaaaaccgaacgggtcccggtccccgttacgtaccggtacctaacccggttcccgggtacgggccgtttaacgtttccgtaccgttacggtacccttaacccgaaccggtttaccggacgggtaaacccaaccggtaccgtaccctactacccgtacgaacccgtaccgtaccggaaccgggacccggtaaccgaacggtaaccttaagggccgtaaggtacggacggtacgttcgtaacgtttaagttccgtggtaacccgtaggaccggttaaggtacggggtaaaccacgggtaaacggttaaacgggtttccggggtacgggtttaccggggggtaaccggggggtaacccgggggtaaccctaaacgggttccccgggttaacccgggtaaccggg

SEQ ID NO: 110452 - DNA, 709 bp, Homo sapiens
  misc_feature: GYAE6OF01ALRJX.53.10.A10.1.454.CMB.1.raw
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgacgttgactcagccaccctcactcgtccgtcgtcccaggacagacacgccaccatcacttgtctgganactaacngggacacaagtatagtttgtcggtactacgaacagtacggcctacggccttcgtcccctgttcgtcggtcattgtactctaacgtaactaacgaacgtcccggacctctcggctaaccgtcccggtaggtacgtactttcgtcgttcggccttaaccgaccgtttacggacgggaaccctaaccgacgtccctacgttccgaacccgtacgtacgttaccgaccgggtacccgggaaccgaggttaccgtacggttacggaactcgggaacgttccggtaacgttaactttaacgttaccggtgtacggtaacggcctaaagggtccggtaaaccgacgggttaaaacgttaccggttaaggggtcccccgggtttaaggggtacccggggggtaaaccccggggggtaaaccctaaccggttggggtaccccccgtttaaaccgggg

SEQ ID NO: 110453 - DNA, 677 bp, Homo sapiens
  misc_feature: GYAE6OF01BIRZY.53.10.A10.1.454.CMB.1.raw
  modified_base (259)..(259): a, c, t, g, unknown or other
  misc_feature (259)..(259): n is a, c, g, or t
  modified_base (296)..(296): a, c, t, g, unknown or other
  misc_feature (296)..(296): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcacgcccaccctcactcgtccgtcgtccccaggacagacacgccaccatctacttgttctggaanataaactggacaactaatatatttgttggtatacaanagacgcgacggccctcgtcccctgtgttacgtctatgtatacgaaagtactaaaccgaggtcccgtacctcgtcggaccctacgtcccggtcggggacttacgtttcgtccgtaggcctaccctaactcggtacggtaacaccgacgtccctaaccgtcgtaccgtaaccgacgtaccgaacggtacccggggaacccaacggtaaccgtaggtaacggcggttaaggtacgggtaccgttacgtaacgtttaacgttacgtcgtacggaacggtcgaacggtcgggaacgtaggaacggtttaaggttccgggtacgggttacggggttaccggggaccgggggtaaaccctaaaccggtccgggtaacccgttaccggg

SEQ ID NO: 110454 - DNA, 691 bp, Homo sapiens
  misc_feature: GYAE6OF01ENQ14.53.10.A10.1.454.CMB.1.raw
tcagcgcgtatacacacgaccggtgctcgatttagcgtcgatctcagggcacgaccggtgctcgatttagcgtcgatctcgaggggctgggcctcaggaagcagcatcggaggtgcctcagccatggcatcggactccctctcttcctcggcgtccttgcttactgcacgaggacttccggtcggtccttcctagtgtagttcgacctcacgcccacccttcgacttcggtccgtcgtccccaggaccacgaccacgcccaccattcctacgtttgttcgtaggaagtaacttaaacgtggaacacctaagttatttagtttgttaggatacgaacgtaggacggaccgtacggtcctccggttccccttagttcggtttacggtctagtcgttaactacgaaacgtactaaacgacggcccggtccctaggtcggacctaccgttcccgggtgggacctactttccgtacggttccgtaccctacccgtaacgttcggacgggtaaccaaccgacgtaccctacgtcgtaccgactcgtacggaccggccggaaccacgtacgtagtgacgttggacgtctagtacttagtcgtagtcgagtcgtacgcggaacgtaggtacgttacggtcggtaccgggttacgggtacccggggacgggtaacccaacggtccggtacccggtacggg

SEQ ID NO: 110455 - DNA, 892 bp, Homo sapiens
  misc_feature: GYAE6OF01EKA1I.53.10.A10.1.454.CMB.1.raw
  modified_base (145)..(145): a, c, t, g, unknown or other
  misc_feature (145)..(145): n is a, c, g, or t
  modified_base (348)..(348): a, c, t, g, unknown or other
  misc_feature (348)..(348): n is a, c, g, or t
  modified_base (710)..(710): a, c, t, g, unknown or other
  misc_feature (710)..(710): n is a, c, g, or t
tcagcgcgtatacacacgaccggtgctcgatttagcgtcgatctcagggcacgaccggtgctcgatttagcgtcgatctcgaggggctgggcctcgaggaagcagcagtcggaggtgcctcagccagtggcagtggacttccctnttccgttccgtcggtcgttccgttagcctttaacgtgaccaacgtagggtccttccggtcggtcccttactagtcgtagttcgacctccaccgacccacctcgtacgttccggttccgtcgtccgaccgaacggacgacggaccaccacccgtaacctagtaccttacgtttgttacggtaaggaacttaaacgttaaacggnggaaacgtaaccttaaaggttttacttaggttttcggttaacgtaacgtaaccaaggtaccggacggtacccggtaccggttcccgtttcccgttacccgtttacgtttagggttcccgttagttaagtttacggtaaacaaacgtaaacgtaaaccggtaaacccgtccgggtacccccgtacctttaccgggtaccggaaccgtttacccggtaccccggggttggtacccgttttaacgttccttaaccgggtcccgttaaccgtaaaccgttaccggttagggtaaaccaaccgtaaccggacctccggtaaccctcgtaccgtaaccgtcgtacccggaaccgggtacccgtaaccngttaacgacggttaaggtacgcgggtaaacctgttacgtaaccgttaacgttcggtacgacggtaaacgtaaccggtgggtaacgaaccgggttaaggttaacggttacggggttcggtaacccgggggttacgggaccgggtaaacccgggttacccaaaccgggttccggtaaacccggg

SEQ ID NO: 110456 - DNA, 112 bp, Homo sapiens
  misc_feature: GYAE6OF02G2UZ8.53.10.A10.1.454.CMB.1.raw
tcagcgcgtatacacacgaccggtgctcgatttagcgtcgatctcagggcacgaccggtgctcgatttagtgacatctcgcagttctttgagcgggctggcaaggcgcatag

SEQ ID NO: 110457 - DNA, 567 bp, Homo sapiens
  misc_feature: GYAE6OF02IMJJE.53.10.A10.1.454.CMB.1.raw
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgtctgganataacngganacaagtatatttgtgtatcaacagagcaggcctgtccctntgttgtcatgtatcaagataacagcgccctntggcatcccgngggctattctctgtctccaactcgtacgggaacacgacgccactcgtacgaccatcgacgccggacccagacgtagtaggacgtgacgtcgtagtacgtaattacgtcgtacgacggacgtagtacgggaacgaacggtacggtaaagttcgggtaccgggttacgggtttaccgggggaccgggggtaacccgtaaaccggttccggtacccggttaacccgg

SEQ ID NO: 110458 - DNA, 557 bp, Homo sapiens
  misc_feature: GYAE6OF02IW84X.53.10.A10.1.454.CMB.1.raw
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgtctggagataactgganacagtatattgtgtatcanagagcagcctgtccctntgtgtcatgtatacaagtactaacaagccgacctcgtcgctacgtcccgtcgggcgtactttacctctcggtcctaccgtaactccgtacgggaacaccgacgtacccactcgtacgaaccacgtccgaacgccggacccagtactagtcgagtacgagtctacgacttacttacacgtacgaggacaggtacggtacgaacgcgtaaagtcggtcggttacggtcggggaccgggtaacgaacgtcgacccgttaccgg

SEQ ID NO: 110459 - DNA, 519 bp, Homo sapiens
  misc_feature: GYAE6OF02FJXAL.53.10.A10.1.454.CMB.1.raw
  modified_base (310)..(310): a, c, t, g, unknown or other
  misc_feature (310)..(310): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagcccaccctcactgtccgtgtcccccaggacagacagccaccatcacttgtctggagataaactggagaccaagtatatttgttggtatcaacagaggccaggcctgtcccctntgttggtcatgtatcaagataacaagcggaccctctggcatcccgtgggcattctctggctccaactctgggaacacagccactctgaccatcagccgggaccagactatggatgagctgactattactgtcaggcagtacgggacagacggtaagttggcggtcggttcggggaccgggggaccgtaaccggtcggacccgtacccgg

SEQ ID NO: 110460 - DNA, 524 bp, Homo sapiens
  misc_feature: GYAE6OF02HDECI.53.10.A10.1.454.CMB.1.raw
  modified_base (309)..(309): a, c, t, g, unknown or other
  misc_feature (309)..(309): n is a, c, g, or t
  modified_base (397)..(397): a, c, t, g, unknown or other
  misc_feature (397)..(397): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctntgttggtcatgtatcaagataacaagccggaccctctggcactcccgtgggctattctcgtgctccactctgggacacgagccactcncgaccactccacgccgggacccagacctagtggacgtggagcgtacgaccttattactgtacgagcagtagggacaggacgtaagttcggcggtggttcgggcgggggaccaacgtcgaccgtccgg

SEQ ID NO: 110461 - DNA, 590 bp, Homo sapiens
  misc_feature: GYAE6OF02G67YH.53.10.A10.1.454.CMB.1.raw
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
  modified_base (451)..(451): a, c, t, g, unknown or other
  misc_feature (451)..(451): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagaccagcccaccatccacttgttctggagaataaactggagaaccaagtatatttgttggtatcaacagaggccaggcctgtcccctntgttgtcatntatcaagataacagcgcctctggctactcccgtgggcgtattcgtcgtcggtcctcccgtaactcgtacgggaactaccagaccctactacctcgaacctactccgacggcccggacccagacctancggtataggacgtctagaccttagttacgtcgtcgacggctaggtacggaacgtaacggacggtaaagtttcgggccgggttcgggtttaccgggggccgggggtaaaccgaaaccggttacggtaacccggttaccgg

SEQ ID NO: 110462 - DNA, 762 bp, Homo sapiens
  misc_feature: GYAE6OF02IGHH9.53.10.A10.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (258)..(258): a, c, t, g, unknown or other
  misc_feature (258)..(258): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactnacgccacctnactcgtccgtgtccccaggacagacagccactatcacttgtctggagataacnggagaccaagtatatttgttggtattacaacagaggtaccaggtcctcgtacccccttgttggtttcgggtcagttagtactacgaaacgtataaacgacggaccggtccccttagtcggacctaacgttccctcgggttacgtacttttccgtcgtccgggtaccttaccctaccgttacggttacgggaaacctaccgtaacgaccctaccgtccgtacgaaccgtacgtaccctacgggtaccccgggaacccgtaaaccggtaccgttaacggtacgggtaacgttacgggtaaccggtaccgtacgttaaccgtttaacggttaccgttaaccgggttaccgtaccgggtaacgttaccgggtacggggtaaacccgaacgggttaaccggtaaaacggtttaccggggtaccgggtttccgggggttaaccgggggtaaccccgggggggtaaacccgttaaaccggttacccggggtaccccggtttaaccccgggg

SEQ ID NO: 110463 - DNA, 771 bp, Homo sapiens
  misc_feature: GYAE6OF02G361S.53.10.A10.1.454.CMB.1.raw
  modified_base (213)..(213): a, c, t, g, unknown or other
  misc_feature (213)..(213): n is a, c, g, or t
  modified_base (285)..(285): a, c, t, g, unknown or other
  misc_feature (285)..(285): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttccgtcggtcgtccttgcttactgcacgaggtactccgtggcctctagtgagttcgactcgagcccacctcncttcgtccgtcgtccccaggaccaggaccacgccacctatctacctttgttccgagggaataacttaaacgnggtaacgtaacctaagttattagttttggttaggttaactacaaacgcgggtacggccgacgggtccttccgttccccttggttaggtttcggtactagttcggtaaactcgaaaaacgtaactaaaacgtacggtccggtacccgttcgtacggaccttaccgttcccggtcgggtaaccgttctttaccgtttccgtacggtacctaacccgtaaccggtaccggttaacggaaccctaacgacgtacccgttacctaccgtacgacctacgtccgaacgggacccggtaccgaacgtacgttacgaggttatacggaggttaaccgtctaagtttaacgtacgttcgtacggaacggtacgtcggtaacgggaacgtaacggtaacccggtaaaggttccgggttaaccgggggtttaccgggtcccggggggtaaacccgggggtaaaccctaaccgggtccgggtacccgggttaacccgg

SEQ ID NO: 110464 - DNA, 812 bp, Homo sapiens
  misc_feature: GYAE6OF02HCWFA.53.10.A10.1.454.CMB.1.raw
  modified_base (266)..(266): a, c, t, g, unknown or other
  misc_feature (266)..(266): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggactccgtggcctctatgtagttgactcacgcccacctcacttcgtccgtcgtccccaggaccagacacgcccacctatcctactttcgttctagganaactaaacgtggaacaaccgaagttattagttttggtttaggtactacaacgaggtacggaccctaagggccccttacgtcccccttcgttcggtttacggttccagtttacgttactaccgaaagtaactaaaccgacggcccggtacccctagtcggacctacgttccccggtggggtaccttacgtttcctcgtcggtccttacccgtaacttcggtacggtaaaccaccgtaccgaccctacgttccgtaccgtaacctacgtacccggtacgggaccccgggaaaccctacggtaaccgttacggtaacgggtacggttacgggaacggtacccggttaacggttaaccgttttaaacgtttaccggttaccggttaccggaaccgggttacgaacggggtttaccggaacggttaacgggtaaaccgggttaaacggtttccggggttaccggggtttaacgggggtttaccccggggggaaacccggggggttaaaccctaaccggggtttacccggtacccccgggtttaaacccggg

SEQ ID NO: 110465 - DNA, 651 bp, Homo sapiens
  misc_feature: GYAE6OF02FWXX9.53.10.A10.1.454.CMB.1.raw
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggcagacagcccaccatcacttgtctgganataaactgganaccaagtatatttgtggtatcaanagagccaggcctgtcccctntgttgtcatgtatcaagtataacgacgccggtccctcgtcggacacgtcccgtgggacctactttccgtcgtcggtctcccgtaaccgtccgtagggaaccacgtacgaccctaacctcgtacgacctactaccgacggtcccgggacccaacgtacctaggttcggagttcggtaacggtccgttaggttaaccttacgttaccgtttacggtaccgtacgggtccgtagggtaccggtaacgtaaccggaacggttaaacggttcggtacgggtttcccggggttacgggggaacccggggggtaaccctaaaccgggttacccggtaccccggttaacccgg

SEQ ID NO: 110466 - DNA, 559 bp, Homo sapiens
  misc_feature: GYAE6OF02HGCWN.53.10.A10.1.454.CMB.1.raw
  modified_base (318)..(318): a, c, t, g, unknown or other
  misc_feature (318)..(318): n is a, c, g, or t
  modified_base (368)..(368): a, c, t, g, unknown or other
  misc_feature (368)..(368): n is a, c, g, or t
  modified_base (440)..(440): a, c, t, g, unknown or other
  misc_feature (440)..(440): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccacctcactgtccgtcgtccccaggacagacagccacatcacttgttctggagataaactggaacgaccaagtatatttgttaggtatcaactaggacggccaggccttacgtccccttntggttcggtcagtgtatcaagataacgagccgacctgtaggctactccgngggctattctcgtcgctccaactcgtacgggacacacgccatcgcgacacgtacagaccggaccagactagnggatggagtctagtacttactacgtcgacgaggacaggtcggagtacgtaaggtaacgttcggagggttcgggttacggggaccggggtaaccgaaccggttcggtaacccgtaccggg

SEQ ID NO: 110467 - DNA, 877 bp, Homo sapiens
  misc_feature: GYAE6OF02I3T59.53.10.A10.1.454.CMB.1.raw
  modified_base (118)..(118): a, c, t, g, unknown or other
  misc_feature (118)..(118): n is a, c, g, or t
  modified_base (293)..(293): a, c, t, g, unknown or other
  misc_feature (293)..(293): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctnagccatggcatggatccctctcttcctcggcgtccttgcttactgcacgaggctccgtgcctcctatgagttgactcgacgcccacccttcgacgttcgtcccgtcgtcccccgaaggaccacgtaccgacgacccaacctatcctacgtttcgttccgtaggagtaattaacgnggaacgacctaagttattagttttacggttggtacttacaacgtaggtacggaccgtacggccttccgtcccccttgttacggtttcggtacctagtcgttactacgtaagtacgtaaacgaaccggtccgtacccttacgtacggtcctaacccgttcccggtaggtacccgtaacttttccgttaccggtcgggttacccctaaccggttaacccgttaccgggtaaccggggttaaaaccctaacccggtaacccgttaacccgtaaccccgttttacccgtaacccggttaccgtaacccggtttacccgtaaacccggggaaccccggggaacccgttaaaaccgttaacccgggttaaacccgggttaggggttaacccggtacgggtacggggtaaccgttaccggtttaaaccgttaacgtttaccggttaaaacggtcggtaacggtacgtacggtaacgggtaacgtaaccgggtacggtaaacgttcgggtacccgggggtttaacggggtacccggggggttaaacccgggtaaaggtaaccccgggttaccggtaaacccggtttcccggg

SEQ ID NO: 110468 - DNA, 690 bp, Homo sapiens
  misc_feature: GYAE6OF02IHAMZ.53.10.A10.1.454.CMB.1.raw
  modified_base (267)..(267): a, c, t, g, unknown or other
  misc_feature (267)..(267): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggactccgtggcctcctatgagttgactcacgcccacccctcacgttcggtcccttcgtcccccaggaacagacacgccaccatctacttgttctagganactaacgtggacgaacgaagttattagtttggtttaggtatacaacgagacggccgaggtccttcgtcccctgttcgttcggttcagttctacgtacaacgtaactaacgaacgtccggcccttcgtacggcctacgtcccggtgggtcctacttccgttcgtcgaccttaccgaccgttcggtaaccgggaacctaacgaccgtcccaaccgttctaccgaacctaagtccgaaccggccgggaaaccctaggaacttagggtacggtaacgttacgggacgtacgtacggttaactttaacggttccgtaggtaccgtaggtacgaaggttcgggaaacaccggtaagttaaaggttccggacgggttacggggtccggggaaccggggtaacccttaacgggtcccgaacccgttaccgg

SEQ ID NO: 110469 - DNA, 712 bp, Homo sapiens
  misc_feature: GYAE6OF02G4JUX.53.10.A10.1.454.CMB.1.raw
tcagcgcgtatacacacgaccggtgctcgatttagcgtcgatctcagggcacgaccggtgctcgatttagcgtcgatctcgaggggctgggcctcaggaagcagcatcggaggtgcctcagccatggcatggatccctctcttcctcggcgtccttgcttactgcacaggatccgtggcctcctatgagttgactcacgccaccctcactgtccgtcgtccccaggacagacacgccacatcacttgttctggataataactggaacaaccaagttattagtttgttaggtatacaacgagacggccaggtcctcgtcccctgttggttcggtctagtgtactacgaaagtaactaaacgaacggccggtacccttacgtcgggacctacgttccccgtggggaccgtactttccgtacgtcggtcctacctacgtcgtacggaaccacgacgcctactcgtacgacctacgtcgacggaccggacccagtaaccgtagtaggaacgttggacggtacgttacggtaactttaacgtttacgttacggttacgacgggtaccgtaagggttacggggaaaccggtaacggtaaccgggttaaacggtttaccggggtaccgggggtttaccggggggttaaccggggggtaaccccgggggggtaaacccttaaaaccggggttcccgggtaaaccccggtttaacccgggg

SEQ ID NO: 110470 - DNA, 743 bp, Homo sapiens
  misc_feature: GYAE6OF02J0JY4.53.10.A10.1.454.CMB.1.raw
  modified_base (138)..(138): a, c, t, g, unknown or other
  misc_feature (138)..(138): n is a, c, g, or t
  modified_base (198)..(198): a, c, t, g, unknown or other
  misc_feature (198)..(198): n is a, c, g, or t
  modified_base (558)..(558): a, c, t, g, unknown or other
  misc_feature (558)..(558): n is a, c, g, or t
  modified_base (578)..(578): a, c, t, g, unknown or other
  misc_feature (578)..(578): n is a, c, g, or t
  modified_base (587)..(587): a, c, t, g, unknown or other
  misc_feature (587)..(587): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctntcttcctcggcgtcctgcttactgcacaggactccgtggtcctcctatgagttgactcgngcccacctctactcgtccgtccgtacccaggactagaccgacgtcccacctactccgtacttcgttacgtggaacgtaacgtaaacgtggaacgaaccgtaaggtattacgtttagtaggttaacaccgtaaccgtagaacggacccgtacggtacccgttccggttcccctggttacggttcggttactaaggttacgtaactacgaaactaacgtaaacgtccggtaaccccggtccctttaggtccggtacctaccgttcccggacggtacgtacgttcccttaggtcggtaccgtacccgtaccgtaccggtacgggtaaccacgtaccgtaccctaccgtccgacctaccgtacncggtacggccgggtaacccncggtaaccncggtagtacgtacggtacggacttacggattaacgtccgtaggcgacgtacgtaggtacggtcgtaacggtaacgttacggtcgggttaccggtacgggtttaccgggggaacccgggaaacccggttaaggtacccggttaccggttaacccggg

SEQ ID NO: 110471 - DNA, 572 bp, Homo sapiens
  misc_feature: GYAE6OF02F6E0E.53.10.A10.1.454.CMB.1.raw
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
  modified_base (290)..(290): a, c, t, g, unknown or other
  misc_feature (290)..(290): n is a, c, g, or t
  modified_base (322)..(322): a, c, t, g, unknown or other
  misc_feature (322)..(322): n is a, c, g, or t
  modified_base (352)..(352): a, c, t, g, unknown or other
  misc_feature (352)..(352): n is a, c, g, or t
  modified_base (368)..(368): a, c, t, g, unknown or other
  misc_feature (368)..(368): n is a, c, g, or t
  modified_base (401)..(401): a, c, t, g, unknown or other
  misc_feature (401)..(401): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtgcctcagccagtggcatggactccctctcttcctcggcgtccttgcttactgcacaggatccgtggcctcctatgagttgactcacgcccaccctcactgtccgtcgtccccaggaccagaccagcccacatcacttgtctgganataactgganaccagtatattgtgtatcaacngacggccagcctgtcccctgtgttcgtcattntatcaagataacgaagccgcctgtgctacncccgtgggcctattcncgtcggcctaccgaactcgacggtaacacgacnctactcacgacctatcgagccggaccacgactagcgagtacgacgtctacgtacttacgttacgtagtacgacggtctacggtacgggactaacggtacgtaacggttcgggtacggttacggggttcgggacccgggggtaacctaaccggtaccgtaaccgtacccggg

SEQ ID NO: 110472 - DNA, 606 bp, Homo sapiens
  misc_feature: GYAE6OF02HK36A.53.10.A10.1.454.CMB.1.raw
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatctacttgttctggaagataaacgtggaacgaccaagtattagtttgttaggtatacaacagacggccaggcctcgtcccctgttggttcggtactattgtatacaagaactaacaaggccgtcctcgtggctacgtcccgtgggactacgttctcgtggtcctaccaacgttcgtacgggaaccacgacgtccactctacgacctatacgacggacccgggaccacggtactagtaggacgtggacgtcgtagtacttaagttacgagtcgaggcaggtacgggactacggaacggttaaagttcgggtacgggttcgggtaccgggggaaccggggtaacctaacggttccggtacccgttaccggg

SEQ ID NO: 110473 - DNA, 570 bp, Homo sapiens
  misc_feature: GYAE6OF02HKDCZ.53.10.A10.1.454.CMB.1.raw
  modified_base (216)..(216): a, c, t, g, unknown or other
  misc_feature (216)..(216): n is a, c, g, or t
  modified_base (306)..(306): a, c, t, g, unknown or other
  misc_feature (306)..(306): n is a, c, g, or t
  modified_base (320)..(320): a, c, t, g, unknown or other
  misc_feature (320)..(320): n is a, c, g, or t
tcagcgcgtatacacacgaccggtgctcgatttagcgtcgatctcagggcacgaccggtgctcgatttagcgtcgatctcagggggctgggcctcaggaagcagcatcggaggtgcctcagccatggcatggatccctctcttcctcggcgtccttgcttactgcacaggatccgtggcctcctatgagttgactcagccaccctcactgtccgtntccccaggacagacagccaccatcattgttctggagataaactggagacaagtatatttgtgtatcaacagaggccaggcctgtcccctntgttgctatgtatnaagataacaagccggcctcgtcggcactccctgggctattctcgtcggtcctaccaactcgtagggaaccacacgtccactctacgacccatacgagaccgggcccaagactagtcggatagacggtctagtaacttattacgtgtacgacgggactacggtacggggtaacaggtaacgtaaagtttgggtacgggttgggttaccgggggaccgggggtaacccaaacggtcggtacccggttaccgg

SEQ ID NO: 110474 - DNA, 682 bp, Homo sapiens
  misc_feature: GYAE6OF02JDGXU.53.10.A10.1.454.CMB.1.raw
  modified_base (494)..(494): a, c, t, g, unknown or other
  misc_feature (494)..(494): n is a, c, g, or t
tcagcgcgtatacacacgaccggtgctcgatttagcgtcgatctcagggcacgaccggtgctcgatttagcgtcgatctcaggggctgggcctcaggagcagcatcggaggtgcctcagccatggcatggactccctctcttcctcggcgttcccttgccttacgtgcacgaggatcccgtggcctcctatgtagttgactcgacgcccacccctcacttcgtcccgtacgtcccccgaggaccagacacgcccacatcacttgttcctgagtaactaaactggacaacctaagttactaatttcggttaggtactcaacgacggtaggcccagggccttcggtcccccttgttcggtttcgtcgtacgttagttacgtacctaaaggtactaaacgaacggtccggtcccttagcggacacgtcccgtaggccgtactcctcgtcgtcctacctactcgtacggacacacgccctactcgaccgtctacgtanaccggaccgacacgtacgttagcggtatcgggacgttacacgttaacttaccgtttacgccgtaacggtccgacgttaggtaaccggtaaccgtaacggtacggttaacggttacgggtaggtttacgggttaacccgggggtaccggggtaaccctaaccgggttccggaacccgtttaacccgggg

SEQ ID NO: 110475 - DNA, 765 bp, Homo sapiens
  misc_feature: GYAE6OF02G2J0H.53.10.A10.1.454.CMB.1.raw
  modified_base (168)..(168): a, c, t, g, unknown or other
  misc_feature (168)..(168): n is a, c, g, or t
tcagcgcgtatacacacgaccggtgctcgatttagcgtcgatctcagggcacgaccggtgctcgatttagcgtcgatctcgaggggctgggcctcaggaagcagcatcggaggtgcctcagccatggcatggactccctctccttccgtcggtcgtccttgctttacngcacgaggactccgtcgcctctatgtagttcgacctcacgcccaccgtcacctcgtccgtccgtcccgaggaccaagaccaccggaccaacctacttcctacgtttcgttaccgtagggaataaacgtaaacgtggaacgtaacccgtaaagttaacgtttattttacggttacggtaactacgaaacgtaacggaccggaccggtaaccggtcccttaccggtccccgtttacgtcgggtttaccggtctacgttacgttaactaaccgtaaaagtaaccgtaaaccggtacgtacccggtcccgtttacgtaccggactacccgttcccgggtacggaccgttacgttccgtacgtccgaccctaccgtaaccgttacgggtaaccggaacctacggacctaccgtaccggtaacacccgtacgtaactaccggtaacccggaccggtaacccgtagtaaccgtaggtacggacttcgggaacgttcctaacgtacgttaccgttaacgtgtaaccgagtaccgagtacgggaacttacgggaagttacgtcggcggttacggcggggaccgtaaccgagttccgacgttaccgg

SEQ ID NO: 110476 - DNA, 756 bp, Homo sapiens
  misc_feature: GYAE6OF02JRR7S.53.10.A10.1.454.CMB.1.raw
  modified_base (239)..(239): a, c, t, g, unknown or other
  misc_feature (239)..(239): n is a, c, g, or t
  modified_base (324)..(324): a, c, t, g, unknown or other
  misc_feature (324)..(324): n is a, c, g, or t
  modified_base (338)..(338): a, c, t, g, unknown or other
  misc_feature (338)..(338): n is a, c, g, or t
tcagcgcgtatacacacgaccggtgctcgatttagcgtcgatctcagggcacgaccggtgctcgatttagcgtcgatctcaggggctgggcctcaggaagcagcagtcggaggtgcctcagccatggcatggatccctctcttcctcggcgtccttgctactgcacaggctccgcggcctcctatgtagttcgactcacgaccctaccctcacgttcgtccgtccgtaccccgaggacncgaacaccgcccactacgtcctacgttgtcgtaggaataacctaacggtgacgtaacctaagttacttagtttcggtacggttanacctacgtagggcnccgtacgtcctccgtcccctgttcgttgactcgttagaactacgaaacgtacaaccgtacggtcccggtacctggtaaccgtcgtaccgttccggccgggtaacgttcctttccggccgtacggtacccgttaccgtaaccggtaccgtaaccgggtaaccgtaccgaccgtacccgtaccctaccggtacctaccggtacctaccgaccgggtacccggaacccgtacggaaccgttacggttaccggtaacggttcggtaaccggtcggttaacgttaaccgttaccggttaacctcggtaccgtaggttacggacggtaccggtaacggtacggtaacgttaacgggtttcgggtaccgggtacgggtccggggtaaaccgggtacccggtaaacgttccggtaccggtaccggg

SEQ ID NO: 110477 - DNA, 948 bp, Homo sapiens
  misc_feature: GYAE6OF02G8C42.53.10.A10.1.454.CMB.1.raw
tcagcgcgtatacacacgaccggtgctcgatttagcgtcgatctcagggcacgaccggtgctcgatttagcgtcgatctcaggggctgggcctcaggaagcagcatcggaggtgcctcagccatggcatggactccctctccttccgtcggccgtccttgtcctttactgccacgaggtactccggtggtccctccttagtcggtagttcgactcacgcccaccctcacctcgtcccgtcgtccccgaaggaccacgacacgacccaccagtccactttgttcctggagaactaaacgtaggaacgaaccctaaagttaacttagttttcggtttagggttaactaccgaaacgtaacgggaaccgggtacccgtacgggtccccgttccggtttaccccccgttggtttcggttttacgggtaccttaacggtttacggttaacttaccgaaaacggttaaacttaaaaccggtaaaaccggtcccgggtacccccgtttaacgttcggggacctaaccggttaccccgttgggggtaccgttaccgttttcccgttacggttccggggtacccttaaccccgtaaaccggtttcccggtaacggggtaaaacccgtaccggtaaaccggtcccgtaaccgtttcccgtaaccggtaaccctaccggttacccgaaccggggttaccccggggaaacccgtaaccggtaaccgggtttaaccggttagggtaaaccgggtaccgggtaacggggttaccgttaaaccggtttaaccggttttaaccgttttaaccgttacggttaccgacgtaaccgttaggggtaaccggaaacggaacggttaacggttaaacggttccgggtaaccggggttacggggttacccggggggaacccggggggttaaacctaacccggggttaccggtaccccgggtttaacccgg

SEQ ID NO: 110478 - DNA, 735 bp, Homo sapiens
  misc_feature: GYAE6OF02IV9KM.53.10.A10.1.454.CMB.1.raw
  modified_base (476)..(476): a, c, t, g, unknown or other
  misc_feature (476)..(476): n is a, c, g, or t
tcagcgcgtatacacacgaccggtgctcgatttagcgtcgatctcagggcacgaccggtgctcgatttagcgtcgatctcaggggctgggcctcaggaagcagcatcggaggtcgcctcagccatggcatggactcctctcttcctcgcgtccttgacttacgtgcacgagggtactccggtcggcctacctagtgtacgttgacctacaccgcccaccctcacttcggtcccgtccgtaccccgaggaccacgaccacgacccacactcctacgtttgttacgtacggaacgtaactaacgtggaaccgtaaccgtaagttacgttagtttcggttacggtaactaccgaaacgtacggtacggtaccggacggtcccttccgtccccgttgttacgggttccggtactacgttgttaactaacgtaaagaaccgtaaacgcggtacccggtccttcgacggactacggtcccgnggtactctacgtcgtacgcctaaccgtacgtacgaggacctacgacgtaccctacgtcgtacgaacctgtaccgggaccgaccggtacctagtaaccgtcgggtaacggtacggtcgtacggtacctaacgttaacctttacggtacggtaaccgtaggacggtcgttaaggtaccggggacaaacgggttacggtaggttccggtagggttaccggtaccggggaccggtaaactccgggttacgtccgggtaaccgg

SEQ ID NO: 110479 - DNA, 769 bp, Homo sapiens
  misc_feature: GYAE6OF02GL8UK.53.10.A10.1.454.CMB.1.raw
tcagcgcgtatacacacgaccggtgctcgatttagcgtcgatctcagggcacgaccggtgctcgatttagcgtcgatctcaggggctgggcctcagggaagcagcatcggaggtgcctcagccatggcatggatccctctcttcctcggcgtccttgcttactgcacaggactccggtggccctcctatggagttgactcacgcccaccctcactcgtcccgtcgtaccccaggaccacgaccacgcccaacctctacactttcgttcgtaggaataataaacgtggaacaacctaagttagttagttttggtaggtaactacgaaacgaggacggcctacggcccttccgtcccctgttggttcgtactagtagtatacgaagtactaaacgacggcccggtccctgtcggacctacgttcccgtggggtacctacgttcccgttcgtcggcccttaacccgtaacggttcccggtaaacgggaaaccctacgaccgtacccctaccgttccacccgtaaccgtaactccggtaaaccgggaccccgggaaccctaaggtaaccgttacgggtacgggtacgttacggggtaacgaccgttaaccgttaaccttttaacgttacccggttacgtaccgagggttaccgaaggtaccgggtaacgaacggttaacgtaacgggtttccgggtaccggggtttacgggggtacccgggggtaaacccgggggtaaccttaacccgggtaccgggtacccgttaacccggg

SEQ ID NO: 110480 - DNA, 824 bp, Homo sapiens
  misc_feature: GYAE6OF02H7JK0.53.10.A10.1.454.CMB.1.raw
tcagcgcgtatacacacgaccggtgctcgatttagcgtcgatctcagggcacgaccggtgctcgatttagcgtcgatctcgagggggctgggcctcaggaagcagcatcggaggtgcctcagccagtggcagtggactcccttcttccttcctccgggtcgttccttcgtctttactcgccgacgaggtctccggtcggtcctcctagtgtagttcgactccacgtcccaccctctaccgtcgttcccggtcgtcccgaaggacgaacgacacgccaccattcctacgtttcgttcgtaggtaacgaactaaacgtcggaacgtaacgtaagtttaatttaggttttaggttaggttacttaaccgaacgtacggtacggaccgtacggttcccgttcccgttacccctttcggttcggttacggtacttagttacgtactaaccgaacgtaacgtaacggacgtccggcccttacggtcgtaccttccgtcccggtacggtcccgtttacttccgttacggttaccgtaccctaacgttaacccgtgggtaacccgaaccacgtacgaccccgttctacgtaccgtaccctaacggtccggaacgggtacccggaacccgtaagggtaaccttcgggttaacgggacgttacggtaaccggtttacgaacgtttaaccgtttagttccggtacgttacggaacgttcgggaaagggtccggacgaaacgggttacctaacggggtttccgggtcggggtaccgggggttaaccggggaacccgggtaaaccttccggggtttaacccggtaccgttaaccggg

SEQ ID NO: 110481 - DNA, 716 bp, Homo sapiens
  misc_feature: GYAE6OF01EPSIS.44.18.B07.1.454.CMB.1.raw
  modified_base (274)..(274): a, c, t, g, unknown or other
  misc_feature (274)..(274): n is a, c, g, or t
  modified_base (398)..(398): a, c, t, g, unknown or other
  misc_feature (398)..(398): n is a, c, g, or t
tcagacagtatatacacgaccggtgctcgattttagtcgctgcgtaaaggagtaaaggggacggaaaggagacctgggtcatctacgatgtgacatcccagatgacccagtctcccttcctccctgtctcgtcctttctagtacggagacagagtccgccatccacttcgccgggacaagtcagacctaagttaacaggtcttaactttaaagttgggtactacgaaggccgaaggacgacccgaaggggaaacgtccccctaggtaacctccnggtacttctacgtgtcttccgccctactaccgtcgtgacgaagggtccgtagtcctactttagaacggttcagtggactggttacgacgttcgcgggaacttagtctttacgtctctcaccgtnaccgttcagttcagtaccctatacggtatttcttacgacccttaaacggttctaaccggttgaactaaccgattaacgttactccgtacccgttacccgttctaccggtttacggaccgggacctacgtcgtacggtacgtataccgaacgtacgtcgtcgtacgcgtacacctactaccgttgtacttacctacgttcccgtcccgtaccgtacttccgttaggacttaacgttacttaaccggtacggttcccgtagggtaaccgggtccgggttcggtaagggtacccggtaggtaccgtacggtattgacgtag

SEQ ID NO: 110482 - DNA, 495 bp, Homo sapiens
  misc_feature: GYAE6OF02FN2M5.44.18.B07.1.454.CMB.1.raw
  modified_base (386)..(386): a, c, t, g, unknown or other
  misc_feature (386)..(386): n is a, c, g, or t
  modified_base (411)..(411): a, c, t, g, unknown or other
  misc_feature (411)..(411): n is a, c, g, or t
  modified_base (462)..(462): a, c, t, g, unknown or other
  misc_feature (462)..(462): n is a, c, g, or t
  modified_base (489)..(490): a, c, t, g, unknown or other
  misc_feature (489)..(490): n is a, c, g, or t
  modified_base (495)..(495): a, c, t, g, unknown or other
  misc_feature (495)..(495): n is a, c, g, or t
tcagacagtatatacacgaccggtgctcgatttagtcgctgcgtaaagggaaggaaagggaggaaggtagactgggttacatactagagtgtgacatccagatgacccagtcttcccttcctccctgtctgcttctataggagacaggaggtcgccgatcgacttgccgggcaagtcagaccattaacagctatttaaattggtatcagcagagaccagggaaagcccctgaactcctgatctctgctgcctccactctgcaaggtggagtctcttcaaggttcagtggcagtggatctgggacagatttcactctcaccatctccagtctgcaacctgaagattttgcaacttactactgtcaacagagttatactgccccgttnacttttggcggggaccaagctgganatcaaacgactgtggctgcaccatctgcttcatccttccgccatctgactntatactgtctgagcggctggcaggcgnngtagn

SEQ ID NO: 110483 - DNA, 719 bp, Homo sapiens
  misc_feature: GYAE6OF02JKCST.44.18.B07.1.454.CMB.1.raw
tcagacagtatatacacgaccggtgctcgatttagtcgctgcgtaaaggaggaaagggaggaaggagactgggtcatctagatgtgacatccagatgacccagtctccttcctccctgtctgcttctataggagtactagagtcgtccatcacttgccgggcaagtcagaccattacagctatttaaatggtatcagcagagaccagggaaagcccctgaactcctgatctctcgctagcctccactctgcaagtgagtctcttcaaggttcagtggcagtggatcgtggacagattcacgtctcacatctcagtctgcaacctgaacgtattttgcgtaactttacgtactggtaccaactacgtagtttaactacttcgtccccggttactaccgtttttacgggtacccgggggtaacctaaacggtcgttacgggtaacggtaactttaaccgaaaaccggtaaacttacggttacgggtacctttccggacgtaaccccgaagtttaccgtagggtttaccttaccgttaacgttcccgtttttaccccccgggacctttaaacgttcccgttaaccggtaattaaaccgtttacttaaaccgttttaccggtttaccgttaacggttaaacgggggtcccgggttacccgtttaacgggggtaccttaaaccgggggttaccctaaccgggttaagtttaacggccgtaacgg

SEQ ID NO: 110484 - DNA, 569 bp, Homo sapiens
  misc_feature: GYAE6OF02II34U.44.18.B07.1.454.CMB.1.raw
  modified_base (161)..(161): a, c, t, g, unknown or other
  misc_feature (161)..(161): n is a, c, g, or t
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (397)..(397): a, c, t, g, unknown or other
  misc_feature (397)..(397): n is a, c, g, or t
  modified_base (423)..(423): a, c, t, g, unknown or other
  misc_feature (423)..(423): n is a, c, g, or t
  modified_base (553)..(553): a, c, t, g, unknown or other
  misc_feature (553)..(553): n is a, c, g, or t
  modified_base (556)..(556): a, c, t, g, unknown or other
  misc_feature (556)..(556): n is a, c, g, or t
  modified_base (558)..(560): a, c, t, g, unknown or other
  misc_feature (558)..(560): n is a, c, g, or t
  modified_base (562)..(569): a, c, t, g, unknown or other
  misc_feature (562)..(569): n is a, c, g, or t
tcagacagtatatacacgaccggtgctcgatttagtcgctgcgtaagggttcgtggatacagctttaccaattactggatcggctgggtgcgccagatgcccgggaaaggccgtggagtggatgggcatcatctatcctggtgactctgataccagatacngcccgtccttccaaggccaggtccaccatctcagcccgacaacgtccatccagcaccgcctacctgcagtggacgcagcctgaacggcctcggacaccgccatgattacngtgcgagacgagnggttagccttggtacttcctggttccgacccgtgggcgacgggaacccctggtccaccggtcctccgtccgacgccctccaaacgaacgggccctatccggtccttcccccgnggccctaccccttcccgccaaaccgngaccctacctcgtggggacccacgacggccggccctcgggcctggaccctggtacccaaggtaccctaccgttcaccgtctactcgacgtcgacggtccggcgtcggccgaaaggccgtaccagtaccgncgncnnngnnnnnnnn

SEQ ID NO: 110485 - DNA, 658 bp, Homo sapiens
  misc_feature: GYAE6OF02GIWTZ.44.18.B07.1.454.CMB.1.raw
  modified_base (219)..(219): a, c, t, g, unknown or other
  misc_feature (219)..(219): n is a, c, g, or t
tcagacagtatatacacgaccggtgctcgatttagtcgctgcgtaaggaggaaaggggaggaaggagacctgggtcagtctagatgtgacgatccagagtcgacccagtctccttcctcccgtgtcctgcttctataggagacacgagtcgccaatcacttgccggcaagtcagaccattaacagtctactttaatggtatcagcagagaccagggaancccctgaacctcctgattctccgtgctgcctcacttcgtgcgtaaggtcggtagttctcgttacgaaggttcaggtgggacacggtaggactcgtgggactagtatttacactctcacctatacgtccgagtctcgactacgtgaacgtattttcgactaactttctacgtgtacaactgtacgttactacctcgtcccgtttactacgttttcgggaccggggtacctaacggtcgttagggacgtacgtaccgtaaacgtacgttcggtacgtacgttagacctacctacgttacttcgttccgtttactactttacccgtttcccgtaccttaccttacgttacgtacgttacgttacgttacgtacggttacgtacggtaacggtccgggtacgtcgggtaccggtaacgggtccgtaacgtacgtacgacgtcg

SEQ ID NO: 110486 - DNA, 173 bp, Homo sapiens
  misc_feature: GYAE6OF01AYP7V.48.41.D08.1.454.CMB.1.raw
  modified_base (127)..(128): a, c, t, g, unknown or other
  misc_feature (127)..(128): n is a, c, g, or t
  modified_base (130)..(173): a, c, t, g, unknown or other
  misc_feature (130)..(173): n is a, c, g, or t
tcagagtatacatacacgaccggtgctcgatttagtcacgcgagaaagggaaaggggctggccctgacgtgtttctgttcccgcctcctctatgtatactctgagcgggctggcaaggccgcatagnntnnnnnnnnnnnnnnnnnnnnnnnnnnnnnnnnnnnnnnnnnnnn

SEQ ID NO: 110487 - DNA, 131 bp, Homo sapiens
  misc_feature: GYAE6OF01DS2TS.48.41.D08.1.454.CMB.1.raw
  modified_base (131)..(131): a, c, t, g, unknown or other
  misc_feature (131)..(131): n is a, c, g, or t
tcagagtatacatacacgaccggtgctcgatttagtcacgcgagaaagggaagggagtcactgctggtatgctccttcatcttcccgccatctgatatgtatactctgagcgggctggcaaggcgcatagn

SEQ ID NO: 110488 - DNA, 126 bp, Homo sapiens
  misc_feature: GYAE6OF01BHO7C.48.41.D08.1.454.CMB.1.raw
tcagagtatacatacacgaccggtgctcgatttagtcacgcgagaaagggaaaggggctggccttgacgtgtttctgttcccgccctcctctatgtatactctgagcgggctggcaaggcgcatag

SEQ ID NO: 110489 - DNA, 152 bp, Homo sapiens
  misc_feature: GYAE6OF01B207K.48.41.D08.1.454.CMB.1.raw
  modified_base (130)..(152): a, c, t, g, unknown or other
  misc_feature (130)..(152): n is a, c, g, or t
tcagagtatacatacacgaccggtgctcgatttagtcacgcgagaaagggaagggggtcgtggccctgacgtgtttctgttcccgccctcctctatgtactactctgagcgggctggcaaggcgcatagnnnnnnnnnnnnnnnnnnnnnnn

SEQ ID NO: 110490 - DNA, 128 bp, Homo sapiens
  misc_feature: GYAE6OF01CA8DQ.48.41.D08.1.454.CMB.1.raw
  modified_base (128)..(128): a, c, t, g, unknown or other
  misc_feature (128)..(128): n is a, c, g, or t
tcagagtatacatacacgaccggtgctcgatttagtcacgcgagaaagggaaagggggctggccctgacgtgtttctgttcccaccctcctctatgtatactctgagcgggctggcaaggcgcatagn

SEQ ID NO: 110491 - DNA, 119 bp, Homo sapiens
  misc_feature: GYAE6OF01B3DUC.48.41.D08.1.454.CMB.1.raw
  modified_base (118)..(119): a, c, t, g, unknown or other
  misc_feature (118)..(119): n is a, c, g, or t
tcagagtatacatacacgaccggtgctcgatttagtcacgcgagaaagggaaaggggacgtgtttctgttcccgccctcctctatgtatactctgagcgggctggcaaggcgcatagnn

SEQ ID NO: 110492 - DNA, 126 bp, Homo sapiens
  misc_feature: GYAE6OF01CARKO.48.41.D08.1.454.CMB.1.raw
  modified_base (126)..(126): a, c, t, g, unknown or other
  misc_feature (126)..(126): n is a, c, g, or t
tcagagtatacatacacgaccggtgctcgatttagtcacgcgagaaagggaaggggctggccctgacgtgtttctgttcccaccctcctctatgtatactctgagcgggctggcaaggcgcatagn

SEQ ID NO: 110493 - DNA, 127 bp, Homo sapiens
  misc_feature: GYAE6OF01EOZFO.48.41.D08.1.454.CMB.1.raw
tcagagtatacatacacgaccggtgctcgatttagtcacgcgagaaagggaaagggggctggccctgacgtgtttctgttcccaccctcctctatgtatactctgagcgggctggcaaggcgcatag

SEQ ID NO: 110494 - DNA, 128 bp, Homo sapiens
  misc_feature: GYAE6OF01BH4YK.48.41.D08.1.454.CMB.1.raw
  modified_base (128)..(128): a, c, t, g, unknown or other
  misc_feature (128)..(128): n is a, c, g, or t
tcagagtatacatacacgaccggtgctcgatttagtcacgcgagaaagggaaagggggctggccctgacgtgtttctgttcccgccctcctctatgtatactctgagcgggctggcaaggcgcatagn

SEQ ID NO: 110495 - DNA, 483 bp, Homo sapiens
  misc_feature: GYAE6OF01CKT0I.48.41.D08.1.454.CMB.1.raw
  modified_base (262)..(262): a, c, t, g, unknown or other
  misc_feature (262)..(262): n is a, c, g, or t
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
  modified_base (395)..(396): a, c, t, g, unknown or other
  misc_feature (395)..(396): n is a, c, g, or t
  modified_base (400)..(401): a, c, t, g, unknown or other
  misc_feature (400)..(401): n is a, c, g, or t
  modified_base (403)..(404): a, c, t, g, unknown or other
  misc_feature (403)..(404): n is a, c, g, or t
  modified_base (407)..(407): a, c, t, g, unknown or other
  misc_feature (407)..(407): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (433)..(434): a, c, t, g, unknown or other
  misc_feature (433)..(434): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (450)..(451): a, c, t, g, unknown or other
  misc_feature (450)..(451): n is a, c, g, or t
  modified_base (453)..(454): a, c, t, g, unknown or other
  misc_feature (453)..(454): n is a, c, g, or t
  modified_base (456)..(459): a, c, t, g, unknown or other
  misc_feature (456)..(459): n is a, c, g, or t
  modified_base (461)..(461): a, c, t, g, unknown or other
  misc_feature (461)..(461): n is a, c, g, or t
  modified_base (465)..(469): a, c, t, g, unknown or other
  misc_feature (465)..(469): n is a, c, g, or t
  modified_base (474)..(476): a, c, t, g, unknown or other
  misc_feature (474)..(476): n is a, c, g, or t
  modified_base (478)..(478): a, c, t, g, unknown or other
  misc_feature (478)..(478): n is a, c, g, or t
  modified_base (481)..(481): a, c, t, g, unknown or other
  misc_feature (481)..(481): n is a, c, g, or t
tcagagtatacatacacgaccggtgctcgatttagtcacgcgagaaagggaaagggccggattcaccatctccagagacaacgccaagcactcactgtatctccaaatgaacagcctgagagccgacgacacggctgtgtattactgtgcgagacttgggagagagtgggacctactgttccactttgactacgtggggccacgggaaccctggtcaccgtctcctcagcctccacgaagggcccagtccggtcttccccgnggccacccgtctccaagacgccaacctctgggggccacgacgcggccctgggctcgcctggtcacggactacttcctatgtatactntcgagcgggtctggcaaggcncagtagncngcagcagcgcntcgcnncganncnngtnagcgtcgatcgntgcncgnactngcnncncnttttttttttcnncnncnnnngngcgnnnnngcgcnnncncgngc

SEQ ID NO: 110496 - DNA, 132 bp, Homo sapiens
  misc_feature: GYAE6OF01DI08X.48.41.D08.1.454.CMB.1.raw
  modified_base (122)..(122): a, c, t, g, unknown or other
  misc_feature (122)..(122): n is a, c, g, or t
  modified_base (128)..(132): a, c, t, g, unknown or other
  misc_feature (128)..(132): n is a, c, g, or t
tcagagtatacatacacgaccggtgctcgatttagtcacgcgagaaagggaaagggggctggccctgacgtgtttctgttcccgccctcctctatgtatactctgagcgggctggcaaggcncatagnnnnn

SEQ ID NO: 110497 - DNA, 127 bp, Homo sapiens
  misc_feature: GYAE6OF02HUS4O.48.41.D08.1.454.CMB.1.raw
  modified_base (126)..(127): a, c, t, g, unknown or other
  misc_feature (126)..(127): n is a, c, g, or t
tcagagtatacatacacgaccggtgctcgatttagtcacgcgagaaagggaaggggctggccctgacgtgtttctgttcccgccctcctctatgtatactctgagcgggctggcaaggcgcatagnn

SEQ ID NO: 110498 - DNA, 175 bp, Homo sapiens
  misc_feature: GYAE6OF02HECE0.48.41.D08.1.454.CMB.1.raw
  modified_base (137)..(137): a, c, t, g, unknown or other
  misc_feature (137)..(137): n is a, c, g, or t
  modified_base (139)..(175): a, c, t, g, unknown or other
  misc_feature (139)..(175): n is a, c, g, or t
tcagagtatacatacacgaccggtgctcgatttagtcacgcgagaaagggaaagggggctggacccgtgaaccgtgtttcctgttcccggcctcctcctatgtatactctgagcgggctggcaaagggccgcatagntnnnnnnnnnnnnnnnnnnnnnnnnnnnnnnnnnnnnn

SEQ ID NO: 110499 - DNA, 129 bp, Homo sapiens
  misc_feature: GYAE6OF02JC3GA.48.41.D08.1.454.CMB.1.raw
  modified_base (96)..(96): a, c, t, g, unknown or other
  misc_feature (96)..(96): n is a, c, g, or t
  modified_base (117)..(129): a, c, t, g, unknown or other
  misc_feature (117)..(129): n is a, c, g, or t
tcagagtatacatacacgaccggtgctcgatttagtcacgcgagaaagggaaaggggactggtttctgttcccgcctcctctatgtatactctgancgggctggcaaggcgcatagnnnnnnnnnnnnn

SEQ ID NO: 110500 - DNA, 434 bp, Homo sapiens
  misc_feature: GYAE6OF02FI6QM.48.41.D08.1.454.CMB.1.raw
  modified_base (122)..(122): a, c, t, g, unknown or other
  misc_feature (122)..(122): n is a, c, g, or t
  modified_base (380)..(383): a, c, t, g, unknown or other
  misc_feature (380)..(383): n is a, c, g, or t
  modified_base (385)..(434): a, c, t, g, unknown or other
  misc_feature (385)..(434): n is a, c, g, or t
tcagagtatacatacacgaccggtgctcgatttagtcacgcgagaaagggaaaggggccgattcaccatctccagagacaacgccaagcactcactgtatctccaaatgaacagcctgaganccgacgacacggctgtgtattactgtgcgagaccttgggagagagtgggacctacctgttccactttgactactggggccagggaccctggtcaccgtctcctcagcctccaccaaggccccatcggtccttccccctggccaccctcctacccagacgccaccctctgggggccacagccggcccctggggcctcgccctggttccaaggtactacttccgtctctcgactctgacggtcggactggcaggcgcatnnnncnnnnnnnnnnnnnnnnnnnnnnnnnnnnnnnnnnnnnnnnnnnnnnnnnn

SEQ ID NO: 110501 - DNA, 573 bp, Homo sapiens
  misc_feature: GYAE6OF01EUPGD.42.66.F11.1.454.CMB.1.raw
  modified_base (322)..(322): a, c, t, g, unknown or other
  misc_feature (322)..(322): n is a, c, g, or t
  modified_base (398)..(398): a, c, t, g, unknown or other
  misc_feature (398)..(398): n is a, c, g, or t
tcagtgacgtatgtcacgaccggtgctcgatttagtcacgcgagaaaagggaaaggggggggtcacaagaggcagcgctctcgggacgtctccaccatggcctgggctctgctactcctcactctccttactcaggacacagggtcgtgggcccagtctgcatccgtgtctgggtctactggacagtcgatcatcatttctacattggtacctgcagtgattttggggctataacgttatttcctccagacaggggcccccaacgtcctcatttttgagggcagtgaggggcctcaggcctttgtgcgcctccggtaggtcngggcgtacgacggggcctccctgacaatctccggactccgagctgacgacgtacggtgattcgtattacgtcgctnatcgctcgccaagtctggctaatttcggaccctccgtgacctaatcgtctcggactccgaagtacgtagaagacgacgataattagttagtacgttcgacttaagttgtattcgtatagttcattcgtacccgtactactaccgtacgaccccgaagtcctccgccccgtaccgg

SEQ ID NO: 110502 - DNA, 482 bp, Homo sapiens
  misc_feature: GYAE6OF01D9VR4.42.66.F11.1.454.CMB.1.raw
  modified_base (231)..(231): a, c, t, g, unknown or other
  misc_feature (231)..(231): n is a, c, g, or t
  modified_base (447)..(482): a, c, t, g, unknown or other
  misc_feature (447)..(482): n is a, c, g, or t
tcagtgacgtatgtcacgaccggtgctcgatttagtcacgcgagaaaagggaaaaggggctggtgtgggtctcagctgttattggtgatgggagtaaacacaaagatacggggactccgtgaagggccgattcagcatctccagagacaacgccaagaaacacgttgtatctaggaaaatgaaacaatctgggagccgaaggacacggctgtctatttctgtgtaaaaagntctgggcggtaacaggtttctttagactagtgggtcagggaacctggtcaccgtctcctcagcctccaccaagggccatcggtcttccccctggccgccctgctccaggacgcacctccgagacgcacagccggccctgggcctgccgtggtacaaaggactacgttccacatacgtcacgtgagcgggctgggacaaacgggcgactacgtaagnnnnnnnnnnnnnnnnnnnnnnnnnnnnnnnnnnnn

SEQ ID NO: 110503 - DNA, 619 bp, Homo sapiens
  misc_feature: GYAE6OF02IIEF5.42.66.F11.1.454.CMB.1.raw
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
  modified_base (524)..(524): a, c, t, g, unknown or other
  misc_feature (524)..(524): n is a, c, g, or t
  modified_base (531)..(531): a, c, t, g, unknown or other
  misc_feature (531)..(531): n is a, c, g, or t
tcagtgacgtatgtcacgaccggtgctcgatttagtcacgcgagaaagggtaaaggggtcgtggtgtgggtctcagctgttattggtgatgggagtaacacaagatacggggactccgtgaagggccgtattcgagcatctccagagacaacgccaagacacgttgtatctggaaatgaacaatcctgggagccgaggacacggctgtctatttcngtntaaaagntctgggcgtanggttcgttgactactggggtcaggaacctggtcaccgtctctcgagcctccaccaagggcccagtcggtccttccccctggcgccctgcctccgaggcgcaccgtccgagacgcacacgccggccctgggctgcccgtggtaccaacggtaccttaccgttcccaacgtaagttacccggtactaaccgttcggacgggtccgggtaccgttacgggacccgtaaagggcccgaaccgtaacgttaacggcagtacgtacgtcgtagtcgcgtagtacgctagtccncgagcgngtacgacgacgacgtgtcgtgtacgtacgacgacgacgtacgcgtcgtaccgtacgtacgtacgacgtacgacgtcgtccgtcgtacg

SEQ ID NO: 110504 - DNA, 487 bp, Homo sapiens
  misc_feature: GYAE6OF02G4EAO.42.66.F11.1.454.CMB.1.raw
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (447)..(448): a, c, t, g, unknown or other
  misc_feature (447)..(448): n is a, c, g, or t
  modified_base (450)..(487): a, c, t, g, unknown or other
  misc_feature (450)..(487): n is a, c, g, or t
tcagtgacgtatgtcacgaccggtgctcgatttagtcacgcgagaaaagggaaagggggctggtgtgggtctcagctgttattggtgatgggagtaacacaagatacggggactccgtgaagggccgattcagcatctccagagacaacgccaagaacacgttgtatctggaaaatgaaacaatctggggagccgaggacacggctgtctatttcngtgtaaaaagntctgggcggtacaggtttcgtttgactacgtgggggtacaggggaaccctgggtcaccgtctcctcagcctccaccaagggcccatcggtccttccccctggccgcccctgcctccaggagccacctccggagagcacagcggccctgggctgccctggtcaaggactactaccacactacgtcactgcggcgggctggcaaacgggcgacgataaggcnnannnnnnnnnnnnnnnnnnnnnnnnnnnnnnnnnnnnnn

SEQ ID NO: 110505 - DNA, 533 bp, Homo sapiens
  misc_feature: GYAE6OF02FJ440.42.66.F11.1.454.CMB.1.raw
  modified_base (202)..(202): a, c, t, g, unknown or other
  misc_feature (202)..(202): n is a, c, g, or t
  modified_base (284)..(284): a, c, t, g, unknown or other
  misc_feature (284)..(284): n is a, c, g, or t
  modified_base (331)..(331): a, c, t, g, unknown or other
  misc_feature (331)..(331): n is a, c, g, or t
  modified_base (496)..(496): a, c, t, g, unknown or other
  misc_feature (496)..(496): n is a, c, g, or t
  modified_base (498)..(533): a, c, t, g, unknown or other
  misc_feature (498)..(533): n is a, c, g, or t
tcagtgacgtatgtcacgaccggtgctcgatttagtcacgcgagaaaagggaaaggggctggtgtgggtctcagctgttattggtgatgggagtaacacaagatacggggactccgtgaagggccgatccagcatctccagagacaacgccaagaacacgttgtatctggaaatgaacaatctgggagccgaggacacgggntgtctatttctgtagtaaaaagatctggggcggttacagggtttcgtttgacttacgtggggtcacgggtaaccctggtccnccgtctcctcagcctccaccaacgggcccagtccggtccttcccccnggtcccgtccctcgcctccaggacgcctaccgtccgacgcgacaccgacggcccggggtcccgtgggcctcggtcccggtagggtacaacggtactaccttccaactagtaccgtcacgtcggacggcgggtcgtcggaccgaacggccgacgtaagtggactgncnnnnnnnnnnnnnnnnnnnnnnnnnnnnnnnnnnnn

SEQ ID NO: 110506 - DNA, 497 bp, Homo sapiens
  misc_feature: GYAE6OF02GI2W3.42.66.F11.1.454.CMB.1.raw
  modified_base (224)..(224): a, c, t, g, unknown or other
  misc_feature (224)..(224): n is a, c, g, or t
  modified_base (442)..(442): a, c, t, g, unknown or other
  misc_feature (442)..(442): n is a, c, g, or t
  modified_base (459)..(459): a, c, t, g, unknown or other
  misc_feature (459)..(459): n is a, c, g, or t
  modified_base (461)..(461): a, c, t, g, unknown or other
  misc_feature (461)..(461): n is a, c, g, or t
  modified_base (463)..(497): a, c, t, g, unknown or other
  misc_feature (463)..(497): n is a, c, g, or t
tcagtgacgtatgtcacgaccggtgctcgatttagtcacgcgagaaaagggaaaggggctggtgtgggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtagtaaaaagntctggggcgtacaggttcgtttgactacgtggggtcagggaaccctggtcaccgtctcctcagcctccaccaagggcccctatcggttccttcccccctggccgtcccctgcctcccacgggcgccaccctccggagacgcaccgacgccgggcccttgggcctcggccctgggtacaaacggtactacttccacactaccgtcactggagccggtcnggcaagggcgcagtagntngnnnnnnnnnnnnnnnnnnnnnnnnnnnnnnnnnnn

SEQ ID NO: 110507 - DNA, 205 bp, Homo sapiens
  misc_feature: GYAE6OF01AP8D8.3.85.H08.1.454.CMB.1.raw
  modified_base (204)..(205): a, c, t, g, unknown or other
  misc_feature (204)..(205): n is a, c, g, or t
tcagagacgcactccacgaccggtgctcgatttagtatcactcagtcgcgggcacgaccggtgctcgatttagtatcactcacgcgggatgcataccgacacgggattccttgccaacaccggaggaccgttgatgatgactcgtgtttcaaagagacggctcgtcccgctggcgctgctgagcgggctggcaaggcgcatagnn

SEQ ID NO: 110508 - DNA, 210 bp, Homo sapiens
  misc_feature: GYAE6OF01DJ21E.3.85.H08.1.454.CMB.1.raw
  modified_base (204)..(210): a, c, t, g, unknown or other
  misc_feature (204)..(210): n is a, c, g, or t
tcagagacgcactccacgaccggtgctcgatttagtatcactcagtcgcgggcacgaccggtgctcgatttagtatcactcacgcgggatgcataccgacacgggattccttgccaacaccggaggaccgttgatgatgactcgtgtttcaaagagacggctcgtcccgctggcgctgctgagcgggctggcaaggcgcatagnnnnnnn

SEQ ID NO: 110509 - DNA, 208 bp, Homo sapiens
  misc_feature: GYAE6OF01B6OMZ.3.85.H08.1.454.CMB.1.raw
  modified_base (204)..(208): a, c, t, g, unknown or other
  misc_feature (204)..(208): n is a, c, g, or t
tcagagacgcactccacgaccggtgctcgatttagtatcactcagtcgcgggcacgaccggtgctcgatttagtatcactcacgcgggatgcataccgacacgggattccttgccaacaccggaggaccgttgatgatgactcgtgtttcaaagagacggctcgtcccgctggcgctgctgagcgggctggcaaggcgcatagnnnnn

SEQ ID NO: 110510 - DNA, 526 bp, Homo sapiens
  misc_feature: GYAE6OF01AMW3T.52.85.H08.1.454.CMB.1.raw
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggttctgtggcctcctatgacttgactcagccaccctcagtgtccgtgtcccccaggacagacagccaccatcacctgctctggacatcgattggggatatacatgtttcctggtatcagcagaagccaggccagtctcctgttcctcctcatctataaagatgtcaagccggccctcagggtactcccgtgacgcgtattctctggctcccaatttcgtaggaaatgcacgccactctgaccatccagccgggaccccagccctagtcggatgaggctgacttattactgtcgaggtcggtaggacgtaggttaggtttgtgtcgtttgggcggagggtccgagcgtcgaccgtccgtacgtcgacgacccgacgtccgtcggtcccccg

SEQ ID NO: 110511 - DNA, 516 bp, Homo sapiens
  misc_feature: GYAE6OF01EFX1P.52.85.H08.1.454.CMB.1.raw
  modified_base (312)..(312): a, c, t, g, unknown or other
  misc_feature (312)..(312): n is a, c, g, or t
  modified_base (419)..(419): a, c, t, g, unknown or other
  misc_feature (419)..(419): n is a, c, g, or t
  modified_base (464)..(464): a, c, t, g, unknown or other
  misc_feature (464)..(464): n is a, c, g, or t
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaagttggggggaaaatatgcttgctggtatcaacagcggccaggccagtccccctgtactggtcatctatctgaatagtaggcgccctntgggatccctgaccgtattctctggcctcccactctagggaacacacgccactctgaccatcgagccgggacccaggtctttggatggaggctgactattactgtcnggcgtgggacaccatcacgtggaatatagtcggacggacggacgnggcgtgaccgttccgaggccacggccccaaggcctcccggcccctggtaccc

SEQ ID NO: 110512 - DNA, 774 bp, Homo sapiens
  misc_feature: GYAE6OF01CNJB3.52.85.H08.1.454.CMB.1.raw
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatcgacctgactcacgcccaccctcagtcgtccgtgtcctccaggacagacacgcccacatccacctgctcgtaggaagtaagttaaagggtagggggaaaatagtcgtcgttgcgttaggtactacaacgaggccggaccgacggacccgaccgttcccgtaggtaaccgttggtactacttacttactacgtagtaaagtacggtacgggtccccggtccttcggttacgggtacctacccgtacggtaacccgtacttccgtccgtccgggtacccttaccccgccgttacggtaacccggggtaaaccacccgtaaccggtccctaaccgttccgaaccgtaaccccttagacccggaaccggggtcccgggaacccgtacgggtttacgtttacggaggttcggtacggtaccgtacgtaacgtttaacttcgtcgtaccggacgggtacggtaccggaacctaccgtaacgtccgtaacgggtagtaacgttaacgtccgggttaccgggaacgggtaccgggtaaccgacgggtacggtacccggtaaccggttccgacgggtacccgaacgaccccggtaacggtacccgtccccgtccccggttcgttaccccg

SEQ ID NO: 110513 - DNA, 784 bp, Homo sapiens
  misc_feature: GYAE6OF01EF0HE.52.85.H08.1.454.CMB.1.raw
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagcccaccctcagtcgtccgtgtcctccgaggacagacacgcccaaccactccacctcgctcgtaggagtaagtaaaagggttaggggggaaaaattacgtgtccgtttggacgttaggtactacgaaacgacggtccggaccgacggccctacgtcccccgtaggttacgtcggtcctacttactagttcgtagtaagttacggttacgggcccggtcccgttcggttacgggaccttcccgtacggtacccgttagtttccgtcgttaccggcccttaccccgtaaccgttccggtaacgggaaaccaccgaccggtaccctacgttacctacgaccctacgtaccgacggccggtaacccgtaggttccgttaggactcggtacggacgttacgttacgttaactttaccgtggtaccggtagggtaccggtaacgggaaccctaaccgtacttacccggtaacgtaggttaacgttaacggttacgggttccggggaccggggtaaccgggaccgtagggtacccgttacccgggtaccggtaccggttaccgggaccaaccccgggtaccgtaaccgggttcccccgtaccccggtccccgttccggttaaccccg

SEQ ID NO: 110514 - DNA, 721 bp, Homo sapiens
  misc_feature: GYAE6OF01BIZQR.52.85.H08.1.454.CMB.1.raw
  modified_base (185)..(185): a, c, t, g, unknown or other
  misc_feature (185)..(185): n is a, c, g, or t
  modified_base (578)..(578): a, c, t, g, unknown or other
  misc_feature (578)..(578): n is a, c, g, or t
tcagcgcagtacgacacgaccggtgctcgatttagtatcactcagtcgcggggctgggcctcaggaagcagcatcggaggtgcctcagccatggcatggactccctctcttcctcggcgtccttgacttactcgcacgaggtactccggtcggcccttcctatcgacctgactcacgccaccctnagtcgtccgtgtcctccgaggacagacacgcccacactccactcgtactcgtacggataagttaaagggtaggggaaaactgtacgtcgttgcgtaggtactacgaacgacggccggaccgacggtaccgtaccgttccccgtagtaccgtcggtactacttactacgtacgtaacggtaacgttaggtcccgggccgtacccgtcggtacgggtaccctcccggtacggtaccttcgttaccgtcggtcctccctacccgtacgtacggtaacgtaccaccgaccgtccgtacctacgacgtacacgtacgaccgggaccggtaaccgtggtacgtaggacgtcggagtacgtcgtacttacggtctggacggtcgggcgtaaccggtaacnccgattcgaggtaaggttatacgggttacgggaaccgggcgggtaaccgacggtacggtccgaccgggtaaccgtcgggacccggttaacggacccgtaaccgggttcgtaccccggtacccgtcccgggttacttaccccgg

SEQ ID NO: 110515 - DNA, 713 bp, Homo sapiens
  misc_feature: GYAE6OF01CARL3.52.85.H08.1.454.CMB.1.raw
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (692)..(692): a, c, t, g, unknown or other
  misc_feature (692)..(692): n is a, c, g, or t
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgaccctgactcacgcccaccctcacgtcgtccgtgtcctccaggacaggaccagccctaccataccacctgctcgtcggataagtaaaggtagggggaaaatntagtnttgcgtaggtactacaacgacgacggaccgaacggcctacgtccccgtaggtactggtacctgtactactacgtagtaactaggtacgggccgtaccctggacggtacttcccgtacgaccgtattccggtctacggcctacccgactccgtaagggaaaccacgactaccctactaccgtaccgaaccgtagtacccggaacgggtacccggtacccggtaggttacgtttacgggacgttacggaacggtacttaccgtagtttaaacttcggttaccgtacggtacggtaccgggacggtaacccgtactaacgtaccgttaacggttaacggacgttaacgttacgggtacgggtacccgggaaggacccgtaggtacccggttagcccggttacggacgtaccgtacggtacccgacggttacccncccgaccccgttcgaaccccg

SEQ ID NO: 110516 - DNA, 510 bp, Homo sapiens
  misc_feature: GYAE6OF02G2V2U.52.85.H08.1.454.CMB.1.raw
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattggggggaaaatatgcttgctggtatcaacagcggccaggccagtcccctgtactggtcatctatctgaatagtaggcggccctctgggactccctgaccgtattctctggctcccactcgtgggaacacacgccactctgaccatcagccggacccaggctttggatggagctgacttattactgtcagggcgtgggacaccgatcacgtggagtaatagttcggcggaggaccaggctggaccgtcgacggtcacgcccgaaggcctccgccccgtggtacc

SEQ ID NO: 110517 - DNA, 538 bp, Homo sapiens
  misc_feature: GYAE6OF02HXOHT.52.85.H08.1.454.CMB.1.raw
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatccacctgctctggagataaagttggggggaaaatatgcttgctggtatcaacagcggccaggccagtcccctgtactggtcatctatctgaatagtaggcggcctctggagtcctgaccgacttctctgctcccactctggacacacgcactctgaccatcacgcgggacccaggctttggatcggaggctcgactatttacctgtcgaggcggttacgggacaccatcgacgtgggtaataagtaagttccgggaccgggaggggaccgagggccgttggaacccgtcgtaaggtccacgcccgaaggcccgtccgccccgtcggtacccg

SEQ ID NO: 110518 - DNA, 580 bp, Homo sapiens
  misc_feature: GYAE6OF02JEA5E.52.85.H08.1.454.CMB.1.raw
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaagttaggggggaaaatatgcttgctggtatcaacagcggccaggccagtcccctgtacgtggtcatctatctgaatagtaggcgccctcgtgggactcccgtgaccgtattcctcgtcggcctcccactcgtagggaacacacgccactctcgaccatccgacgccgggacccaggtcttaggacgtggacggctgacttacttacgtgtcgagggtcggtacgggaccaccgagtaccgacgtagtacgtaaagtacgttacgggacggacgggaccgaggtccgtacggacccgtccgtacggtaccgacggacccgtaacgggtcccgtcccggtcccccgtcggttaccccg

SEQ ID NO: 110519 - DNA, 556 bp, Homo sapiens
  misc_feature: GYAE6OF02HSMFI.52.85.H08.1.454.CMB.1.raw
  modified_base (220)..(220): a, c, t, g, unknown or other
  misc_feature (220)..(220): n is a, c, g, or t
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctgganataaagttgggggaaaatagtgcttgctggtatcaacagcggcaggccagtcccctgtactggtcatctatctgaatagtaggcggccctcgtgggactcccgtgaccgtattctctcggcctcccactcgtggaacacagccactctacgaccatcaggccgggacccaggtctttaggatggaggtctagtacttattacgtgtcagggcgtacgggacaccgatctacgtggaacgttaagtagttcgggacggacgggaccgagggtctacggacccgtcgtacggtccgacggaccccgaaggtcccgtccggtcccccgtacggtacccg

SEQ ID NO: 110520 - DNA, 590 bp, Homo sapiens
  misc_feature: GYAE6OF02IZP56.52.85.H08.1.454.CMB.1.raw
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaagttaggggggaaaatatgcttgctggtatcaacagcggccaggccacgtcccctgtactggtcatctatctagaatagtagggccgtccccgtcgtcgggactccccgtgacccgtattctcgtcggcctccccactcgtagggaaccacgacgcccactctgacctatcgacggccgggacccaggtcgtttaggatggagtctagtactattacgtgtacgagggtcgtacgggaccaccgtatcacgtggtaacttaagtacgttcgggacggacgggaccgtacggtccgtaccggacccggttaccggtacggtaccgtaccgacccgacggtcccgtccggtccccccggttggtaccc

SEQ ID NO: 110521 - DNA, 630 bp, Homo sapiens
  misc_feature: GYAE6OF02J1D02.52.85.H08.1.454.CMB.1.raw
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctgagataaattgggggaaatatgcttgcgtggtatcaacagcggccgaggccagtcccctgtactggtcatctaatctagaatagtaggcggccctcgtgggactcccgtgaccgtattcgtctggcctccactcgtagggaaccacgacgaccactctcgacctagtcacggtcccgggacccgagggtcctttacgggagttcggacggtacgtacgtaaccgttacgtttaacgtggttaccgacgggtacgtacggggaacctaccgtaacgtacgtaaccgtagggtaacgttaagtaacgttacgggaccgggacgggaccgtaccgggaacgtccggtacccggtaccgttaccgggtcgtaaccggcccggaaacggtcccgtaaccggtcccccgtaccggtaccc

SEQ ID NO: 110522 - DNA, 594 bp, Homo sapiens
  misc_feature: GYAE6OF02F5UFY.52.85.H08.1.454.CMB.1.raw
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaagttggggggaaaatatgcttgctggtatcaacagcggccaggccacgtcccctgtactggtcatctatctagaatagtaggcggccctcgtgggactccgtgaccgtattcctcgtcggcctcccactcgtacggaactacacgccactctgaccatcgagccggaccgaggtctttggatggacggtctagtacttagttacgtgtcgacgggtcggtacgggacaccgtatacacgttaggaacgttaagttacggttcgggacgggacgggaccgagggtccgtacggtaacccggttaccgtagggttacccgaacggtacccgaaacgggtccgtacccggtccccccggttcggttaaccccg

SEQ ID NO: 110523 - DNA, 646 bp, Homo sapiens
  misc_feature: GYAE6OF02IQCXX.52.85.H08.1.454.CMB.1.raw
  modified_base (260)..(260): a, c, t, g, unknown or other
  misc_feature (260)..(260): n is a, c, g, or t
  modified_base (294)..(294): a, c, t, g, unknown or other
  misc_feature (294)..(294): n is a, c, g, or t
  modified_base (320)..(320): a, c, t, g, unknown or other
  misc_feature (320)..(320): n is a, c, g, or t
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggaccagacacgccacactcacctgctcgtgagataaagttagggggaaaatagtgcttgctggtatcaangcgccagccagtccctgtactggtcatctatctnaataggtagcgccctcgtggctccgngcgtatctcgtcgcctcccactcgtacgggaacacgacggccactacgtcgaaccatacgaacgggaccgggaccccggaaggttcgtttaggtacgtcggacgggtacgttccgtaaactttacgtttaacgttacggtacggtaacgggtcggttaaccggggaaccaaccgtactaccgtacggtacggtaaggttaaagttacgttaccggggaccgggacggggaaccgtacgggtaacgtaccgggtaaccggttccgtaacggtaccgtacggaccccggtaacgggcccgttaccggtacccccgttacggtaccccg

SEQ ID NO: 110524 - DNA, 620 bp, Homo sapiens
  misc_feature: GYAE6OF02G6GTK.52.85.H08.1.454.CMB.1.raw
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccgatcacctgcctctggagataaagttaggggggaaaatatgcttgctggtatcaacagcggccaggccacgtcccctgtactggtcatctatctagaatagtaggccggccctcgtcgggactccctgaccgtagttcctcgtcggtcctcccgactcgtacgggtaaccacgacgcccactccgtcgacctatccgacggcccgggacccgacggtctttacggactggacggtcgtacgtacttacgttacgtgtccgagggtcgtagggaccaccgatcgacgttaggagttaacgttcgttaccgggacgggtacgggaccgtacgggtccgtaccgggtacccgtaccggttaccggttaccgaccggtaccccgtaaggccccgtccgtaccccccggttcggtaccccg

SEQ ID NO: 110525 - DNA, 690 bp, Homo sapiens
  misc_feature: GYAE6OF02FKMKD.52.85.H08.1.454.CMB.1.raw
  modified_base (219)..(219): a, c, t, g, unknown or other
  misc_feature (219)..(219): n is a, c, g, or t
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagcaccatcacctgctctgganataaattggggggaaaatatgacttgctggtatcaacagcgccaggccagtcccctgtactggtcatctatctagaatagtaggtcggccctctgggactcctgaccgtattcgtctacggctacccactcgtacgggaaccacgacgcctactctacgaccctatacaacggccgggaaccccgtaggtcctttagggacttgggacggtcttacgggtacctttaagttaccttggtacgtacgggtaccggttacggggaacctaacccgtaacgttaccgtaaccggttaaggggtaaacgttaaacggttaccgtttaccgggggaccggggtaaggggaaccccgtagggggtaaccctacgggtaaccccggtttaacccggttaacggggttacccgaaccgggtaaccccggtaaccgggtcccggttaccccgggttcccccccgttacgggttacccccg

SEQ ID NO: 110526 - DNA, 610 bp, Homo sapiens
  misc_feature: GYAE6OF02HGC2M.52.85.H08.1.454.CMB.1.raw
  modified_base (220)..(220): a, c, t, g, unknown or other
  misc_feature (220)..(220): n is a, c, g, or t
  modified_base (337)..(337): a, c, t, g, unknown or other
  misc_feature (337)..(337): n is a, c, g, or t
  modified_base (453)..(453): a, c, t, g, unknown or other
  misc_feature (453)..(453): n is a, c, g, or t
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctgganataagttgggggaaaatagtgcttgctggtatacaacagcggccaggccacgtcccctgtacgtggtcatctatctagaataggtaggccgccctcgtcggtactcccgtgaccgtnttctcgtcggtcctcccacgtcgtacgggaaccacgacgccctactcgtacgacccagtcgacggcccgggaccctaggtcctttagggatcggacggtcttagtaccttattcgngtcgaggtcgtagggaaccacgtactcgtaacgtggtaaagttaacgtacggttccgggaacgggtaccggacgtacgggtcctaccgggtaacccgtccgttaacggccaccggtacccgtacggtccccgtacccggtcccccggtacgtacccg

SEQ ID NO: 110527 - DNA, 801 bp, Homo sapiens
  misc_feature: GYAE6OF02JVGLO.52.85.H08.1.454.CMB.1.raw
  modified_base (211)..(211): a, c, t, g, unknown or other
  misc_feature (211)..(211): n is a, c, g, or t
tcagcgcagtacgacacgaccggtgctcgatttagtatcactcagtcgcggggctgggcctcaggaagcagcatcggaggtgcctcagccatggcagtggatccctctcttcctcggcgtccttgcttactgccacgagatccgtgcctcctatcgacctgactcacgtccacctgagtcgtcgtcgtctccgagtcagcacgtaccactntccacctgactcgtgatagtaaaggttacggggtaatatcgtatacgtcgtagtactacgaactacggtccgacgtacggccgtacgtccccgtagtaccgtgtaccgtactacgtcttacgacgtaaacgtgggttaccggccggttaccgtcggtacggttaccaccgtacggtaaccgtaccttcgttaacgtccgaccctttacgtacgttcggtaacggaaccgtcgaaccggtacctcttaccgtacgtaccctaaggtacccgttaccggaccgggtacccgtagggtttaccgtacgggtaagtccgggtaaacgtccgttaacgttaacccgtttacgttacccgtaccgggttggtaacccgggtacggttacccgggtaaacttacccgggtaatttaacccgggaacgtttaacgggttaccttaaacccgggttggttaaccggggaacccggggtttacggtaccgtaaccgggttaacccgggtaacgtttacgggtacccggttaacggtcccgggtaaccggtacccggtaggttaccccccggtaccggtaccccttaccggttaaccccgg

SEQ ID NO: 110528 - DNA, 107 bp, Homo sapiens
  misc_feature: GYAE6OF01EQTVL.53.15.B04.1.454.CMB.1.raw
  modified_base (86)..(86): a, c, t, g, unknown or other
  misc_feature (86)..(86): n is a, c, g, or t
  modified_base (107)..(107): a, c, t, g, unknown or other
  misc_feature (107)..(107): n is a, c, g, or t
tcagcgcgtatacacacgaccggtgctcgatttagacagtatatatccgcgggcacgaccggtgctcgatttagcagacgtctgancgggctggcaaggcgcatagn

SEQ ID NO: 110529 - DNA, 174 bp, Homo sapiens
  misc_feature: GYAE6OF01E15MP.53.15.B04.1.454.CMB.1.raw
  modified_base (159)..(174): a, c, t, g, unknown or other
  misc_feature (159)..(174): n is a, c, g, or t
tcagcgcgtatacacacgaccggtgctcgatttagacagtatatatccgcgggttagacgagtatatatccgcgggcacgaccggtgctcgatttagctagtcactctgttcccaccctcctctcgtactgcgctgagcgggctggcaaggcgcatagnnnnnnnnnnnnnnnn

SEQ ID NO: 110530 - DNA, 145 bp, Homo sapiens
  misc_feature: GYAE6OF01C3I80.53.15.B04.1.454.CMB.1.raw
  modified_base (145)..(145): a, c, t, g, unknown or other
  misc_feature (145)..(145): n is a, c, g, or t
tcagcgcgtatacacacgaccggtgctcgatttagacagtatatatccgcgggcacgaccggtgctcgatttagtcgagctctctcgcgggcacgaccggtgctcgatttagcagacgtctgagcgggctggcaaggcgcatagn

SEQ ID NO: 110531 - DNA, 115 bp, Homo sapiens
  misc_feature: GYAE6OF01A6BPA.53.15.B04.1.454.CMB.1.raw
tcagcgcgtatacacacgaccggtgctcgatttagacagtatatatccgcgggcacgaccggtgctcgatttagctgcgtcacgatctctctgagcgggctggcaaggcgcatag

SEQ ID NO: 110532 - DNA, 107 bp, Homo sapiens
  misc_feature: GYAE6OF01BKEBA.53.15.B04.1.454.CMB.1.raw
  modified_base (107)..(107): a, c, t, g, unknown or other
  misc_feature (107)..(107): n is a, c, g, or t
tcagcgcgtatacacacgaccggtgctcgatttagacagtatatatccgcgggcacgaccggtgctcgatttagcagacgtctgagcgggctggcaaggcgcatagn

SEQ ID NO: 110533 - DNA, 106 bp, Homo sapiens
  misc_feature: GYAE6OF01DK45L.53.15.B04.1.454.CMB.1.raw
tcagcgcgtatacacacgaccggtgctcgatttagacagtatatatccgcgggcacgaccggtgctcgatttagcagacgtctgagcgggctggcaaggcgcatag

SEQ ID NO: 110534 - DNA, 177 bp, Homo sapiens
  misc_feature: GYAE6OF01A99EC.53.15.B04.1.454.CMB.1.raw
  modified_base (136)..(136): a, c, t, g, unknown or other
  misc_feature (136)..(136): n is a, c, g, or t
  modified_base (142)..(177): a, c, t, g, unknown or other
  misc_feature (142)..(177): n is a, c, g, or t
tcagcgcgtatacacacgaccggtgctcgatttagacagtatatagtccgcgggcgacgaccggtgctcgatttagtacacgtgattagggattgggtgatagggtacgcactcgtctgagcgggctggcaaggcncatagnnnnnnnnnnnnnnnnnnnnnnnnnnnnnnnnnnnn

SEQ ID NO: 110535 - DNA, 155 bp, Homo sapiens
  misc_feature: GYAE6OF01AL6OW.53.15.B04.1.454.CMB.1.raw
  modified_base (133)..(133): a, c, t, g, unknown or other
  misc_feature (133)..(133): n is a, c, g, or t
  modified_base (151)..(155): a, c, t, g, unknown or other
  misc_feature (151)..(155): n is a, c, g, or t
tcagcgcgtatacacacgaccggtgctcgatttagacagtatatatccgcgggcacgaccggtgctcgatttagacagtttatatccgcgggcacgaccggtgctcgatttagacagtatatatcgaggcggngtgacgaggcgatatagnnnnn

SEQ ID NO: 110536 - DNA, 300 bp, Homo sapiens
  misc_feature: GYAE6OF01DJM38.53.15.B04.1.454.CMB.1.raw
  modified_base (292)..(300): a, c, t, g, unknown or other
  misc_feature (292)..(300): n is a, c, g, or t
tcagcgcgtatacacacgaccggtgctcgatttagacagtatatatccgcgggcacgaccggtgctcgattttcgagctctctcgcgggcacgaccggtgctcgatttagtcgagctctctcgcgggcacgaccggtgctcgatttagtcgagctctctcgcgggagagctccgactaaagcaccggcgtgcctaaacccttcgatcgcgtctaaatcgagcaccggtcgtgctgcctggtcaaggactacttcctcgtactgcgctggagcgggctggcaaggcgcatagnnnnnnnnn

SEQ ID NO: 110537 - DNA, 147 bp, Homo sapiens
  misc_feature: GYAE6OF01A4ZMQ.53.15.B04.1.454.CMB.1.raw
  modified_base (146)..(147): a, c, t, g, unknown or other
  misc_feature (146)..(147): n is a, c, g, or t
tcagcgcgtatacacacgaccggtgctcgatttagacagtatatatccgcgggcacgaccggtgctcgatttagtcgagctctctcgcgggcacgaccggtgctcgatttagcagacgtctgtcgcgggctggcaaggcgcatagnn

SEQ ID NO: 110538 - DNA, 107 bp, Homo sapiens; identical to SEQ ID NO: 110532
  misc_feature: GYAE6OF01DSJ0F.53.15.B04.1.454.CMB.1.raw
  modified_base (107)..(107): a, c, t, g, unknown or other
  misc_feature (107)..(107): n is a, c, g, or t

SEQ ID NO: 110539 - DNA, 165 bp, Homo sapiens
  misc_feature: GYAE6OF01EJ8E4.53.15.B04.1.454.CMB.1.raw
tcagcgcgtatacacacgaccggtgctcgatttagacagtatatatccgcgggcacgaccggtgctcgatttagctctacgctcagggtcgatttagctctacgctcagggcacgaccggtgctcgatttagcagacgtctggagcgggctggcaaggcgcatag

SEQ ID NO: 110540 - DNA, 153 bp, Homo sapiens
  misc_feature: GYAE6OF01A8XFY.53.15.B04.1.454.CMB.1.raw
  modified_base (150)..(153): a, c, t, g, unknown or other
  misc_feature (150)..(153): n is a, c, g, or t
tcagcgcgtatacacacgaccggtgctcgatttagacagtatatatccgcgggcacgaccggtgctcgatttagacgacagctcagggcacgaccggtgctcgatttagtgacatctcgcagttctgagcgggctggcaaggcgcatagnnnn

SEQ ID NO: 110541 - DNA, 150 bp, Homo sapiens
  misc_feature: GYAE6OF01BREJO.53.15.B04.1.454.CMB.1.raw
  modified_base (139)..(139): a, c, t, g, unknown or other
  misc_feature (139)..(139): n is a, c, g, or t
  modified_base (145)..(150): a, c, t, g, unknown or other
  misc_feature (145)..(150): n is a, c, g, or t
tcagcgcgtatacacacgaccggtgctcgatttagacagtatatatccgcgggcacgaccggtgctcgatttagtcgagctctctcgcgggcacgaccggtgctcgatttagcagacgtctgcgcgggctggcaaggcncatagnnnnnn

SEQ ID NO: 110542 - DNA, 345 bp, Homo sapiens
  misc_feature: GYAE6OF01AFMM2.53.15.B04.1.454.CMB.1.raw
  modified_base (323)..(345): a, c, t, g, unknown or other
  misc_feature (323)..(345): n is a, c, g, or t
tcagcgcgtatacacacgaccggtgctcgatttagacagtatatatccgcgggcacgaccggtgctcgattttcgagctctctcgcgggcacgaccggtgctcgatttagtcgagctctctcgcgggcacgaccggtgctcgatttagtcgagctctctcgcgggagacgctccgactaaagcaccggcgtgccctaaacccgttgactcggcgttactaaaactcgaacgccaccggtcgtgcctcggcctaggtacgaaggtaccttaccttccgtcgtacgtggccgctgacggccgggactgggcaacggcgacatagnnnnnnnnnnnnnnnnnnnnnnn

SEQ ID NO: 110543 - DNA, 391 bp, Homo sapiens
  misc_feature: GYAE6OF01BAT7K.53.15.B04.1.454.CMB.1.raw
  modified_base (319)..(391): a, c, t, g, unknown or other
  misc_feature (319)..(391): n is a, c, g, or t
tcagcgcgtatacacacgaccggtgctcgatttagacagtatatatccgcgggcacgaccggtgctcgattttcgagctctctcgcgggcacgaccggtgctcgatttagtcgagctctctcgcgggcacgaccggtgctcgatttagtcgagctctctcggcgggagagcctccgaactaaaagccaaccggcgtcgacccttaaaaacccttgaactccgcgttactaaaacgtcgacgccaaccgggtcgtagcctgccctaggtaccaaaaggtaccttacttcccgtaccggtacgtcgccgtcgtaggacggnnnnnnnnnnnnnnnnnnnnnnnnnnnnnnnnnnnnnnnnnnnnnnnnnnnnnnnnnnnnnnnnnnnnnnnnn

SEQ ID NO: 110544 - DNA, 108 bp, Homo sapiens
  misc_feature: GYAE6OF02F9OI5.53.15.B04.1.454.CMB.1.raw
  modified_base (107)..(108): a, c, t, g, unknown or other
  misc_feature (107)..(108): n is a, c, g, or t
tcagcgcgtatacacacgaccggtgctcgatttagacagtatatatccgcgggcacgaccggtgctcgatttagcagacgtctgagcgggctggcaaggcgcatagnn

SEQ ID NO: 110545 - DNA, 146 bp, Homo sapiens
  misc_feature: GYAE6OF02GQGIV.53.15.B04.1.454.CMB.1.raw
  modified_base (146)..(146): a, c, t, g, unknown or other
  misc_feature (146)..(146): n is a, c, g, or t
tcagcgcgtatacacacgaccggtgctcgatttagacagtatatatccgcgggcacgaccggtgctcgatttagacagtatatatccgcgggcacgaccggtgctcgatttagcagacgtctgagcgggctggcaaggcgcatagn

SEQ ID NO: 110546 - DNA, 226 bp, Homo sapiens
  misc_feature: GYAE6OF02HYJ55.53.15.B04.1.454.CMB.1.raw
  modified_base (205)..(226): a, c, t, g, unknown or other
  misc_feature (205)..(226): n is a, c, g, or t
tcagcgcgtatacacacgaccggtgctcgatttagacagtatatatccgcgggcacgaccggtgctcgatttagacagttatatccgcgggcacgaccggtgctcgatttagacagtatatatccgcgggctggcaaggcgcatagctgcctggtcaaggactacttcctcgtactgcgctgagcgggctggcaaggcgcatagnnnnnnnnnnnnnnnnnnnnnn

SEQ ID NO: 110547 - DNA, 298 bp, Homo sapiens
  misc_feature: GYAE6OF02IWQWQ.53.15.B04.1.454.CMB.1.raw
  modified_base (291)..(298): a, c, t, g, unknown or other
  misc_feature (291)..(298): n is a, c, g, or t
tcagcgcgtatacacacgaccggtgctcgatttagacagtatatatccgcgggcacgaccggtgctcgattttcgagctctctcgcgggcacgaccggtgctcgatttagtcgagctctctcgcgggcacgaccggtgctcgatttagtcgagctctctcgcgggagagctccgactaaagcaccggcgtgcctaaacccttcgatcgcgtctaaatcgagcaccggtcgtgctgcctggtcaaggactacttcctcgtactgcgctgagcgggctggcaaggcgcatagnnnnnnnn

SEQ ID NO: 110548 - DNA, 295 bp, Homo sapiens
  misc_feature: GYAE6OF02HTNOU.53.15.B04.1.454.CMB.1.raw
  modified_base (288)..(295): a, c, t, g, unknown or other
  misc_feature (288)..(295): n is a, c, g, or t
tcagcgcgtatacacacgaccggtgctcgatttagacagtatatatccgcgggcacgaccggtgctcgattttcgagctctctcgcgggcacgaccggtgctcgatttagtcgagctctctcgcgggcacgaccggtgctcgatttagtcgagctctctcgcggagagctccgactaaagcaccggcgtgcctaaaccttcgatcgcgtctaaatcgagcaccggtcgtgctgcctggtcaaggctacttcctcgtactgcgctgagcgggctggcaaggcgcatagnnnnnnnn

SEQ ID NO: 110549 - DNA, 296 bp, Homo sapiens
  misc_feature: GYAE6OF02IBE9C.53.15.B04.1.454.CMB.1.raw
  modified_base (291)..(296): a, c, t, g, unknown or other
  misc_feature (291)..(296): n is a, c, g, or t
tcagcgcgtatacacacgaccggtgctcgatttagacagtatatatccgcgggcacgaccggtgctcgattttcgagctctctcgcgggcacgaccggtgctcgatttagtcgagctctctcgcgggcacgaccggtgctcgatttagtcgagctctctcgcgggagagctccgactaaagcaccggagtgcctaaacccttcgatcgcgtctaaatcgagcaccggtcgtgctgcctggtcaaggctacgttcctcgtactgcgctgagcgggctggcaaggcgcatagnnnnnn

SEQ ID NO: 110550 - DNA, 262 bp, Homo sapiens
  misc_feature: GYAE6OF02HL4KP.53.15.B04.1.454.CMB.1.raw
  modified_base (242)..(242): a, c, t, g, unknown or other
  misc_feature (242)..(242): n is a, c, g, or t
  modified_base (248)..(262): a, c, t, g, unknown or other
  misc_feature (248)..(262): n is a, c, g, or t
tcagcgcgtatacacacgaccggtgctcgatttagacagtatatatccgcgggcacgaccggtgctcgatttagacagtatatatccgcgggcacgaccggtgctcgatttagacagtatatagtccgcggcacgaccggtgctcggattttagctctacgctcgagggcacgaccggtgctcgatttagtctagcgacttccgcggggtaacgcactcgtctgagcgggctggcaaaggcncatagnnnnnnnnnnnnnnn

SEQ ID NO: 110551 - DNA, 107 bp, Homo sapiens; identical to SEQ ID NO: 110532
  misc_feature: GYAE6OF02F8MYF.53.15.B04.1.454.CMB.1.raw
  modified_base (107)..(107): a, c, t, g, unknown or other
  misc_feature (107)..(107): n is a, c, g, or t

SEQ ID NO: 110552 - DNA, 132 bp, Homo sapiens
  misc_feature: GYAE6OF02F60EH.53.15.B04.1.454.CMB.1.raw
  modified_base (131)..(132): a, c, t, g, unknown or other
  misc_feature (131)..(132): n is a, c, g, or t
tcagcgcgtatacacacgaccggtgctcgatttagacagtatatatccgcgggcacgaccggtgctcgatttagtacacgtgattagggatttgggctgatactactgagcgggctggcaaggcgcatagnn

SEQ ID NO: 110553 - DNA, 299 bp, Homo sapiens
  misc_feature: GYAE6OF02GZTJF.53.15.B04.1.454.CMB.1.raw
  modified_base (284)..(284): a, c, t, g, unknown or other
  misc_feature (284)..(284): n is a, c, g, or t
  modified_base (289)..(299): a, c, t, g, unknown or other
  misc_feature (289)..(299): n is a, c, g, or t
tcagcgcgtatacacacgaccggtgctcgatttagacagtatatatccgcgggcacgaccggtgctcgattttcgagctctctcgcgggcacgaccggtgctcgatttagtcgagctctctcgcgggcacgaccggtgctcgatttagtcgagctctctcgcgggagagctccgactaaagcaccggcgtgcctaaacccttcgatcgcgtctaaatcgagcaccggtcgtgctgcctggtcaaggctactttcctgtactgcgctgagcggctggcaaggcgnatagnnnnnnnnnnn

SEQ ID NO: 110554 - DNA, 223 bp, Homo sapiens
  misc_feature: GYAE6OF02GXI95.53.15.B04.1.454.CMB.1.raw
  modified_base (205)..(223): a, c, t, g, unknown or other
  misc_feature (205)..(223): n is a, c, g, or t
tcagcgcgtatacacacgaccggtgctcgatttagacagtatatatccgcgggcacgaccggtgctcgatttagacagtttatatccgcgggcacgaccggtgctcgatttagacagtatatatccgcgggctggcaaggcgcatagctgcctggtcaaggctacttcctcgtactgcgctgagcgggctggcaaggcgcatagnnnnnnnnnnnnnnnnnnn

SEQ ID NO: 110555 - DNA, 112 bp, Homo sapiens
  misc_feature: GYAE6OF02IDX5R.53.15.B04.1.454.CMB.1.raw
  modified_base (107)..(112): a, c, t, g, unknown or other
  misc_feature (107)..(112): n is a, c, g, or t
tcagcgcgtatacacacgaccggtgctcgatttagacagtatatatccgcgggcacgaccggtgctcgatttagcagacgtctgagcgggctggcaaggcgcatagnnnnnn

SEQ ID NO: 110556 - DNA, 148 bp, Homo sapiens
  misc_feature: GYAE6OF02FQGSE.53.15.B04.1.454.CMB.1.raw
  modified_base (145)..(148): a, c, t, g, unknown or other
  misc_feature (145)..(148): n is a, c, g, or t
tcagcgcgtatacacacgaccggtgctcgatttagacagtatatatccgcgggcgaccggtgctcgatttagacagtttatatccgcgggcacgaccggtgctcgatttagcagacgtctgtcgcgggctggcaaggcgcatagnnnn

SEQ ID NO: 110557 - DNA, 152 bp, Homo sapiens
  misc_feature: GYAE6OF02G0TBZ.53.15.B04.1.454.CMB.1.raw
  modified_base (147)..(152): a, c, t, g, unknown or other
  misc_feature (147)..(152): n is a, c, g, or t
tcagcgcgtatacacacgaccggtgctcgatttagacagtatatatccgcgggcacgaccggtgctcgatttagacagtatatatccgcgggcacgaccggtgctcgatttagcagacgtctgacgcgggctggcaaggcgcatagnnnnnn

SEQ ID NO: 110558 - DNA, 154 bp, Homo sapiens
  misc_feature: GYAE6OF01EATHA.29.25.C03.1.454.CMB.1.raw
  modified_base (154)..(154): a, c, t, g, unknown or other
  misc_feature (154)..(154): n is a, c, g, or t
tcagatagagtactcacgaccggtgctcgatttagtagtgtagatttgggtttggggaagaggaagactgacggtcctgccacagcggccctgggctgcctggtcaaggactacttccagtactctatctgagcgggctggcaaggcgcatagn

SEQ ID NO: 110559 - DNA, 129 bp, Homo sapiens
  misc_feature: GYAE6OF01AIFKV.29.25.C03.1.454.CMB.1.raw
tcagatagagtactcacgaccggtgctcgatttagtagtgtagatttgggtttgggcacagcggccctgggctgcctggtcaaggactacttcccgtgtctgatctgagcgggctggcaaggcgcatag

SEQ ID NO: 110560 - DNA, 524 bp, Homo sapiens
  misc_feature: GYAE6OF01BUB4G.29.25.C03.1.454.CMB.1.raw
  modified_base (444)..(444): a, c, t, g, unknown or other
  misc_feature (444)..(444): n is a, c, g, or t
  modified_base (480)..(480): a, c, t, g, unknown or other
  misc_feature (480)..(480): n is a, c, g, or t
tcagatagagtactcacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggagtgggggtggatcgaacgtacagactggtggcacagactatgcacgagggctccgagggcagctcaccatcgaccacagacacactcagacgaacacgagtacaacagtggagttggacggagcctgcgatcgngacgcgcggtcgtatacttactgtgcgagagtacgngcggcgtcgttcttgctacgtgggcgtggactgtcgtctcgtcc

SEQ ID NO: 110561 - DNA, 158 bp, Homo sapiens
  misc_feature: GYAE6OF01AHV89.29.25.C03.1.454.CMB.1.raw
  modified_base (156)..(158): a, c, t, g, unknown or other
  misc_feature (156)..(158): n is a, c, g, or t
tcagatagagtactcacgaccggtgctcgatttagtagtgtagatttgggtttggggggaagaggaagactgacggtcctgccacagcggccctgggctgcctggtcaaggactacttccagtactctatctgagcgggctggcaaggcgcatagnnn

SEQ ID NO: 110562 - DNA, 130 bp, Homo sapiens
  misc_feature: GYAE6OF02GEKPV.29.25.C03.1.454.CMB.1.raw
  modified_base (130)..(130): a, c, t, g, unknown or other
  misc_feature (130)..(130): n is a, c, g, or t
tcagatagagtactcacgaccggtgctcgatttagtagtgtagatttgggtttgggcacagcggccctgggctgcctggtcaaggactacttcccgtgtctgatctgagcgggctggcaaggcgcatagn

SEQ ID NO: 110563 - DNA, 155 bp, Homo sapiens
  misc_feature: GYAE6OF02HX5H6.29.25.C03.1.454.CMB.1.raw
  modified_base (155)..(155): a, c, t, g, unknown or other
  misc_feature (155)..(155): n is a, c, g, or t
tcagatagagtactcacgaccggtgctcgatttagtagtgtagatttgggtttgggggaagaggaagactgacggtcctgccacagcggccctgggctgcctggtcaaggactacttccagtactctatctgagcgggctggcaaggcgcatagn

SEQ ID NO: 110564 - DNA, 131 bp, Homo sapiens
  misc_feature: GYAE6OF02HE1JV.29.25.C03.1.454.CMB.1.raw
  modified_base (109)..(109): a, c, t, g, unknown or other
  misc_feature (109)..(109): n is a, c, g, or t
  modified_base (130)..(131): a, c, t, g, unknown or other
  misc_feature (130)..(131): n is a, c, g, or t
tcagatagagtactcacgaccggtgctcgatttagtagtgtagatttgggtttgggcacagcggccctgggctgcctggtcaaggactacttcccgtgtctgatctgancgggctggcaaggcgcatagnn

SEQ ID NO: 110565 - DNA, 547 bp, Homo sapiens
  misc_feature: GYAE6OF01BLH2V.52.17.B06.1.454.CMB.1.raw
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
tcagcgcagtacgacacgaccggtgctcgatttagtcgatagtgaaggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcacatctcctgcactggcaccaacagtgattttggtgttatgattctgtcttcgtggtaccaacggccacccaggcaaacgtcccccaaatcatgtacttactgatctcaatacgacgccctgacgggtccctgacgtcgcttcncgtcggctcagtcnggcaacgcgcctccngaccntcgtcgtggcctcgngtcngagntgacgctagtattnttcngctgctacatatcgcgcggcgtactacgtaccgttgtacggttccgttaccgggtaacgtaccgggacctacggtacccgacccgttccggttacggaccgaccgaccccgtaacggacccctaaccccg

SEQ ID NO: 110566 - DNA, 541 bp, Homo sapiens
  misc_feature: GYAE6OF01EC17M.52.17.B06.1.454.CMB.1.raw
  modified_base (361)..(361): a, c, t, g, unknown or other
  misc_feature (361)..(361): n is a, c, g, or t
  modified_base (403)..(403): a, c, t, g, unknown or other
  misc_feature (403)..(403): n is a, c, g, or t
tcagcgcagtacgacacgaccggtgctcgatttagtcgatagtgaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcaccaacagtgattttggtggttatgtattctgttcttctggtaccaacggcacccaggcaaacgtcccccaaactcatgattactgatatcaaataagacgccctcgaggggtccctgatcgcttctctggctcagtctgcaacncgcctcctgaccatctctcgggctccagctagaggatggagntagaatttattctgctgctcatatgcgaggcggctacacgtttatgtccgttacggtaacctcggggaccccagggtaccctacccggtaccgttacgggtacccaccggtaccccgaaaccggcccctaaacccccg

SEQ ID NO: 110567 - DNA, 654 bp, Homo sapiens
  misc_feature: GYAE6OF01D0ACO.52.17.B06.1.454.CMB.1.raw
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
  modified_base (306)..(306): a, c, t, g, unknown or other
  misc_feature (306)..(306): n is a, c, g, or t
tcagcgcagtacgacacgaccggtgctcgatttagtcgatagtgaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctctgcactgcaccacngtgtattttggngttatgtattctgttcttcgtcggtaaccaacggccaacccgaggacaaacgtccccaaactcatgtattacngatatacaatagcgcctgacgggtcctagactcgtcttctcgtcggtctaccgaagttcgtacggacctaaaccgaccggtccccttacccgtacgaaccctacttccgtcggtccgggtccttacccggaggtccgtaggagggtacgttagggaacggttccttaaggttaaactttcgttttaccgtggtccttacggtaccttacgtattacggtcgaccgtacgggtccggtaaccttaacgtactttacgcgtttaccggtaaccgggtaaccgtacggggacccttagggtccctacccggttcgtacgtaccgaccgaccccgaacggcccctaaacccg

SEQ ID NO: 110568 - DNA, 713 bp, Homo sapiens
  misc_feature: GYAE6OF01EN8WI.52.17.B06.1.454.CMB.1.raw
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
  modified_base (298)..(298): a, c, t, g, unknown or other
  misc_feature (298)..(298): n is a, c, g, or t
tcagcgcagtacgacacgaccggtgctcgatttagtcgatagtgaaggggggggtctcaggaggcagcactctcgggacgtctccaccatggcctgggctctgctcctcctcagcctcctcactcagggcacaggatcctgggctcagtctgccctgactcagcctcgctcagtgtccggtctccgtggacagtcagtcacatctctgcactgcaccaacngtgtattttggngttatgtattctgtcttcgtggtaccaacggcaccgaggacaaacgtccccaaatcatgattacngatatcaatagcgccctgacgggtcctgactcgtcttctcgtcggctaccgaagtccgtaggacctaaaccggccggtaccccttcccgtacgaaccctagttcccgttaccggtcgggtcccttacccggaggtccgttacggaagggtacttagggacgggtccttaagtaactttacgttttccgcgtaccgttcggtacctttaccgtaagttacgttacgggaccgtaacgggtcccgttaacttaaccgttaaccgtttacgttaccggttacccgtttaacggggtaaaacccgttcccgggggtaaaccccttacgggttacccccgttaaccccgggttacccggttaaccgggtaccccgaaccgggtaaccccccgtaaaccgggaccccccctaaaaccccgg

SEQ ID NO: 110569 - DNA, 587 bp, Homo sapiens
  misc_feature: GYAE6OF01DTZRP.52.17.B06.1.454.CMB.1.raw
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (298)..(298): a, c, t, g, unknown or other
  misc_feature (298)..(298): n is a, c, g, or t
  modified_base (409)..(409): a, c, t, g, unknown or other
  misc_feature (409)..(409): n is a, c, g, or t
tcagcgcagtacgacacgaccggtgctcgatttagtcgatagtgaagggggggtctcaggaggcagcactctcgggacgtctccaccatggcctgggctctgctcctcctcagccctcctcactcagggcacaggatcctggctcagtctgccctgactcagcctcgctcagtcgtccgggtctcctggacagtcagtcaccatctcctgcactggcacacngtgatttggngttatgtattctgtcttctcggtaccaacggccaaccaggcaaacgtccccaaactcatgattacnatatcaataagacgccctgacgggtccctgactcgtcttctctcggctacaagtctaggaccacgaccgccttcccagacctatcctcgtcggcctacgaggctagaggtntgagctagtaattctttctagtcgtcgacttacgtaatagtcggtacgacgggtccgtactaccttaacgttacgtcggttaccgttaaccgggtaaccgtacgggtaccccgtacggtaccctaccggttaccgttacgggtaccaaccggacccccgaaagtccccctaaaccccg

SEQ ID NO: 110570 - DNA, 635 bp, Homo sapiens
  misc_feature: GYAE6OF01DUYFD.52.17.B06.1.454.CMB.1.raw
tcagcgcagtacgacacgaccggtgctcgatttagtcgatagtgaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggccaccaacagtgtattttgggtggttatgtattctgtcttctggtaccaacggcaccaggacaaacgtccccaaactcatgattactgatatacaataagacgtccctcgacgggtccctgactcgtcttctcgtcggcctaccgaagtcgtaggaccaacgaccggtcccttcccgtacgaccctacttccgtaccgtcggggtaccctccggaggtccgtaggacggtagtacgggaacggtacgttaggtaaatttacgttttccgtaggtccttcgtcttactattacgtcgacggacgggtccgtacgttaacctactttagtcgttaccgttaccgggaaccgtcgggacccgtacggtacccgtaccgtaccgtacggtaccaccggtaccccgaacggcccctaaaccccg

SEQ ID NO: 110571 - DNA, 653 bp, Homo sapiens
  misc_feature: GYAE6OF01A1VHY.52.17.B06.1.454.CMB.1.raw
tcagcgcagtacgacacgaccggtgctcgatttagtcgatagtgaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcaccaacagtgtagtttggtgttatgtattctgtcttctcggtaaccaacggccacccgagacctaaacgtacccccaaactctatcgtaattacctagaatactaccgtaaattaacgacggtacccctacggtaacggggtcccctaggacttccgtactttcgtcgtcggtaccgtacctaagttccgtacggacctaacgacccggtccctacccgtgaccctattccgtcgtcgggcctccgaggtcgtagaggtagtcggtacggtacgttacgtaacgtttacttcggtactacgtcgtcctactagtacgtcggacgtacggccggtactactcgttagtccgttacgttaccgggaacgtccggaacccgtggtaccccgtaccgttccgttacggacctaccgacccgtaaccggcccctaaccccg

SEQ ID NO: 110572 - DNA, 563 bp, Homo sapiens
  misc_feature: GYAE6OF01CQ1KM.52.17.B06.1.454.CMB.1.raw
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (317)..(317): a, c, t, g, unknown or other
  misc_feature (317)..(317): n is a, c, g, or t
  modified_base (410)..(410): a, c, t, g, unknown or other
  misc_feature (410)..(410): n is a, c, g, or t
tcagcgcagtacgacacgaccggtgctcgatttagtcgatagtgaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcacaacagtgatttggngttatgattctgtctntgtacaacgcaccagcaaacgtccccaaatcatgattactgatatacaataagacgccctgagggtccngactcgcttctctggctacgaagtctaggacaacgaccggcctcctgacctatctcgtgggcctccgagctagagatgaggctagaatattcngctgtctacgtatagtcgacgacgggccgtacgtactaccttagtcggttaccgtacgggtaaccgtacggggaaccctacgggtacccgtaaccggttccccggtaacggttaccaaccgggtaccccaaaccgggcccctaaaacccccgg

SEQ ID NO: 110573 - DNA, 759 bp, Homo sapiens
  misc_feature: GYAE6OF01CZPZV.52.17.B06.1.454.CMB.1.raw
  modified_base (264)..(264): a, c, t, g, unknown or other
  misc_feature (264)..(264): n is a, c, g, or t
tcagcgcagtacgacacgaccggtgctcgatttagtcgatagtgaaggggggggtctcaggaggcagcactctcgggacgtctccaccatggcctgggctctgctcctcctcagcctcctcactcagggcacaggatcctgggctcgagtctcgccctgactcacgcctcgctcgagtcgtccggtctccgtggactagtcacgtccacctatcctcctgctacgtcggaccaaccaagtggtagttagttttgggtaggttangtactttcgtgttcttcgtacggtaaccgaaccggtccaccgaggactaaaccgtacccccaaactctactagtacttacgtagtaatacgtaactaaagtaacggtaccggtacccctacgggaccgggttccctagtaccttcgtacctttcgtcgtcggtacctaccgtaacgtcgtacggaccctaaccgtacccggtcccctacccgtacgtaccctacgttccgtcggtccgggtcctacccggaggtcgtacgggtaacggtagtacgggaacgtacgttaagtaacgtttacgtttcgcgtccgtcgtaccttagtaataccgtcggacggtaacgggtcctaccgtaacgttaacgtttactccggtttaccggtaaccgggtaaccgtacccggggtaaccccgtaccgggttacccgttaacccggttcccgtaacggtacccgaaccccggaaccccggaaacccgtacccccgtaaaccccg

SEQ ID NO: 110574 - DNA, 711 bp, Homo sapiens
  misc_feature: GYAE6OF01AVWUT.52.17.B06.1.454.CMB.1.raw
tcagcgcagtacgacacgaccggtgctcgatttagtcgatagtgaaggggggggtctcaggaggcagcactctcgggacgtctccaccatggcctgggctctgctcctcctcagcctcctcactcagggcacaggatccgtgggctcagtctgccctgactcagcctcgctcagtcgtccggtctccgtggactagtcagtcacctattcctccgtgctacgtggaccaccaacagtgtagttttggtgttatgtattctgttcttcgtcggtaccaacggccacccgaggaccaaacgtacccccaaatctaagtcgtacttacgtgaatactactaaagtaacgtacggtaccctaggaccgggttcctagtacgtccgtcttcgtacgtcggtacctaccgtaacgtccgtacgaaccgtaaccgaccggtccctacccgtacgacccgtactccgtccgtacgggtccttaccggaggtaccgtggaaacggtgtcggaacggtcgtaacgttaagttcgtttcgtacgtccgttacgtcctaagtacgtacgtagacccggtacggtaccgtaccttacgttaaccttcgtccgggttaacgttaccggaacggttccggaacccgttaccggtacccgttaccggttacccggtaacggtccccgtaaaccggtacccccggtaaacggtccccctaaaccccgg

SEQ ID NO: 110575 - DNA, 661 bp, Homo sapiens
  misc_feature: GYAE6OF01D2O3O.52.17.B06.1.454.CMB.1.raw
  modified_base (378)..(378): a, c, t, g, unknown or other
  misc_feature (378)..(378): n is a, c, g, or t
  modified_base (413)..(413): a, c, t, g, unknown or other
  misc_feature (413)..(413): n is a, c, g, or t
tcagcgcagtacgacacgaccggtgctcgatttagtcgatagtgaagggggggtctcaggaggcagcactctcgggacgtctccaccatggcctgggctctgctcctcctcagcctcctcactcagggcacaggatcctggctcagtctgccctgactcagcctcgctcagtgtccgggtctcctggacagtcagtcaccatctcctgcactggccaccaacagtgtattttggtggttatgattctgtcttctggtaccaacggcacccaggcaaacgtccccaaactcatgattactgatatcaataagacgccctcgacggggtccctgactcgcttctctcggctccaagtctcggcaacacggccctccctanaccgatccgtccgtgggcctccgaggtctggacgngtgaggtccttagtaacgttacttttcgtgtcgttcgtccttctaagtagttcggaccggtacgggtacccggtaccttaaccgtaccgttttaacgttcggttttacccgtttaccggggtaaaacccggttcgggggtaacccccgttaacgggttaccccggtaaccccggttaccccggtttacgggttaccccgaacccgggtaccccccgaaaaccggggtacccccctaaaacccccccgg

SEQ ID NO: 110576 - DNA, 669 bp, Homo sapiens
  misc_feature: GYAE6OF01B4FJ8.52.17.B06.1.454.CMB.1.raw
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
tcagcgcagtacgacacgaccggtgctcgatttagtcgatagtgaaggggggggtctcaggaggcagcactctcgggacgtctccaccatggcctggctctgctcctcctcagcctcctcactcaggcacaggatcctggctcagtctgccctgactcagcctcgctcagtcgtccgggtctccgtggacagtcacgtcaccatctcctcgcacgtggcaaccaacngtgtagttttggngttactgtattctcgttcttacgtacggtaaccaaccggccaacccgtaaggacctaaacgtccccaaaactccgaatcgtacttaacagtaattatacaaagtaacgacggaccctcggacgggtccctagtacgtcgtcttacgtcgtacggtcctaccgaagttcctacggacctaaccgaccggtcctacccggtacgactacgtcgtacgtcggtcctacgacgtcgtaggacggtacgtcgggacgtctaaaggtaactttacgtttcgacgtctacgtctacctaagtacttacgcgtacggtccgtactaaacgtgttaccgtcggttaccggttacggtaaaccgttccggaacccgtacggtaccctacccggttcccggtacgtacccgaaccggacccctacggaccccctaacccg

SEQ ID NO: 110577 - DNA, 772 bp, Homo sapiens
  misc_feature: GYAE6OF01AK3WZ.52.17.B06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (349)..(349): a, c, t, g, unknown or other
  misc_feature (349)..(349): n is a, c, g, or t
tcagcgcagtacgacacgaccggtgctcgatttagtcgatagtgaaggggggggtcgtcaggaggcgagcactctcgggacgtctccaccatggcctgggctctgctcctcctcacgcctcctcactcagggcacaggatccgtgggctcagtctgccctgactcacgccctcgctcgagttcgtccgggtctccgnggaccngtcagtcacctatcttccngcactcgacaccaacgtgtgttagttttgggagttaattgtactttccgtgtttcttcgtacgggtacccaaggtcccaaccgaacgactaacccgtaccccaaacgtctagtacgttacttacgtntacgtaactacgaaacgtaagggccgtaccccgttacggaccgggggttacccttaggccttaaccgttcccgtttactccggtacggtccctactaacggttcgtccgaaaccctaacggtaccccggtcccttacccgcgttaacacctttccgtcccggtacggggtaccctcggtaaccggtcggtaacgtaagggtccgtaggggtacggtacttaaggtaaactttctttcgtggttacctcggacctttacgaagttacgttccggaccggtcgggtaccgttacctaccttagggttccctagggtttacccggttaacgaccgggttacccggtacccgtagggtccccgttccgggtaccctttaacccggtacccgacccggtaacccgacccgggttacccccgaaacccg

SEQ ID NO: 110578 - DNA, 663 bp, Homo sapiens
  misc_feature: GYAE6OF01CC52Q.52.17.B06.1.454.CMB.1.raw
tcagcgcagtacgacacgaccggtgctcgatttagtcgatagtgaaggggggggtctcaggaggcagcactctcgggacgtctccaccatggcctgggctctgctcctcctcagcctcctcactcagggcacaggatccgtgggctcagtctgccctgactcagcctcgctcagtcgtccgggtctccgtggacagtcagtcacctatcctccgtgctacgtggaccaccaagagttgtagttttgggtggttaatgtattctgtcttctggtaccaacgcaccgagacaacgtcccaatcactgtattactgaatatacaatagaccgcctacgtacgggtcctacgacgtcgtcgtactcgtcggtacctaccgacggttcgtacggacctaacccggtccggaccccttacccgtaggtaccctacgttcccgtacggttccgggtacctaccggacgggttcgtaggaaccgggtatacgggagggtaccttaaggtaacctttatttccggtagtccgttactcgtaacgtacgttagtcgaccggacggtcgtacctaacgtacgttacgtcgttaccgtaccgggacgttccgggaacccgtggtacccgtacccggtacgtacgtcaaccggcccgtaaaccggccctaacccgg

SEQ ID NO: 110579 - DNA, 731 bp, Homo sapiens
  misc_feature: GYAE6OF01BAW7S.52.17.B06.1.454.CMB.1.raw
  modified_base (216)..(216): a, c, t, g, unknown or other
  misc_feature (216)..(216): n is a, c, g, or t
  modified_base (334)..(334): a, c, t, g, unknown or other
  misc_feature (334)..(334): n is a, c, g, or t
tcagcgcagtacgacacgaccggtgctcgatttagtcgatagtgaagggggggggtctcaggaggcagcactctcgggacgtctccaccatggcctgggctctgctcctcctcagcctcctcactcgagggcacaggatccgtgggctcagtctcgccctgactcacgtcctcgctcgaggtcggtccgggtctccgtggacagtcagtccacctntcctctgctacgtcgaccaccacgtgtgttagtttggtagttatgtacttcgtgttcttcgtacggtaaccacgccaaccgagaccaaccgtacccaatcatagtactactatactanacaagtacgccgtacctcggtacggtcctgacgtcgtcttctcgcgactacgtacgtcgacgaccacgtcccgtacccgtcctacggacctacgtcccgtacggtaccggtccgtaccggtaggtcgtaggtacggtacgacgggtacggttacttaacggtaatttccgttcggtaccgtcgttaaccgtcttagttacggtacgttaccggggaccgtaacggggttaccctacgtttaaccgttacggtttaacgttcccgggttaacccgtacggggtaaccccgttaacccgggaccccgtttaccggtaacccccgtttccgggtaacccggtaccggttaacccccgaaccccggttaccccgaaaccccccggaccccgttaaaccccg

SEQ ID NO: 110580 - DNA, 765 bp, Homo sapiens
  misc_feature: GYAE6OF01CK1IC.52.17.B06.1.454.CMB.1.raw
  modified_base (268)..(268): a, c, t, g, unknown or other
  misc_feature (268)..(268): n is a, c, g, or t
tcagcgcagtacgacacgaccggtgctcgatttagtcgatagtgaaggggggggtctcaggaggcagcactctcgggacgtctccaccagtggcctgggctctgctcctcctcagccctcctcactcgagggcacgaggactccgtgggctcaggtctgtccctgactcgacgtccgtcgctcgtaggtcgtccgggtctccgtggacagtcagtccacctatccgtcctgctacgtcggaccaaccgtacgtagttgtagttttggngttatgtacgttcgttgtccgttcgtacggtaaccgaaccggctaccgaggaacctaaccgtaccccaactcgatcgtactacgtagtaacttaacgtactaaacggtaacggaccggtacccgtacgggtaaccgggttaccctagttaccgtccgtttaccgtttccgtaccggtacgtacctacccgtagtccgtacggacctaaaccgtcccggtccctccgaccgtactacgttccgtacgttccggacctacggacgtgtagtacggtagtaccgggagtacgtagtacgttcgttactcggttactcgtacgtaacgtagtacccgtcggtacgaccgggttaccggttactacggttaccgtttaccggttcggtaacccggtaacggggttacccgacccgggttaacccggttcggtacccggtaacccgttaccgggtacccgtaaccgacccgggtaacccccgacgtaaacccccgtaacccgg

SEQ ID NO: 110581 - DNA, 542 bp, Homo sapiens
  misc_feature: GYAE6OF02GRD8S.52.17.B06.1.454.CMB.1.raw
  modified_base (235)..(235): a, c, t, g, unknown or other
  misc_feature (235)..(235): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
tcagcgcagtacgacacgaccggtgctcgatttagtcgatagtgaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcaccaacagtgattttggngttatgattctgtcttctggtaccaacggcacccaggacaaacgtccccaaactcatgattactgatatacaaataagacgccctcgacggggtccctgactcgcttctctggctcaagtctgcaacgacggcctccctcgacctatcctcgtcgggcctccgggctggaggatggacgtctagtaattgttcngtctgctnattgtcgcgaggcgtactactacttatcgttacgttacggaacgtcgggaaccctaggtcctaccgtccgtaggtccacgacccgaacggtaccccaacccgtcg

SEQ ID NO: 110582 - DNA, 599 bp, Homo sapiens
  misc_feature: GYAE6OF02IT6RU.52.17.B06.1.454.CMB.1.raw
  modified_base (235)..(235): a, c, t, g, unknown or other
  misc_feature (235)..(235): n is a, c, g, or t
  modified_base (472)..(472): a, c, t, g, unknown or other
  misc_feature (472)..(472): n is a, c, g, or t
tcagcgcagtacgacacgaccggtgctcgatttagtcgatagtgaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcaccaacagtgattttggngttatgattctgtcttctggtaccaacggcaccaggcaaacgtccccaaactcaatgtattactgaatactacaaataacgacgtccctgacggggtccctagactcgcttctcgtcggcctaccgaagtctaggactaaaccgaccggtcccttcccgtacgaacctacgtccttacgtcgggtccctaccgacgggtctaggaacggtatggacggtcgtagtaacttctttcgngtacttcgtcttactagttactcggacgacgggtccgtactaacgtacttagttgttaccgttacggtactccgggacctacggtccgaccgtactacggtaccacgacccgacggcccctaacccg

SEQ ID NO: 110583 - DNA, 783 bp, Homo sapiens
  misc_feature: GYAE6OF02HXAOV.52.17.B06.1.454.CMB.1.raw
tcagcgcagtacgacacgaccggtgctcgatttagtcgatagtgaagggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcaccaacagtgattttggtagttatgtattctgtcttctggtaccaacggcacccgaggcaaacgtcccaaactcatgtatactgatatacaaataagacgtcctacgaggggtccctagactcgcttactctggtcctaccgtaagtccttaggaaccctaaccgtaccgggccccttcccgtacgtaccctacttcccgtaccggtccggggtaccttacccggtacgggtccggttacgggaacgggtacgttacgggaacgggttaccttacgggttaaaactttacgttttaccggtacggttccgttacggtacccgttaacctaagtttaaccgttacggtaccggaacggggttaccccgggtaacctttaacccgttaacttttaaacgggttccgtttaaccggtttaacccgggggtaaacccggtttcccggggtaaaacccccggttacggggttaaaccccctaaccccggggttttacccggttaaccggggttaccccgaacccgggtaacccccggttaaccgggaaaccccccgttaaacccccccgg

SEQ ID NO: 110584 - DNA, 695 bp, Homo sapiens
  misc_feature: GYAE6OF02IMNVG.52.17.B06.1.454.CMB.1.raw
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (298)..(298): a, c, t, g, unknown or other
  misc_feature (298)..(298): n is a, c, g, or t
tcagcgcagtacgacacgaccggtgctcgatttagtcgatagtgaagggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctctgcactggcaccaacngtgtatttggngttatgattctgtcttctggtaccacggccaccagacaaacgtccccaaactcatgtattacngatactacaaataacgacggccctacgacggggtccctgacgtcgtcttctcgtcggaccttaccaacgttcgtacggaccaaccgtacccggtcccttaccgtcgtaaccctattccgtccgtcgggtcctacccggaagggtcctagggaacggtacgtaggtaacggtctttaaggtaactttacgtttccggtcgtaccgttcgtacccgttactaagttacgtcggaccggtaacgggtcccggttacttaacccgttacgtttacgttccggttaccggtttaccgggaacggttaacccggggaccgttacgggttacccgaacccggttacccgttaacgggtccctaacccgggtaaccccgtaacccgggtaaccccctaaccccgg

SEQ ID NO: 110585 - DNA, 608 bp, Homo sapiens
  misc_feature: GYAE6OF02F1K7N.52.17.B06.1.454.CMB.1.raw
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
  modified_base (314)..(314): a, c, t, g, unknown or other
  misc_feature (314)..(314): n is a, c, g, or t
  modified_base (403)..(403): a, c, t, g, unknown or other
  misc_feature (403)..(403): n is a, c, g, or t
tcagcgcagtacgacacgaccggtgctcgatttagtcgatagtgaaggggggggtctcaggaggcagcactctcgggacgtctccaccatggcctgggctctgctcctcctcagcctcctcactcagggcacaggatcctgggctcagtctgccctgactcagcctcgctcagtcgtccggtctccgtggacagtcagtccaccatctcctgcacgtggccaccaanagtgtattttggngttatgtattctgttcttcgtaggtaccaacggccaacccgaggacaaacgtccccaaactcagtcgacttacngtatatcaaatagcggtccctacggtacgggtccctgactcgtcttctctcgcctacgacgtctaggaccaacgaccggtccttcccgngacctactcgtcgtcggcctccgagtcgtgacggatggacggtactagtaacgttcttcgtgtcctagtcctatattacgtcgacgtacggtctactaccgtacttacgttcgttacgtaccggtactacggtacccgtaaccgtacggttacccgtccggttaccggtaccgggtccaacccggacccgtaaccgtaacccccg

SEQ ID NO: 110586 - DNA, 753 bp, Homo sapiens
  misc_feature: GYAE6OF02IMGVV.52.17.B06.1.454.CMB.1.raw
  modified_base (220)..(220): a, c, t, g, unknown or other
  misc_feature (220)..(220): n is a, c, g, or t
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (293)..(293): a, c, t, g, unknown or other
  misc_feature (293)..(293): n is a, c, g, or t
tcagcgcagtacgacacgaccggtgctcgatttagtcgatagtgaaggggggggtctcaggaggcagcactctcgggacgtctccaccatggcctgggctctgctcctcctcagcctcctcactcgaggcacaggatcctgggctcagtctgccctgactcagcctcgctcagtgtccggtctccgtggacagtcagtcacatctctgcactgcacaacngtntatttggngttangattcgtgtcttctgtaccacgcaccgaggacaaacgtcccaactcatcgacttacngtatactactaataacgacgtcccttacggacggggttccctagacttaccgtccttaccgtccgttacggtcctaccgtaacgttccgtacggtaaccaaaccgtcccgggtccccttacccggtacgaacccgttacgttacccgttaccgtcggggtaccccttaccggtacgggtccgttaagggacggtacgggtacgtaaccggtcgtttaacgtaaacttttaccgtttaccgttccggaccttacggtccttaaccgtagttacgtccggtacggtaccgggtaccggtaaccttaacgttacctttaacggtcccggtttaaccgtttacccggggtaaaccggttcccggggtaacccgtaccgggttacccgttaaccccggtttaccggttaaccgggtcctaaccccgggtaaccccggtaacccggtaacccccgttaacccccgg

SEQ ID NO: 110587 - DNA, 679 bp, Homo sapiens
  misc_feature: GYAE6OF02IKNLY.52.17.B06.1.454.CMB.1.raw
  modified_base (537)..(537): a, c, t, g, unknown or other
  misc_feature (537)..(537): n is a, c, g, or t
tcagcgcagtacgacacgaccggtgctcgatttagtcgatagtgaaggggggggtctcaggaggcagcactctcgggacgtctccaccatggcctgggctctgctcctcctcagcctcctcactcagggcacaggatcctgggctcagtctgccctgactcagcctcgctcagtcggtccggtctccgtggacacgtcagtccacctatcctctcgcctactggaccaacctaacgtagttgttaacgttttgggtaggttactagtacttcgtgttccttcgtacggtaaccaacggccacccgacggacctaaaccgtacccctaaactccaagttagtaacgttaccgtagtatactactaaacgtaacgaccggtcccttacggtacggggtccctagacgttccgtcttccgtcgtcgtacctaccgtacgtccgtacggaccgtaaacgtcccggtcctacccgtcgaacctctccgtacgtcggtcctcgacgtcgaggagacgtgacggtctagttacttcgttcgtancgtctacgttactacgtgtacggacgtacggtcgtacctacgttacttacgtcggttacgtaccggtacgtacccggtaccggtaacggtaccttaccggtaccgtacggtaccgaccgttaacccgaccggacccctaccg

SEQ ID NO: 110588 - DNA, 576 bp, Homo sapiens
  misc_feature: GYAE6OF02I26U7.52.17.B06.1.454.CMB.1.raw
  modified_base (459)..(459): a, c, t, g, unknown or other
  misc_feature (459)..(459): n is a, c, g, or t
tcagcgcagtacgacacgaccggtgctcgatttagtcgatagtgaaggggggggtctcaggaggcagcactctcgggaccgtctccaccatggcctgggctctgctcctcctcagcctcctcactcagggcacaggatcctgggctcagtctgccctgactcagcctcgctcagtgtccgggtctcctggacagtcagtcaccatctcctgcactgcaccaacagtgtagtttggtgttactgtattctcgttcttcgtcggtaccaacggccacccgagacaacgtacccctaactcatcgtattacgtagactactactaataagacgtcctcggacggtcctgactcgtcttctctcgctacgagtcgtgaccacgaccgtcctccgtacgactacgtcctcgtcggctccgaggtctggaacgtagtcggacgtactagtaacgtttacttcgancgttcgtactacgtatacgcgaccgtgggtcctacctacgttagttactcgttaccgtacgtacggtaccggaccgtagtccctaccgtcgtacgcaccggcccacggtcccaaccg

SEQ ID NO: 110589 - DNA, 718 bp, Homo sapiens
  misc_feature: GYAE6OF02I6NJA.52.17.B06.1.454.CMB.1.raw
  modified_base (258)..(258): a, c, t, g, unknown or other
  misc_feature (258)..(258): n is a, c, g, or t
tcagcgcagtacgacacgaccggtgctcgatttagtcgatagtgaaggggggggtctcaggaggcagcactctcgggacgtctccaccatggcctgggctctgctcctcctcagcctcctcactcgacgggcacgaggatccgtgggctcagtctcgccctgactcacgtcctcgctcagtcggtccggtctcgtgactagtccagtccacgtactctctgactcgtgccaacgtaatgttattcgtttgggtattangtacttctcgttcttcgtacggtaaccacgaccaccgagtaccaaccgtacccctaatcgtagttacgtactttagcgtaatacgtaaccaaagtaccgccgttacccgtcggtaacccggttccgtagtaccttccgttacgttcgtaccgtagttacccgtactacgggtccaacggtaactaaccccggccgttcccgacctacgaacctcgtccgtaccgacgttccacggtacgtacgtacgaaggtcgtacgtacgtacctaagttaccgttacttaccgtcgtaaccttgtaacccgttagtaccgtacggtggtacccgtacgtccggtacttaacgttagttaccgttcgtaccggtaaccgggttaaccgtccggtaaacccggttccgtacccggttacgttaccggacggtacccgaacccggtaccaaccccgtacccgttacccgg

SEQ ID NO: 110590 - DNA, 726 bp, Homo sapiens
  misc_feature: GYAE6OF02JX75L.52.17.B06.1.454.CMB.1.raw
  modified_base (211)..(211): a, c, t, g, unknown or other
  misc_feature (211)..(211): n is a, c, g, or t
  modified_base (525)..(525): a, c, t, g, unknown or other
  misc_feature (525)..(525): n is a, c, g, or t
tcagcgcagtacgacacgaccggtgctcgatttagtcgatagtgaaggggggggtctcaggaggcagcactctcgggacgtctccaccatggcctgggctctgctcctcctcagcctcctcactcagggcacaggatcctgggcctcagtctgccctgactcagcctcgctcagtcgtccgggtctcctaggacagtcagtcaccatctcngacactgcaaccacagttgtatttggtgttatgtactttctcgtcttctacggttaccaacggaccacccgaggtaccgaaaccgttaccccgaaactcacgtacgtaacttacgtacggtactactaacgaaacgttaaacgaccggtacccgtaccggtaacggggttccctaggtaccgttccggtaccttccgtcgtcggtaccttacccgtaacggtcgtacggaactaaccggtacccgtacccgttccacggtacctactaccgttcgacggtctaccgacgggtctgggtaacgtagtcggtacgngtaagttacgttactcgttcgacttgtcgtacttcgtagccgacgtaacgggtcctaaccgtacgttaacgttcggttacgttaccgggtaccgggaaaccggtttacgggacccgggtacgttaaacccgtcccgggtttaaccgtaaccggttacccgaaccccggttaccccggaaccggtaccccccttaaacccgg

SEQ ID NO: 110591 - DNA, 815 bp, Homo sapiens
  misc_feature: GYAE6OF02GNOAK.52.17.B06.1.454.CMB.1.raw
tcagcgcagtacgacacgaccggtgctcgatttagtcgatagtgaaggggggggtctcaggaggcagcactctcgggacgtctccaccatggcctgggctctgctcctcctcagcctcctcactcagggcacaggatcctgggctcagtctgccctgactcagcctcgctcagtcgtccggtctccgtggacagtcagtcacctatctcctgcactggccaacaactgtcgtagttttggtgttatgtacttcgtcgttcttacgtacggtaaccgaacggtccacccgacggactaaaccgtaccccaaacgtcacgtagtacttcgttagacggtcgaggtcgtaaccgtccgggacccgttcggtacggggttacctcgtacgtcccgtccgttcccgtcccggtaccttacccgtaacggttcgtacgggtaccgtaccgtacccggtaccccggtccccgtacccgtaccgtaacccgtactttaccccgtcgggtacccggtaccgtaccccggtagggtaccgtaaccggggtaacgggtaaccggtaccggttacccggttagttaaccggttttaaccgtacgtaccggtaaccgtacgtaacccgttacgtaaacccgtaaacccgtaaaaccgtaaccgtaaaccgttaaccgggttacggttaaccgggtttaccgggaccggggtacccgggtaacccggtaacccgtaacgggtcccgttaccccggttacccgttccggtaaccgtacccggaccggtccgtacccgtcccccggtccgtacccgtacccgttaccccgg

SEQ ID NO: 110592 - DNA, 506 bp, Homo sapiens
  misc_feature: GYAE6OF01DY37Z.37.35.D02.1.454.CMB.1.raw
  modified_base (424)..(424): a, c, t, g, unknown or other
  misc_feature (424)..(424): n is a, c, g, or t
  modified_base (501)..(501): a, c, t, g, unknown or other
  misc_feature (501)..(501): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactgggtgcgccaggcccctcgacaagggcctgagtggatgggatacgatcaaccccgacactggcgacacaaagtctgcacatgactttcaggcagagtcacctgaccggacatgtcagcaataccgcctacatagaactcagtanacctaaaatctacgacgacacgccgtactactactgtgcgagaggcgagagttccacgtgggatagtgcgactccgntgtcg

SEQ ID NO: 110593 - DNA, 253 bp, Homo sapiens
  misc_feature: GYAE6OF01A1QJ9.37.35.D02.1.454.CMB.1.raw
  modified_base (252)..(253): a, c, t, g, unknown or other
  misc_feature (252)..(253): n is a, c, g, or t
tcagtagtgtagatcacgaccggtgctcgatttagcacacgatagttgggtctgggacagacttcagtctcatgatcgacacactggacccaacagattttgctgtctattactgtcagcactatgggtccccggcgtgacgttcggccaagggaccacggtggaagtcaaacgaactgtggctgcaccatctgtcttcatcttcccgccatctgaatctacactactgagcgggctggcaaggcgcatagnn

SEQ ID NO: 110594 - DNA, 253 bp, Homo sapiens
  misc_feature: GYAE6OF01ECL4Y.37.35.D02.1.454.CMB.1.raw
  modified_base (252)..(253): a, c, t, g, unknown or other
  misc_feature (252)..(253): n is a, c, g, or t
tcagtagtgtagatcacgaccggtgctcgatttagcacacgatagttgggtctgggacagacttcagtctcatgatcgacacactggacccaacagatttgctgtctattactgtcagcactatgggtcccccggcgtgacgttcggccaagggaccacggtggaagtcaaacgaactgtggctgcaccatctgtcttcatcttcccgccatctgaatctacactactgagcgggctggcaaggcgcatagnn

SEQ ID NO: 110595 - DNA, 512 bp, Homo sapiens
  misc_feature: GYAE6OF01DN3VC.37.35.D02.1.454.CMB.1.raw
  modified_base (505)..(505): a, c, t, g, unknown or other
  misc_feature (505)..(505): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactgggtgcgccaggcccctcgacaagggcctgagtggatgggatacgatcaaccccgcactggcgacacaaagtctgcacatgactttcagggcagagtcaccctgacccggacatgtccagcaataccgcctacatagaactcagtagacctaaatctagacgacacgccgtctattctgtgcgagaggcgagagttccacgtgggataaggtcgacgactcccgngtgttcg

SEQ ID NO: 110596 - DNA, 522 bp, Homo sapiens
  misc_feature: GYAE6OF01BS1IN.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatctcaacgcctattatatacactgggtgcgccaggcccctcgacaagggcctggagtggatgggatacatcaaccccgacactggcgacacaaagtctgcacatgactttcagggcagagtcaccctgacccggacatgtccagcaataccgcctacatagaactcagtacgacctaaatctagacgacacggcctctacttactgtgacgagaggcgagtagttaccgacgtggggataaggtcgacgacgtcccgagtcgttcg

SEQ ID NO: 110597 - DNA, 546 bp, Homo sapiens
  misc_feature: GYAE6OF01BVZB5.37.35.D02.1.454.CMB.1.raw
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
  modified_base (392)..(392): a, c, t, g, unknown or other
  misc_feature (392)..(392): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactgggtgcgcaggcccctgacaagggcctgagtggatgggatacatcaacccganacgtggcgacacaaagtctgcanatgactttcgaggcagacgtccaccgtgacccgganatcgtcagcaaataccgacctacatagaactcaagtagacctaaatcgtagaccgacgacggccgtactacttacgtgtgacgagaggacgaggtacgttccgaacgttcggggaattaacggtcgaccgaccgttccccgagttcgttaccgg

SEQ ID NO: 110598 - DNA, 507 bp, Homo sapiens
  misc_feature: GYAE6OF01D4BVD.37.35.D02.1.454.CMB.1.raw
  modified_base (426)..(426): a, c, t, g, unknown or other
  misc_feature (426)..(426): n is a, c, g, or t
  modified_base (501)..(501): a, c, t, g, unknown or other
  misc_feature (501)..(501): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactgggtgcgccaggcccctcgacaagggcctgagtggatgggatacatcaaccccgacactggcgacacaaagtctgcacatgacttcaggcagagtcaccctgacccgggacatcgtccagcaatacccgctacatagactcagtanacctaaatctagacgacacggccgtctattactgtgacgagaggcagagttccacgtgggatagtgcgactccgntgttcg

SEQ ID NO: 110599 - DNA, 548 bp, Homo sapiens
  misc_feature: GYAE6OF01CDVJS.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcttgaggtgaagagctgggctcagtgaaggtccctgccaggcttctggatacatcttcaacgcctattatatacactgggtgcgccacggcccctcgacaaggcctgagtggatgggatacatcaacccgacactggcgacaacaaagtctgacacatgactttcgagggtcagacgtcaccctcgacccggacatcgtccagcaaacgtaccgacctacaatacgaactacaacgtacgacctaaatctacgtacgacgaccggtaccgtactactacgtgtcgacgagacggacgagtagttaccgacggtaggggaataaggtacgacgacgtcccgtagtggtttacg

SEQ ID NO: 110600 - DNA, 533 bp, Homo sapiens
  misc_feature: GYAE6OF01CHONT.37.35.D02.1.454.CMB.1.raw
  modified_base (285)..(285): a, c, t, g, unknown or other
  misc_feature (285)..(285): n is a, c, g, or t
  modified_base (469)..(469): a, c, t, g, unknown or other
  misc_feature (469)..(469): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactgggtncgccaggcccctcgacaagggcctgagtggatgggatacatcaaccccgacactggcgacacaaagtctgcacatgactttcagggcagagtccaccctggacccggacatgtaccagcaaactaccgcctacatacgactacagtacacctaaatctagaccgacgacggacctctatttacngtcgcgtagacggcaaggtagttccacgtagggagtaacgtcgacgaccgtccgagttgttacg

SEQ ID NO: 110601 - DNA, 539 bp, Homo sapiens
  misc_feature: GYAE6OF01C6VUP.37.35.D02.1.454.CMB.1.raw
  modified_base (428)..(428): a, c, t, g, unknown or other
  misc_feature (428)..(428): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagccgtggggcctcagtgaacggtcccctgccaggcttctggatacatcttcaacgcctattatatacactgggtgcgccaggcccctcgacaagggcctgagtggatgggatacatcaaccccgacactggcgaacacgaaagtctgcacatgactttcaggcagagtccaccctcgacccgggacactcgtcagccaagtacccgcctaacatanaacctacagtaagacctaaatctacggacgacgtaccggccgtacttacttactgtgcgagaggcgagtagttccacgtggggaataacgtgacgactcccgatcgttacg

SEQ ID NO: 110602 - DNA, 561 bp, Homo sapiens
  misc_feature: GYAE6OF01DUYU7.37.35.D02.1.454.CMB.1.raw
  modified_base (286)..(286): a, c, t, g, unknown or other
  misc_feature (286)..(286): n is a, c, g, or t
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgcccaggcttctggatacatcttcaacgcctattatatacactgggtncgccaggcccctgacaagggcctgagtggatgggatacatcaaccccgnactggcgacacaaagtctgcanatgactttcagggcagagtcacccgtgacccgggacagtacgtcccagacaaactacccgcctaacactaacgaactcgaagtacgacctaaaatccgttacgaaccgaacgtacggaccgtacttaacttacgtgtcgcgacggaggacgagacgttcccgaggtaggggaataacggtgaccgactcccgagtcggtttacg

SEQ ID NO: 110603 - DNA, 541 bp, Homo sapiens
  misc_feature: GYAE6OF01CW1P4.37.35.D02.1.454.CMB.1.raw
  modified_base (224)..(224): a, c, t, g, unknown or other
  misc_feature (224)..(224): n is a, c, g, or t
  modified_base (533)..(533): a, c, t, g, unknown or other
  misc_feature (533)..(533): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctnagtgaacggtcccctgccaggcttctggatacatcttcaacgcctattatatacactggtgcgcacggcccctcgacaagggcctgacgtggatgggatacatccaaccccgacactggcgacaacaaagtctgacacatcgtactttcagggcagacgtcacccgtcggacccggacagtcgtacccagacaactaccgacctacactacgaactacagtaacgacctaaatctacgacgacgacggccgtactacttactgtgacgagagacgagtagttccagtgggaatacgtcgcgacctccgntcgttacg

SEQ ID NO: 110604 - DNA, 560 bp, Homo sapiens
  misc_feature: GYAE6OF01B3ZAK.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttccttgaggtgaagaagcctggggcctcagtgaaggtccctgccaggctctggatacatcttcaacgtcctattatatacacgtgggtgccgaccacggcccctcggaacgaagggcctgacgtggagtgggatacactcaaaccccgacacgtggacaacgaacaaacgtctagacaacagtgtacttcgaggtacagacgtccacccgtggaacccggcacgtcgaccgagactaacgtaccgactacatacgaactcaagtacacctaaatcgacgacgacacggtctctactatcgtcgacgtgacggcgtacgtacgttacgacgtgggaataacggcgacgactcccgagttgttacgg

SEQ ID NO: 110605 - DNA, 514 bp, Homo sapiens
  misc_feature: GYAE6OF01B2NLT.37.35.D02.1.454.CMB.1.raw
  modified_base (224)..(224): a, c, t, g, unknown or other
  misc_feature (224)..(224): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctnagtgaaggtcccctgccaggcttctggatacatcttcaacgcctattatatacactgggtgcgcaggcccctcgacaagggcctgacgtggactgggatacatcaaccccgacactggcgacacaaagtctagcacatgactttcaggcagagtcaccctgacccgggacatgtccagcaataccgcctacatacgaactcagtagacctaaatctagacgacacggacctctattactgtgcgagagcagagttccgcgtagggatagtgcgacgtcccgagtgttacg

SEQ ID NO: 110606 - DNA, 599 bp, Homo sapiens
  misc_feature: GYAE6OF01CTASZ.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaattggtgcagtcttcctttgaggtgaagaagcctggggcctcagtgaaggtcccctgccaggcttctggatacatcttcaacgcctattatatacatgggtgcgccacggcccctcgacgaacggcctagagtggatgggatacataccgaaccccgacacgtggcaacgacaaagtctgcacattgacctttgaggcacgacgtccacccgtacggacccggactacgtcgtacccaagaccaaactacccgacctaacaactacgaactcgtaacgtacgaaccttaaactacgtacgaaccgtaaccgaccggtaccgtacttaactttacgtgttacggcgtaggaggacacggtacgttaccgacggttagggaagtaagtcggacgacccgttacccgagttcggtttacgg

SEQ ID NO: 110607 - DNA, 586 bp, Homo sapiens
  misc_feature: GYAE6OF01CJJAV.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttccttgaggtgaagaagcctggggcctcgagtgaacggtcccctgccaggtcttcgtggactacacttcttcaacgcctaattatatacactgggtgcgccacggcccctcgacaacggcctgacgtggagtgggatacataccaacccgacactcggcacaacaaacgtctagcacatagactttcgaggcagacgtcacccgtacgacccggtacacgtcgtaccacgactaaactaccgacctaacaactaacgaactacaagtacgacctaaatactagaccgaacacggtccgtactaagttactgtacgacgacggagacgtaacggtacgttacgtacggtacgggaagttaacggtcggacgtaccgtaccgtagtgtttacg

SEQ ID NO: 110608 - DNA, 545 bp, Homo sapiens
  misc_feature: GYAE6OF01CL3JC.37.35.D02.1.454.CMB.1.raw
  modified_base (336)..(336): a, c, t, g, unknown or other
  misc_feature (336)..(336): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactgggtgcgccaggcccctcgacaagggcctgagtggatgggatacatcaaccccganactggcacacaaagtctgacacatgactttcagggcagagtcacccgtcgacccgggacactcgtccagacaactaccgcctacaatagaactcagtacgacctaaatctacgacgacgacggtccgtactattactagtcgacgagacggcgacgtagttaccgacgtaggggaataacggtcggacgacctcccgagtcgtttacgg

SEQ ID NO: 110609 - DNA, 553 bp, Homo sapiens
  misc_feature: GYAE6OF01AQYK7.37.35.D02.1.454.CMB.1.raw
  modified_base (511)..(511): a, c, t, g, unknown or other
  misc_feature (511)..(511): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactgggtgcgccaggcccctcgacagggcctgagtggatgggatacataccaacccccgacacgtggacgacaacaaagtctgacacatcgactttcgagggcagacgtccacccgtacgacccgggacagtcgtacccgagacaactaccgcctacatacgactcagtacgacctaaatctagacgacgaccggccgtactacttactgtgcgtagaggcgacgacgttaccnggtaggggattaacggcgtcgactcccggtagtcggtttacg

SEQ ID NO: 110610 - DNA, 617 bp, Homo sapiens
  misc_feature: GYAE6OF01CM3E7.37.35.D02.1.454.CMB.1.raw
  modified_base (456)..(456): a, c, t, g, unknown or other
  misc_feature (456)..(456): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctaattatatacacgtgggtcgcgccacggcccctcgacaagggcctgagttggactggggaactacgacgtaccaaaccccggacacgtggaccgacaacgaaagtctgcacatggtactttcgaggcaagacgtccacccgtcggacccgggactacgtcgtaccagtactaaactaccggaccctanaactacgaacctacaagtacgaacctaaattctacgaacgaccgtacggaccgttactaacttacgtgtcggaccggaggtacgggacgtacggacgtttacccgaagggttcgggtaataaggttccgggactacccgtacccgtagtcggttttaccgg

SEQ ID NO: 110611 - DNA, 551 bp, Homo sapiens
  misc_feature: GYAE6OF01AH14U.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactgggtgcgccacggcccctcgacaaggcctgagtggatgggatacatccaaccccgacactggcgacaacaagtctagcacatgactttcgaggcagagtccacccgtcggacccgggacacgtcgtaccgagacaacgtaccgacctacaatacgaactcacgtacacctaaatctacgacgacgaccggaccgtactattacgtgtcgcgagagacgagtacgttccgacgtagggtataaggtcgacgtaccgtccgagtcggtttacg

SEQ ID NO: 110612 - DNA, 636 bp, Homo sapiens
  misc_feature: GYAE6OF01BA533.37.35.D02.1.454.CMB.1.raw
  modified_base (254)..(254): a, c, t, g, unknown or other
  misc_feature (254)..(254): n is a, c, g, or t
  modified_base (386)..(386): a, c, t, g, unknown or other
  misc_feature (386)..(386): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctgggaggatcgtcttcttggtggcagcagtcacaggagcccactcccaggtgaaattggtgcagtcttcctttggaggtgaagaagccgtggggcctcgagtgaacgtcccctgccaggcttcgnggatacatcttcaacgtcctattatatacacgtggtcgcgccgacggcccctcggacgaacgggcctggacgtggagtgggactacactaccaaccccgacacgtcggacgaacaacgaaagtctagccaanatcgtacttcgaggacagctaccgaccgtcgacccggacacgtcgtccaagacctaaactacccgacctaacaacgtaacgaactacgaacgtaacgaacccttaaaagtcgtaacggaaccgtaaccgaccggtacccgttacttaacgttaccgtgtacggaccgtaaggacggtacgaacggtacgttaccgacgggtagggtaactaacgggtacgaccgtaacgttcccggtagttcggtttacg

SEQ ID NO: 110613 - DNA, 603 bp, Homo sapiens
  misc_feature: GYAE6OF01DG2NH.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtacacaggacgcccactcccaggtgaaattggtgcagtctttcctttgaggtgaagaagccgtggggccttcagtgaacggtcccctgccaggtccttctggatacatcttcaacggcctattatatacacgtggtgcgccaggccccctcgacgaacgggcctgagtggatgggatacatccaaccccgacactggcacacaaagtctcgcacatcgactttcgaggcagagtccaccgtgacccggacatacgtccagacaacgtaccgacctacaactaagaactcaacgtacgacctaaatcctacgaaccgaccgtaccggaccgttaccgttacttacgtcgtacggacgaggtacgggacgaggtaccggttaccgtaacggttaggggtaaagttaacggtcggaacgtaccgtacccggagttcgttttaacccggg

SEQ ID NO: 110614 - DNA, 603 bp, Homo sapiens
  misc_feature: GYAE6OF01CQFGO.37.35.D02.1.454.CMB.1.raw
  modified_base (282)..(282): a, c, t, g, unknown or other
  misc_feature (282)..(282): n is a, c, g, or t
  modified_base (335)..(335): a, c, t, g, unknown or other
  misc_feature (335)..(335): n is a, c, g, or t
  modified_base (363)..(363): a, c, t, g, unknown or other
  misc_feature (363)..(363): n is a, c, g, or t
  modified_base (590)..(590): a, c, t, g, unknown or other
  misc_feature (590)..(590): n is a, c, g, or t
tcagtagtgtagatcacgaccggtgctcgatttagcacacgatagttgggtttggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaagtcccctgccaggcttctggatacatcttcaacgctattatatacacgtggtncgccacggcccctgacgaaggcctgacgtgatcgggatacatccaaaccccgnaacgtggacgacaacgaaagtctgacanagtgaactttcgaaggccaagtacgtcccacccgtacggaccccgggactagttcgtacccgagacaacgtaacccgacctaactaagtaacgaactaccaagtaacgaacgtaaaactcgtacgaccgaacgaccgtaccgtattactacgtgtcgcgaagtacggacgtacggtagttaccgtaaggtaccggggtaataaacggtcgacgtaaccgttacccgngttcgtttaccgg

SEQ ID NO: 110615 - DNA, 666 bp, Homo sapiens
  misc_feature: GYAE6OF01A5XEL.37.35.D02.1.454.CMB.1.raw
  modified_base (240)..(240): a, c, t, g, unknown or other
  misc_feature (240)..(240): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagacgccgtgggcctcgagtgaacggtccccngccaggcttctggatacatcttcaacgcctattatactacacgtgggtcgcgccgacggcccctcggaccgacggggcctggagtaggacgtggggatacgactaccgaaccccgacacgtcggacaacgaacgaaagtcctaggaccactatacgtaccttttacgacgggtacaacgtacgtaccgtaaccccgtcggaaccccgggacgtacgtcggtacccgagtaccaaacgtacccgtacctaaccaataacgtaacctacgtaacgtaacgtaaccttaaaatccgtagaaccgaccgtaccggtaccgttacttaacgttactggtacgacgtaggacgacgaggtacccgttaccggcggtagggtaacgttaacggtacgtaccggtaaccccgtccgtacgttcggttttaccgg

SEQ ID NO: 110616 - DNA, 598 bp, Homo sapiens
  misc_feature: GYAE6OF01DH8WF.37.35.D02.1.454.CMB.1.raw
  modified_base (587)..(587): a, c, t, g, unknown or other
  misc_feature (587)..(587): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaacggtcccctgccagggcttcgtaggatacatcttacaacgcctattatactacactgggtgcgccgacggcccctcgacgaagggcctggagtgagtggatacatccaaccccgacacgtgacgacacaaaagtcgtcgacaacatgtactttgacggacgagacgtccacccgtaggacccgggaacagtacgtcacgacaaacgttacccgacctaactactaacgaaactacgaagtaacgaaccttaaataccgtacgaacgaccgaccggtccgtacttaacttacgtgtgacgaggaggacgaacggacgttaccacggaaggggtataacggtcgacgtaccgtaccgtnttggtttacgg

SEQ ID NO: 110617 - DNA, 739 bp, Homo sapiens
  misc_feature: GYAE6OF01BDJMV.37.35.D02.1.454.CMB.1.raw
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (692)..(692): a, c, t, g, unknown or other
  misc_feature (692)..(692): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctgggaggatcgtcttcttgggtggcagcagtcacaggacgcccacctcccaggtagaaatttcggtgcagttctttccgtttggaggtgaacgagccgtggggcctcaggtcgaacgtcccctgccaggtcttcgnggatactntcttacaacgtcctattatatacngtagggtcnccgccacggcccccgtgaccgaacgggcctggagtcggaagtagggacttaacaacctacccgaaacccccgtagaccgtacgggaccgtaacgtaaacaaacggttccgtagacccaacgtacgtacgttaccgtttacggacgggtacaacggtaccgttacccgaaccccgtacgggaaccccgggtaactacgttccgaccgaacgacccaacgttaacccgacctaagtaacgtaaccgtaactcgtaaagtaaccgtaaccttaaagtcctaaccggaaccggtaaccgtacccgggttaccttaacttaccggttacgtcgggtacgaacggtacgtacggtaggtaaccgtacgttacccggtaagggtacgggtaanaaacgggtccggaaccgtacccgtacgttacggttcggttttaacgg

SEQ ID NO: 110618 - DNA, 618 bp, Homo sapiens
  misc_feature: GYAE6OF01D8TIC.37.35.D02.1.454.CMB.1.raw
  modified_base (353)..(353): a, c, t, g, unknown or other
  misc_feature (353)..(353): n is a, c, g, or t
  modified_base (371)..(371): a, c, t, g, unknown or other
  misc_feature (371)..(371): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggagatcgtcttcttggtggcagcagtcacaggacgcccactcccaggtgaaattggtgcagttcttcctttgaggtgaagaagccgtggggcctcgagtgaacggtccccctgccaggcttcgtggatacatcttacaacgtccttattatatacacgtgggtgcgccgacggcccctacgacgacgggcctggagtggagtggatacataccaaccccganacgcggacacacaagtcngcacagtgtacttacgaggacacgtacgtccacccgtacggacccggacacgtacgtacccgagacctaacgtacccgacctaacaactacgaacctactaacgtacgtaacctaaagtctacgaccgaccgtaaccggtccttacgttacttacgtacgcgacggacggacggacgtaacggtacgtaccgtacggtagggtaacgtaaacggtcgaccgtacccgtacccgtagtcgtttacggg

SEQ ID NO: 110619 - DNA, 996 bp, Homo sapiens
  misc_feature: GYAE6OF01BJIA4.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctgggaggatcgtcttcttggtggcagcagtcacgaggacgcccacctcccgagggtagtaaagttgggtgctaggttcctttccgtttaggagggttaggaaaggtaacggcccggttgggggccctcgtaagggttacggaaccggttccccgtggaccgtaggtcctttacggtaggtaactacgtacttaccgttaaccgaaccggttccttaatttaacgttaactaccgtacggttcggggttcggacccggtaccggaacccgggtcccccgtaaccggaaccggtaaacggggtcccgttagggaacgggttacgggtaacggtacggggaacttaaccgtaaccttaaccccggaaaacccccggaccgtaaccggtaccggggaaccgaaaccgtaaaacggtaaaaccggttccgtacggaaccgtaaaccgttaacgttaccgggtttaaaccgtttaccgggacggggtaaaccgtaaaccgggtacccgtttaaccccgtacccccgggttaaccggggtaacccccgggtaacgttaaccgggttacccggttaaccccggaaacggtaaccctaaaacccgggttaccccggtaacccgttaaaccggtaaacgttaaaccggtaaccctaacggtaaacgggtttaaccgtaaacccgttaaaactcccggttaaaccggaacccgtaacccgggtacccggttacccgttaactttaaccggtacggttcggtaccgtaacgggaaggtaccggtacgaacggttacgttacccgggaaacgggttagggtaaaccgtaacgggtcccgtaaccgggtacccttaccggtaaggttcggttttaaccggg

SEQ ID NO: 110620 - DNA, 695 bp, Homo sapiens
  misc_feature: GYAE6OF01CN7Z5.37.35.D02.1.454.CMB.1.raw
tcagtagtgtagatcacgaccggtgctcgatttagcacacgatagttgggtttggggcatcacccagcaaccacatctgtcctctagagaatcccctgagagctccgttcctcaccatggactggacctggaggatcgtcttcttggtggcagcagtcacgaggacgcccactcccgaggtagaaagttggtgctacgttcctttccgtttgaggtagaagaagccgtggggcctcgagtcgacgtccctgccaggtcttcgagatacattctacgaaccgtccttattatactaccacgttgggtcgccgccgacggccccctagacgacgggcctaggagttacggaagtcgggtaactaaccgacgtacccgaaccccgactacgtacggaccgaacgaaacgtaaacgtccgtagtaccacgtactacggtacctttacggaggacctaggtacggtacccgaccgtaccggaacccggtacactccggtaccaacgaacctaaccgtacccgacctaacgtaactaacgtaacctacgtagtaacgtaaccgtaaatccgaacggacctaaccggtcgtaccgttacttaagtaccgttagcggtaagtacggacggtacgtacggtacgtaccggtagggtacggtaaattcggtaccgtaccgtaccgtacccgttgtcgttttccgg

SEQ ID NO: 110621 - DNA, 552 bp, Homo sapiens
  misc_feature: GYAE6OF01BPHG9.37.35.D02.1.454.CMB.1.raw
  modified_base (285)..(285): a, c, t, g, unknown or other
  misc_feature (285)..(285): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactgggtncgccaggcccctcgacaacgggcctgagtggatgggatacgatccaaaccccgacactggacgacaacaaagtctagcacatgactttcgaggtcagagtccaccctcgacccgggacatcgtccacgcaaactacccgacctacaactaacgaactcaagtacgaacctaaactctacgacgacgaccggccgtactattactgtgacgagacgggcgtagtaccgacgtgggaataagtcgacgacctaccgatgtgttttacgg

SEQ ID NO: 110622 - DNA, 690 bp, Homo sapiens
  misc_feature: GYAE6OF01AL5SD.37.35.D02.1.454.CMB.1.raw
  modified_base (427)..(427): a, c, t, g, unknown or other
  misc_feature (427)..(427): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcgttggtggcagcagtcacgaggacgcccactcccgaggtgtaaagttggtgcagtctttcctttggaggtgaagaagccgttggggcctacgaggtcgaacggtcccctagccgtagtccgttgtcggatacacgtcttacaaccgtcttattaactatacacgttgggtcgcgccgaccgggcccctcggaacgaacgggccttggaggtaggacggtagggaactacaacgtaccccgaaaccccgtacgacgtccggacaaacaacggtaacgttccganaccgactagtcgtaccgtttcgaaggggacaaggtaccgttaccgaccgttaccggacccggaacgtacgtaccgtacgaaccgacgtaacgaacccgacgtaaccagtaaccgtaactacacgtaactaacctaagacgtacgacgtaccaccgggtaccttactaacgtacgtacggcgacggtacgacggtacgtacgtacgtacggtacggtacgggaactacgggtaccgacgtacccgtaccgtagttcgttaacgg

SEQ ID NO: 110623 - DNA, 698 bp, Homo sapiens
  misc_feature: GYAE6OF01BRJZ0.37.35.D02.1.454.CMB.1.raw
  modified_base (294)..(294): a, c, t, g, unknown or other
  misc_feature (294)..(294): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtagcagtcttcctttgaggtgaagaagcctggggcctcagtgaacggtcccctgccgaggcttcgtggactacgatcttaccaacgcctattatatacacgtgggtnccgtccacggtccccctaggacaacgggcctggagtggacgtgggactacattacccaaaccccgactacgtcgggaccgaaccaacgaaacggttcctacggaccaacgtaagttcgtaaccgttttacgaacggggaccaaggtacgtaccccaaccccgttacggaaccccgggtactaacgttccgtacccgaacggaccaaacgtaccccgacctaacgactaacgactacgaagtaaccgtaacctaaaactctaggaccgaccgtacccggtaccttacctacgttacgtcgtacggacggacgacgggtaccgacggtaccgtttacccgacggttaggggtaacttaaacgggtcggaacccgtaaccgtcccggtaagttccggttttaaccgg

SEQ ID NO: 110624 - DNA, 735 bp, Homo sapiens
  misc_feature: GYAE6OF01CNXF9.37.35.D02.1.454.CMB.1.raw
tcagtagtgtagatcacgaccggtgctcgatttagcacacgatagttggggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttccttgaggtgaagaagcgtggggcctgagtgaacggtcccctgccaggcttcgtggatacatcttacaacgctattatatacagtgggtgccgccacggccccctacggaacgaacggggcctaggaggtcgggagtgggataccaacgtacccgaaaccccgacacgtacggaccgaaccaaacgtaaacggtcctacgcaaccgtattacgtaccttttacggaacggggtacaacggtacgtaccctaaccccggttacggaccccggggtaactacgttaccggtacccgacggaccgtaaacgtacccggtaccctaacgtaacgtaacgtaaaccttacgtaaacgtaacgtaacccgttaaaattccgtaacggaacccgtaacgtaccgggtacccgttacttaacgttacgttacggtcggtacggacggacggtacgtaacggttaacggttacccggtaaccggttgggggtaaacttacgggtaccggtaccgtacccggtacccggtgttaccggttttaccggg

SEQ ID NO: 110625 - DNA, 894 bp, Homo sapiens
  misc_feature: GYAE6OF01EL4ME.37.35.D02.1.454.CMB.1.raw
  modified_base (189)..(189): a, c, t, g, unknown or other
  misc_feature (189)..(189): n is a, c, g, or t
tcagtagtgtagatcacgaccggtgctcgatttagcacacgatagttgggtttggggcatcacccagcaaccacatctgtcctctagagaatcccctgagagctccgttcctcaccatggactggacctggaggatcgtcttcttggtgcagcagtcacaggacgcccactcccgaggtgaaattggtnctagtcttcctttgaggtgaagagccgtgggcctcgagtcgaacgtcccctgccaggtcttcgtggactacattcttaccgaacgtccttaattataactacacgttgggtcgccgccgtacggcccccttaggaaccgtaaacggggtccctaggtacggtacggaggtacggggtaactaaccgtactacccgaaaacccccggtactaccgtacggacccgaaccgtaaacctaaacggttccttacggaccctaacgtaacgttacgtaacccgtttacggaacgggtaccgtaaacggtaccggttacccgtaccccgttaaccggggaaccccgggtaactacggttacgtaaccccggacggtaaaccgtaacccgttaacccccggtaaccttaaacccgtaaacgttacccggtaaaaccgttaccgtaaaccgggtttaacccgtaaaaccctttaaaaacgttcccggtaaaccgggtaaaccccgtaaacccgggttaaccccggggttaacccgttttaaccgttaaaccggttttaccgttacgggtttaaccggaccgggtaaacgggaaccgggtaccgttaaacggttacccggtttaacccggtaacgggtaaacgggggttaaactaacgggttccggaccggttaaccccggttaaccggtacggtttccggttttaaaccgggg

SEQ ID NO: 110626 - DNA, 733 bp, Homo sapiens
  misc_feature: GYAE6OF01D1E1N.37.35.D02.1.454.CMB.1.raw
  modified_base (188)..(188): a, c, t, g, unknown or other
  misc_feature (188)..(188): n is a, c, g, or t
  modified_base (239)..(239): a, c, t, g, unknown or other
  misc_feature (239)..(239): n is a, c, g, or t
  modified_base (305)..(305): a, c, t, g, unknown or other
  misc_feature (305)..(305): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtgcagcagtcacaggagcccactcccaggtgaaattggtncagttcttcctttgaggtgaagaagccgtgggcctcagtgaacggtccccngccaggtcttcgtggactactatccttacaaccgtacctaatttaataataacctacgtgggtacnccgtaccgacggtaccccctagaacggaaacgggtccctaggacggttaggagtagggtactaacacttacccgaaaccccgactaccggacggaccgaacgaaacgtaaaacgttcgacggtaccaacgtagtacgtaccttttaccgggaggacgtaacggtaccgtaccgtaaccccggttacgggaacccccgggtaataaccggtccgttaaccccggaacgtaacccgtaaacggtaaccccacccgttaaactaacgtaaacccgtaaacgtacctaaacggtaactaaacccgttaaaactacggtacgaacgtaaccgtaccggtccgtacttaacgttactaggccgtacgaggacgcgtaagtacgttaccgacggtaggtacaaaggtcacggtaaccgtctagtcgtttaaccgg

SEQ ID NO: 110627 - DNA, 662 bp, Homo sapiens
  misc_feature: GYAE6OF01AQUUF.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagccccactcccaggtgaaattggtgcagttctttcctttggaggtgaagagccgtggggcctgagtcgacggtcccctgccgaggtcttcgtggatacatcttcaacgtcctattatatacacgtgggtgccgccgaccggcccctacgacgaacgggcctagaggtggtagtggggaactacgactacccgaacccccggacaaccgtcggaccgaaccaacgtaaacgtctagaccacgtatcgtactttcgagggacaggtacgtaccacccgtacggaacccgggtacacgttacgaccgacgacaaccgtacccgacctacgaacgtacgtaacctacacgtaactaaccttaaactcgtacgaccggaaccgtaccggtaccttactttacttacgtggtacgacgtagggacgacgtaaggtaccgttacccggaacggttagggaagtaacggtcggtacccgtaccgtacccgtgtttcgtttaccgg

SEQ ID NO: 110628 - DNA, 735 bp, Homo sapiens
  misc_feature: GYAE6OF01C1RT0.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacgaggacgcccacctcccgaggtgtaaagttgggtcgctagttccttttccgtttaggagggtagaacggaaggtcccgtgggggcccttcgaggtcggaaccggtccccgtggccgtagggtcctttacgtagggtaactaccgtacttaccgttacctaaccgtaccttaattacttaactaccgtacgttcgggcgccggtccgtaccggcccccgtaccgaaccggacgggtccgtaggaggtggtagtacgggactacgacgtacccgaaccccgaacgacgtacgacgaacaaccgaaaggtactacgactacgtacttacgtacctttacggacggacgacggtaccgtacccggaaccccgacccgggactacgtaccgaccacgtacctaaccgtaccgtacctacgtacaacgacgtacgaacgtaacgtaactaaacgtcgtaacgaccgtaccgacccggttacgtacttacgttacgtagtcgacgacgaggacgtacgtcgttaccggacggtggtaacgtacggtacgacgtaccgtcgtaacgttgttacgtttacggg

SEQ ID NO: 110629 - DNA, 677 bp, Homo sapiens
  misc_feature: GYAE6OF01CEM3W.37.35.D02.1.454.CMB.1.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccagggtgaaattggtgcagtcctttcctttgaggtgaagaagcctggggcctnagtgaacggtccctgccaggcttcnggatacatcttcaacgtctaattatatacacgtgggtcgcgccaggcccctacgacgacgggcctggagtggacgtgggactacactaccaaccccgtacgactcggacacaacaaacgtcacgcaacagtcgtactttacgaggccagacgtccacccgtacggaccccgggaacacgttacggtaccgtacgacctaacgtaccccgtacctaaccgaacgttaacgtaaaccgtaccgtaacgtaaccgtaacccgttaaaactcgtaacggtaacccgaaccgtaccggtacccggtttacttaacgttacctaggtcggaacggacggtacggacgtacggtacggttaccgtaaccggttaggggtaaccgttaaacgggtcgacccggttaccgttacccgtcgttagttttaccggg

SEQ ID NO: 110630 - DNA, 745 bp, Homo sapiens
  misc_feature: GYAE6OF01B0H3S.37.35.D02.1.454.CMB.1.raw
  modified_base (253)..(253): a, c, t, g, unknown or other
  misc_feature (253)..(253): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggacgcccactcccaggtgaaattggtgcagtcttctttgaggtgaagaagccgtggggcctcgagtgaacgtcccctgccaggtcttcgngatacatcttcaacgccttatatatacacgtggtacgcgaccgacggccccgtacgacgaacgggcctggaggtcggagtagggactaacgactacccgaaaccccacgacgtacggaccgaccgaaacaaacgtcgacgtaccactatcgtacctttcggaggacctagtacgtaccgacccgtacggacccggacacgtacgtaccgacgaccgtaacgtaccctaccgtaactacgaacgtaccgtactaacgttacgtaacctaaaacgttccgaaccggtaaccggaacccgtaccgggttaccccgtttaaccgttaacgtttacggttaccggttacggtaccgggtacgggaaacgggaccggttaacggttaacccgggtttacccggttaaacgggtaccggggggttaaaacgttaacgggttaaccgggacccggtttaaccccggttacccggttaacgttggggttttttaacccggg

SEQ ID NO: 110631 - DNA, 885 bp, Homo sapiens
  misc_feature: GYAE6OF01D93UF.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgttcttcgttggtggcagcagtcacgaggacgcccacctcccgaggtagtaaagttgggtcgacgtacgttcctttccgtttaggaagggtaggaaaggaacggtccggtcggggcctacgtaggtacggtaaccggtccccgtaggccgacggttccgtttcggtacggtacttacctattacccttaccgaaaccgttcctttaaagttaacttaactaccgtaacggtggggtccgtacccggacccggtacccggtacccccgttacggaaccggtaaccggggtccgtagggtaacggtacgggtaacggtacgggtaactaaccgtaaccgtaccccgaaaaccccggtcgtaaccggtacgggaaccgtaaaccgtaaacgtaaacgggttccacggtacccctaaagttacggttaacccgttaccggtttaccgggaaacgggtaccgtaacggtacccgtaccccgaaccccgggttaccgggaaaccccgggtactacggtaccgtaccggaacgtaaccgtaaccgtaccccgtaactaaacgtaacgtaacgtaaccgtaagtaaccggttaaacctaacgttaaacgtcgtaaacggacccgtaaccgggtacccggttacgttacgtttaaccgttacgggaacgttcggaacgggtaccgaaggttactacggttaacgtaccgagggtagtaacgtacggtcgaaccgtaccgtgttagttcggtttacg

SEQ ID NO: 110632 - DNA, 686 bp, Homo sapiens
  misc_feature: GYAE6OF01APFT7.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagccgtggggcctcgagtcggaacggttcccctgccgaggtcttcgtggatacattccttacaacgtccttattatactacacgtgggtcgccgccacggtccccctaggaaccgaacgggcctaggacggtaggagtgggaactacactacccgaaccccgtacacgtcggaccgaacaaacgtaaacggtctacggacctaacgtacgttacggtaccttttccggaaggggaccgtaacggtacgtaccctacccgtaccgggaaccccgggtactacggttccgtacccgaagaccctaaacgtacccgacctaaacgaactaacgaaccgtacctaacgtaccgtaacccttaaagtcctaacggaaccgaccgtacccggtacgttacttacttacgtcggtagccggaagacggacgtagtaccgttcgaggtaggaatacggtcgacgacctcgtgttgtttaccgg

SEQ ID NO: 110633 - DNA, 529 bp, Homo sapiens
  misc_feature: GYAE6OF01B2P8R.37.35.D02.1.454.CMB.1.raw
  modified_base (190)..(190): a, c, t, g, unknown or other
  misc_feature (190)..(190): n is a, c, g, or t
  modified_base (501)..(501): a, c, t, g, unknown or other
  misc_feature (501)..(501): n is a, c, g, or t
  modified_base (519)..(519): a, c, t, g, unknown or other
  misc_feature (519)..(519): n is a, c, g, or t
  modified_base (523)..(523): a, c, t, g, unknown or other
  misc_feature (523)..(523): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactgggacctgggaggatcgtcttcttggtggcagcagtcacaggagcccactcccaggtgaaattggngcagtcttcctttgaggtgaagagcctggggcctcagtgaaggtcccctgccaggcttctggatacatcttcaacgcctattatatacactgggtgcgccaggcccctcgacaagggcctgagtggatgggatacatcaaccccgacactggcgacacaaaagtctgcacatgactttcagggtcagagtcaccctcgacccgggacactcgtccagcaaatacccgcctaaccataacgaactacaacgtacgacctaaaactctagacggacaccggaccgtactatactgtgcgagaggcgagagtcncgtgggatagtagcgacnccgntgttcg

SEQ ID NO: 110634 - DNA, 1085 bp, Homo sapiens
  misc_feature: GYAE6OF01CIP7D.37.35.D02.1.454.CMB.1.raw
tcagtagtgtagatcacgaccggtgctcgatttagcacacgatagttgggtttgggggcatcacccagcaaccacatctgtcctctagagaactcccctgagacgctcccgttcctcaccatggactggaccgtgggaggattcgttcttcgttggtggcagctagtcacgaggacgcccacctcccgaggtagtaaagtttcggtcgtactacggtttccttttccgtttagggtacgggtaagggaaacggaaaccggtcccgggtaccgggggtacccttacggtaacgggttacggtaacccgggttccccccgtaccgggtaccccggtacgggtttccgtttaccgggtacgggttaacttaacctaccgttttaccgtttacccgtaaaacccggttacccctttaaaagttttaaccgttaaacttaaaacccggtttacgggtttacgggggtccggtaccccggtaaccccggttaacccccgggggtaccccccccgtttaacgggaaaacccgggttaaaccgggggtcccggtttaaacgggtaacgggttacgggggttaaccgggtaacggggtttaaaccgttaaaccctaaccggttacccccgaaaacccccggtaacggtaacccggttaccgggacccgtaaaaccgtaaacggtaaaccgttaccgtccgtaaaccgtacgtttacgttaaccgggtaccttttaacgggaacgggtaccgtaacgtaccggttaaccccctaaccccgggtaccgggtaacccggttaacacccgggttcaaccggtaaccaacgttaaaccccggtaccgttaccccgtaagttaaacgtaaccttaacccgtaaccggtaacgtaacccggttaaacttaaaccgttcgaaacccggttaacccggaaacccgggttacccgttaacccgttttaactaaccggtttacgtaccggttacgggaaccggtaggacggtaaccggtacgggtacgtacccgggttaagggttggggaaaccctttcgggacgtacccgtaaccggttaccgttgtttccgggtttttaacgg

SEQ ID NO: 110635 - DNA, 775 bp, Homo sapiens
  misc_feature: GYAE6OF01EOJSJ.37.35.D02.1.454.CMB.1.raw
  modified_base (418)..(418): a, c, t, g, unknown or other
  misc_feature (418)..(418): n is a, c, g, or t
tcagtagtgtagatcacgaccggtgctcgatttagcacacgatagttgggttggggcatcacccagcaaccacatctgtcctctagagaatcccctgagagctccgttcctcaccatggactggacctggaggatcgtctttcttggtgcagcagtcacaggacgcccactcccgaggtagaaattggtgctagttcttcttgagtagaagagcgtgggcctcgagtgaacggtccctgaccaggcttcgagactacgatctacaacgtcttaatatactacacgtggtcgcgaccgaccggtacccctacggaaccgaacgggtcccgtaggtagtacggtagtagggtaactaaccgacttaccccgaaacccccggataccggtaggaacccgtaaccaacgtaaacgttccganaacctaaacgtgttaccgttaacgttacgaaacggcctaaggtaaccgttacccgacccgtacggtaaccccgggatacgtacccggtaccaacgaccgtaaaccgtaccccgtaccgtaactaacgtaaacgaaccgtacgtaaacgttaacccgtaaaccgtaaaacgtccggttaaccgaaacggtaaccccggtacgggttaaccccttacggttaaaccgtttacggtaggtttaccggaacgggttaacggaccgggtaaactacgggttaaccggttaccggttaacggggttaaccgggtaaagtaacggtcggaaccttacccggtacgttacgttacgttttacggg

SEQ ID NO: 110636 - DNA, 934 bp, Homo sapiens
  misc_feature: GYAE6OF01DZ9OB.37.35.D02.1.454.CMB.1.raw
  modified_base (193)..(193): a, c, t, g, unknown or other
  misc_feature (193)..(193): n is a, c, g, or t
tcagtagtgtagatcacgaccggtgctcgatttagcacacgataggttgggtttgggggcatcacccagcaaccacatctgtcctctagagaactcccctgagacgcctcccgttccctccacctagtggacgtcggaccgtgggaggtacttccgttctttcgttggtacggcagcagtacacgacggaccncccacgtaccgaggtagtaacgttggcgtacgtacgtttccttcgtttggaggtacgaagacggtccggtacgggtcctacgtaggttaccggtacccggttcccctacggtaccgtacggtccttacggtacgtaacttacgtaccttacccgttaccaaccgttaccttaaagttactaactaccggtacggttcgggtccgacccgaccgtacccgggttaccccagggaccgtaacgggtccgtaggtacggtggtaacggtacgtaacctaaccaccgtaaccccgaacccggacgtacgaccggaacgtaaccgaagtaccgtaccgcgtaaccaacgttacgttacgtacgttacggaacggtaccgtacgtaccccgttacccggaccccggtacggtaaaccccggtcgttaacgtaccccggtaacccgtaaccgtaacccggttaacccgtaacccgtacccgtaaaccgttaacgtaacccgtaaaccgttaaccggtaaacggtttaaacccgtaaacccgttaaacgttccgaaacccggggtaaccctacccggtttaaccccggttttacgtttaaccgtttaaccggtttacggccgttaacgggtacggaccggtacgttaccggtaaaccgttaccggttacgggaacggggttaacgaagggttaaccccggtccgttaacccggtacctttaccgggtttaagttccgttttaaccgggg

SEQ ID NO: 110637 - DNA, 818 bp, Homo sapiens
  misc_feature: GYAE6OF01D7CMW.37.35.D02.1.454.CMB.1.raw
  modified_base (168)..(168): a, c, t, g, unknown or other
  misc_feature (168)..(168): n is a, c, g, or t
tcagtagtgtagatcacgaccggtgctcgatttagcacacgatagttgggtttgggggcatcacccagcaaccacatctgtcctctagagaactcccctgagagctccgttcctcaccatggactggacctggaggatcgtcttctggtggcagcagtcacagggacncccactcccgagggtagaaagttgggtgactagttcctttccgtttaggacggtaggaaggaacgtccgtacgggggcctacgaggtgtaaccggtcccctggcctacgggtctttcgtacggactactacttccttaccgaaccgtccttaatttaactacgtaaccgtcgttggggtcgcccgtccgtaaccgggtcccctaccggaacggaaccggggtcctagggtagggtaggtaggtacgggtaacttaaccgaactaccccgaaaccccgtactaccggtacgggacccaaacgaacggtaaactcgtaccgaactaccgattaccgtaccgttacgacgggtacacggtaccgtcccgaacccggttacgggaaccccgtagttacgtacggtacccctacggaaccttaaccgtaccccggtaaccttaacgtaaacgttaaccggaaccttacggtaaacttaaccgggtaaaccttaaatccgttaacggaacccgtaacccgtaccgggttcctttaacgttaacggtttacgacggttacgacgggtaccgtaagggccgtaaacgtccgttaccggtacgggtaaggtaacggtacgtcggtacccggtccgttaaccgtggtttccgtttacggg

SEQ ID NO: 110638 - DNA, 759 bp, Homo sapiens
  misc_feature: GYAE6OF01EV8ES.37.35.D02.1.454.CMB.1.raw
  modified_base (73)..(73): a, c, t, g, unknown or other
  misc_feature (73)..(73): n is a, c, g, or t
  modified_base (182)..(182): a, c, t, g, unknown or other
  misc_feature (182)..(182): n is a, c, g, or t
  modified_base (303)..(303): a, c, t, g, unknown or other
  misc_feature (303)..(303): n is a, c, g, or t
  modified_base (686)..(686): a, c, t, g, unknown or other
  misc_feature (686)..(686): n is a, c, g, or t
tcagtagtgtagatcacgaccggtgctcgatttagcacacgatagttgggttgggggcatcaccagcaaccanatctgtcctctagagaactcccctgagagtcctcccgttacctcacctagtcggactggaccgtgggagtatcgttccgttgttggtcggcagtcgagtcacgaggacncccacgtccgaggtataagttggtgtctaacgttcttcgttaggaggtagaagtacggcggtacgggctcgaaggtcgtaaccggtcccgtagccggaggttcttggtacggtataacgtnttaccgtaccgaacgttaccttaattaactacgtaacgtcggtacggtcggtccgaccgaccggtacccgacggtaaccgacgggtactgggacggttaggacggtaggtactaccgtacgtacccgtaaaacccgcggtaactccgggaacgtaaccgaaacgtagtacccacggtacctaaacgtcgtaacggtttacctaacccgggagggtaaccacggtaccgtaacccgaccggtacccggtaaccggacacgttccgactaaccgactaacgtaacccgacttacgtaactaccgaacgtacgtaagtacgtaacttaacgtcgaacgaccggtacgacggtaccttacgttcgtacgttacggtcgtaggtacgngtaaccggttacgtacgttaaccgggagtaacggagttcggacctacggtaccgttcggtaccgttgggttag

SEQ ID NO: 110639 - DNA, 740 bp, Homo sapiens
  misc_feature: GYAE6OF01AXRM1.37.35.D02.1.454.CMB.1.raw
  modified_base (137)..(137): a, c, t, g, unknown or other
  misc_feature (137)..(137): n is a, c, g, or t
  modified_base (151)..(151): a, c, t, g, unknown or other
  misc_feature (151)..(151): n is a, c, g, or t
  modified_base (324)..(324): a, c, t, g, unknown or other
  misc_feature (324)..(324): n is a, c, g, or t
  modified_base (368)..(368): a, c, t, g, unknown or other
  misc_feature (368)..(368): n is a, c, g, or t
  modified_base (423)..(423): a, c, t, g, unknown or other
  misc_feature (423)..(423): n is a, c, g, or t
  modified_base (665)..(665): a, c, t, g, unknown or other
  misc_feature (665)..(665): n is a, c, g, or t
tcagtagtgtagatcacgaccggtgctcgatttagcacacgatagttgggtttgggggcatcacccagcaaccacatctgtcctctagagaatcccctgagagctccgttcctacaccatggactggacctggaggntcgtcttcgttggngcagcagtcagaggacgcccactcccgaggtagtaaagtttggtcgactaggttccctttccgttttagggaggttaggaaaggaacggtcccggtcgggggtccctacgtaggttacgggaacccgggttccccctggacccgtaggtccgttttacgtgggaacttacctnttcctttacaaccgtcttaattagtaactaacgtcggtgggtcnccgaccgaccgccccgtagaccgaacgggtcctggaggtcgtagtaggtataacnctaacccgaaccgactacgtcgggaccaaccgtaactaacggtcgacgaccacgtaacgtcgttaccgtttaccgggaagggactaacggtacgtcccgtaacccgggtacggaacccgggtactacgtcggtacccaaggtacctaaaccgtaccgtacctaacaacgtaacgtaacctacgaacgtacgtaaacctaacgtctaacgaccgaccgtacggtccttaacttactcgtacgngtaccggaggaacgtcgtacggtacgttccacggggtaggtacgacgtcggaacgtaccctcgtaggtgtttacg

SEQ ID NO: 110640 - DNA, 698 bp, Homo sapiens
  misc_feature: GYAE6OF01ANH9E.37.35.D02.1.454.CMB.1.raw
  modified_base (508)..(508): a, c, t, g, unknown or other
  misc_feature (508)..(508): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaacgccgtggggcctcgagtgaacggtcccctgccaggtcttcgtggatacatctacaacgcctattatactactacgtgggtcgcgccgacggccccctacgaccgacgggccgtggaggtggtagtgggactacactacccgaaccccgacacgtcggacgacaacgtaacgtctcgcactagtacgtactttacgagggtacagtacgtccacccgtaccggaccggtacacgtcgacacgaccactaccccgaacctacaactaacgtaactacctaacgtacaaccgttaaanccgtacgtacccgaacgtaccggttaccgttacttacgttacgacggtacggtacggtaacggaccgggtacgtaacggttaaccggttacccggtacggggttaaccggggtaaacggttaaacggtacccgggttaaacccggtacccggtttaacccggtacgggttttaccggttttaaccggggg

SEQ ID NO: 110641 - DNA, 835 bp, Homo sapiens
  misc_feature: GYAE6OF01D9ZM0.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgttcttcttggtggcagcagtcacgaggacgcccactcccaggtacgtaaagttggtgtcgagttccgtttccgtttaggagggttagaaaggaacggtccgtacgggggtccctcgtaacggtacggtaaacccggttcccccgtcggtcccgtaacgggtccgttttacggtacgggtacgtaacctactttaccgttaaccgtaacccgttaccttaatttaactaactaaccgtacgttaggggtcgcccgtcccgaacccggtccccgtaaccggaaccggtaacgggtcccgtaggtacggtgggtacggtagggtaacctaactaaccgtaccccgaaaccccggacctaccggtacggtacccgaacgaaaccgtaaacgttaccgtacggaacctaacgtaacgttacgtacgttacgggacgggactaacggtaccggtcccgtaacccggtaccgggacccggtaactacgtaccggtaccgtaacgtaaccgtaacgtaaccccgtacttaactaacgtaacgtactaacgtaagttaacctaaccgttaaacgtcgtaaccgaaccgtaccgtaccggtaccttaacttacttacggtacggtgtaccgggagacggacgtacggtaccgttacggacggtagggttaacacgggtcgacctaccggtcgttgttcgtttacgg

SEQ ID NO: 110642 - DNA, 991 bp, Homo sapiens
  misc_feature: GYAE6OF01DLVTM.37.35.D02.1.454.CMB.1.raw
  modified_base (903)..(903): a, c, t, g, unknown or other
  misc_feature (903)..(903): n is a, c, g, or t
tcagtagtgtagatcacgaccggtgctcgatttagcacacgataggttgggtttgggggcatcacccagcaaccacatctgtcctctagagaactcccctgagacgcctccgttcctcaccagtggactggacctgggaggtatcgtctttcgttgggtggcagcagtcacgaggacgcccacctacccgaaggtacgtaaagttggtgcgtacgttcctttcgtttaggaggtagaacggaacggccggtacggggtccctacgtaacgggtacggtaacccggttccccgacggtaccccgtacggttccgtttacggtaggtaaccgttacgttacttaccgttaaccgtaaccggttacctttaatttaacttaaccgttaccgtaacgggttcggggttacccgacccggaaccccgggttacccggaccccccggttaccggaaacccggtaccgggggtaccgttaacggggtagggttaacggggtaaggttaacccggggtaactttaacccgaacccgttaaaccccgtaaaccccggaacgttacggtacccggggaaaccgtaaaccggtaaaaccgtaaaccgttcgtaaccggtaccgtaacggttaccgtttaacgggtttaaccccgtttacggggaaacggtttaccggtaacggtttaaccccgtaacccggttaaccccggaacccggggtaaacccgggtacctaaccgttaccgtaaccccgggtaaactaacccggtaaacccgttaacggtaccctttaaacggaaacccgttaacgtacccgtttaacgtaaaccgggtaacctttaaaaccgttaacgtaccggttaaccgggaaccggtaaccccgtaaccggtaccctttacgttagttacccggngtacggtaagggaccgtacgtaacggttcgtaaccgttcgaggttaacggacgtacgtacgacgtacgtcgttacgttggtttaacgg

SEQ ID NO: 110643 - DNA, 592 bp, Homo sapiens
  misc_feature: GYAE6OF01A4DLK.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagccccactcccaggtagaaattggtgcagtcttcctttgaggtgaagaagccgtggggcctcagtgacggtcccctgccaggtcttctggatacattctcaactcctattatatacactgggtgcgccaggcccctcgacgaacgggcctggagtggatgggatacataccaacccgacacgtcggcgacgacaaagtcagcacatcgtactttcgagggcagacgtccacccgtcggacccggacacgtcgtcccagacaactacccgacctactactaacgtaacctcaacgtaacgacctaaatcgtacgacgaccgtacggtacctactattacgtgtcgacgacggacggcgaggtacggttacccgtaggtcgggtaagtacgttacggaccgtaacccgtcccggtagttcggtttacgg

SEQ ID NO: 110644 - DNA, 540 bp, Homo sapiens
  misc_feature: GYAE6OF02IO2HN.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtccccctgccaggcttctggatacatcttcaacgcctattatatacactgggtgcgccaggcccctcgacaagggcctggagtggatgggatacatccaaccccgacacgtggcgacacaaagtctgcacatgactttcagggcaggactcaccctggacccgggacatgtaccagcaaatacccgcctaacatacgaactcaagtacgacctaaaatctagaccgacacggccgtactacttacgtgtgacgagaggacgaagtacgttcaacgtgggaatacggtgaccgacgtcccgatcgttcg

SEQ ID NO: 110645 - DNA, 302 bp, Homo sapiens
  misc_feature: GYAE6OF02ISZPC.37.35.D02.1.454.CMB.1.raw
  modified_base (137)..(137): a, c, t, g, unknown or other
  misc_feature (137)..(137): n is a, c, g, or t
  modified_base (257)..(257): a, c, t, g, unknown or other
  misc_feature (257)..(257): n is a, c, g, or t
  modified_base (259)..(302): a, c, t, g, unknown or other
  misc_feature (259)..(302): n is a, c, g, or t
tcagtagtgtagatcacgaccggtgctcgatttagcacacgatagttgggtctgggacagacttcagtctcatgatcgacacactggacccaacagattttgctgtctattactgtcagcactatgggtcccccggngtgacgttcggccaagggaccacgggtggaagtcaaacgactgtggctgcaccatctgtcttcatcttcccgccatctgaatctacactactgacgcgggctggcaaggcgcattaggcngnnnnnnnnnnnnnnnnnnnnnnnnnnnnnnnnnnnnnnnnnnnn

SEQ ID NO: 110646 - DNA, 555 bp, Homo sapiens
  misc_feature: GYAE6OF02JZ199.37.35.D02.1.454.CMB.1.raw
  modified_base (284)..(284): a, c, t, g, unknown or other
  misc_feature (284)..(284): n is a, c, g, or t
  modified_base (401)..(401): a, c, t, g, unknown or other
  misc_feature (401)..(401): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctgggcctcagtgaaggtcccctgtcaggcttctggatacatcttcaacgcctattatatacactgggtncgccaggcccctgaccaagggcctgagtggagtgggatacatcaaccccgacactggaccgacacaaagtctgcacatgactttcgagggtcagacgtcacccgtggaccccggganacgtcgtccagctaactacccgcctacatagaactcagtacacctaaaatctagacgaccgacggccgtacttacttacgtgttagaccgagacggcgaaggtacgttccgaacgttgggaattaaggtcgacgaccgtcccggattgttaccg

SEQ ID NO: 110647 - DNA, 593 bp, Homo sapiens
  misc_feature: GYAE6OF02HSQNU.37.35.D02.1.454.CMB.1.raw
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggacctcaggtgaaggtcccctgccgaggcttcgtggatacatcttcaacgcctattanatacactgggtncgccacggcccctcgacacgggcctaggagtggagtgggatacgagtaccaaccccgacacctacggacgaacacgaaagtctagacacatcgactttacgagggtcaggacgtaccacccgtacggaacccgggacacgtcggtaccagacaaactacccgacctaacactaacgaaccttcgaagtacgacctaaatcgtagacgacgacggtccgtactagtactgtacgcgagacggtacgaggtacgttccgacgtggggtaataaggtcgaccggtacctacccggtagttcgttacg

SEQ ID NO: 110648 - DNA, 511 bp, Homo sapiens
  misc_feature: GYAE6OF02HO4KI.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactggtgcgcaggcccctcgacaagggcctgagtggatgggatacatcaaccccgacactggcgacacaaagtctgcacatcgactttcagggcagagtcacctgacccgggacatgtccagacaataccgctacatagaactacagtacgacctaaatctagacgacacggccgtctattactgtgcgagaggcgagacgtccataggggataagtggcgactccgatgttcg

SEQ ID NO: 110649 - DNA, 609 bp, Homo sapiens
  misc_feature: GYAE6OF02JZL54.37.35.D02.1.454.CMB.1.raw
  modified_base (364)..(364): a, c, t, g, unknown or other
  misc_feature (364)..(364): n is a, c, g, or t
tcagtagtgtagatcacgaccggtgctcgatttagcacacgatagttgggtttggggcatcacccagcaaccacatctgtcctctacgagaatacccctgagagctccgttcctcaccatggactggacctaggaggatcgtcttcttggtggcagcagtcacaggagcccactcccaggtgaaattcggtgcagtcttcctttgaggtgaagaagcctggggcctcagtgaaggtcccctgccaggcttctggatacgatcttcaacgcctattatactacactggtgcgccaggcccctcgacaagggcctgagtggatgggatacatcaaccccgcactggcgacacaaagctagcacatnactttcagggcagacgtccaccctgacccgggactacgtcgtaccgagacaacttacccgaccctaaccgaactaacgaacttaccgaagttacgaaccttaaaactctacggaaccgaccgaaccggtccccttacgttacgttaactcggttacgacgacgacggacgtacgaaccggtttcccgaaccgttaggggtaactaacggtcggaccgtaacccgttcccggatccgttttaccgg

SEQ ID NO: 110650 - DNA, 623 bp, Homo sapiens
  misc_feature: GYAE6OF02G5B8M.37.35.D02.1.454.CMB.1.raw
  modified_base (338)..(338): a, c, t, g, unknown or other
  misc_feature (338)..(338): n is a, c, g, or t
  modified_base (404)..(404): a, c, t, g, unknown or other
  misc_feature (404)..(404): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctgggcctcagtgaaggtcccctgccaggcttctggatacatcttcaacgcctattatatacagtggtgcgcgacggcccctcgacaacgggcctgagtggagtgggatacatccaaccccganacgtggcgacacaaagtctgcacatgacctttcgagggcagacgtccacccgtaggaccccggganacgtcggtacccaagaccaacgtacccgccttaacgaacttaacgaacctaccgaagtacgaaccttaaaactcgtacgaaccgaccgaccggtaccgttacttaacttaccgtgttacgacggaggacggtacgaacggtaccggttacccgaacggttacggggtaactaacgggtacggacccggtaaccgtaccccggtagttacggtttaccgg

SEQ ID NO: 110651 - DNA, 529 bp, Homo sapiens
  misc_feature: GYAE6OF02IBR71.37.35.D02.1.454.CMB.1.raw
  modified_base (282)..(282): a, c, t, g, unknown or other
  misc_feature (282)..(282): n is a, c, g, or t
  modified_base (394)..(394): a, c, t, g, unknown or other
  misc_feature (394)..(394): n is a, c, g, or t
  modified_base (431)..(431): a, c, t, g, unknown or other
  misc_feature (431)..(431): n is a, c, g, or t
  modified_base (505)..(505): a, c, t, g, unknown or other
  misc_feature (505)..(505): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgagagcctgggcctcagtgaaggtcccctgccaggcttctggatacatcttcaacgcctattatatacactgggtncgccaggcccctcgacaagggcctgagtggatgggatacataccaaccccgacactggcgacacaaagctgcacatgactttcagggcagacgtcacccgtgaccccggganatcgtccagcaactaccgctacatacgaactcagtanacctaaatctagacacacggccgtactacttactgtgcgagacggcaaggtacgttccacggtgggaattaggngaccgtaccgtcccggtatgttcg

SEQ ID NO: 110652 - DNA, 552 bp, Homo sapiens
  misc_feature: GYAE6OF02I6Z1S.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactgggtgcgccagcccctcgacaagggcctgagtggatgggatacgatcaaccccgacactcggacgacaacaaagtcctgacacatagactttcagggcagagtccacctcggacccgggacacgtcgtaccagctaaactaccgacctacaactacgaactacagtagacctaaatctacgacgacaccggccgtacttactactagtcgacgagaggacgaggtactccgacgtaggggataacggtcggccgacgtcccgtatcgttacg

SEQ ID NO: 110653 - DNA, 534 bp, Homo sapiens
  misc_feature: GYAE6OF02I47TO.37.35.D02.1.454.CMB.1.raw
  modified_base (451)..(451): a, c, t, g, unknown or other
  misc_feature (451)..(451): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactgggtgcgccaggcccctcgaccaagggcctgagtggatggggatacgatcaaccccgacactggcgacacaaagtctgcacatcgactttcagggcagagtcaccctcgacccgggacactgtccagcaactaccgcctacataagaactacagtacgactaaaactctanaccgacgacggccgtctaattactgtacgcgaggacgcgagtagttccgacgtgggaataggtcgaccgactcccgatgttcg

SEQ ID NO: 110654 - DNA, 530 bp, Homo sapiens
  misc_feature: GYAE6OF02GMM7X.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactgggtgcgccaggcccctcgacaagggcctgagtggagtgggatacatccaaccccgacactggacgacacaaagtctgcacatgactttcagggcagacgtcacccgtcggacccgggacagtcgtccagacaactacccgcctaacactaagaactcagtacgacctaaatctagacgacacggccgttactattactgtcgacgagagcaggagttccagtgggatagtcgcgacgtccgtatgttcg

SEQ ID NO: 110655 - DNA, 804 bp, Homo sapiens
  misc_feature: GYAE6OF02JSE6Y.37.35.D02.1.454.CMB.1.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
tcagtagtgtagatcacgaccggtgctcgatttagcacacgatagttgggtttgggggcatcacccagcaaccacatcctgtcctctagagaatcccctgagagctccgttcctcaccatggactggaccctggaggatcgtcgttcttggtggcaggtctagtcacaggtagcccactcccaggtgaattggtgcagtcttcttgagtgaagagctgggctcngtgaggtccctgcaggctcnggatacatcttcacgcctattactatacactggtgacgccaggcccctcgacaacgggcctggacgtggagtcgggatacgacgtacgaacccccgtaacgaaccgtacgggaccgaaccgaaccgaaaacggttacctaacggtacctaaacgtacgttagtaacccgttttacgaacggggtaccgaacgggtaacgttaccgtaaccccgtacggtaacccccggggtaacaacgtttacggaacccgtaacgacccgtaaaacgtaaccccggtacccttaaaccgtaacgttaaccggtaaacccttccggtaaacggttaaaccgtaaacccggtttaaaaaacgttccgtaaccgtaacccggaaaccggtaaccccgggtaacccgttaaccgtttaaacgtttaaccgtacggttaacgtaaccggtacggtaacgggtacccgtaaacgggttaaccgtttaccggaacggttaacgggggtaaagtttaaccggtacggttaacccggtaaccccgtttaaccggttacgtaccggttttttacccggg

SEQ ID NO: 110656 - DNA, 577 bp, Homo sapiens
  misc_feature: GYAE6OF02IJHYM.37.35.D02.1.454.CMB.1.raw
  modified_base (559)..(559): a, c, t, g, unknown or other
  misc_feature (559)..(559): n is a, c, g, or t
tcagtagtgtagatcacgaccggtgctcgatttagcacacgatagttgggtttgggggcatcacccagcaaccacatctgtcctctagagaaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattaatatacactgggtgcgccaggcccctcgaccgaacgggcctgaggtggactggggaatacgattccaaacccccggacacgtcggcgaacaacaaaggtcagcaacatcgtaacttttcgacgggcaagacgtcacccgtcggaaccccgggacaacgtcgtaccgacgacaaacgtacccgacctaacgactaagaacctcaagtaacgtacctaaaagtctagacgacgacggtaccgtctaactactgtacgcgagacgacgacgtacgttcagtggaatagnggcgacgtcgatgttacg

SEQ ID NO: 110657 - DNA, 665 bp, Homo sapiens
  misc_feature: GYAE6OF02JKA9M.37.35.D02.1.454.CMB.1.raw
  modified_base (249)..(249): a, c, t, g, unknown or other
  misc_feature (249)..(249): n is a, c, g, or t
  modified_base (285)..(285): a, c, t, g, unknown or other
  misc_feature (285)..(285): n is a, c, g, or t
tcagtagtgtagatcacgaccggtgctcgatttagcacacgatagttgggtttgggggcgatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagagcctggggcctcagtgaaggtcccctgccaggcttcnggatacatcttcaacgcctattatatacactgggtncgccaggcccctcgacacgggcctgagtggatgggatacgataccaaccccgacacgtggccgaacacaaagtcgtagcaacatgtacctttcgaaggggtcaggtacgtccacccgtacggaccccgggactaacgtcgtaccgtacgactaaacgtacccgcctaacactaaccgtaactactagtaacgacccttaaaagtccgtacgaaccggtaccgtaaccgggcccgtttacttaaccgttaccgttacggtacgaccggtacggtaacggggacctaacgggttaacgtttacccgaaccgggttagggggtaaacgttaacgggttaccggaccggtaacccggttacccggtacgtttacggtttaccgg

SEQ ID NO: 110658 - DNA, 549 bp, Homo sapiens
  misc_feature: GYAE6OF02HDQO9.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctgggggcctcagtgaaggtcccctgcccaggcttctggactacatcttcaacgcctattatatacactgggtgcgccaggcccctcgacaagggcctgagtggatggggatacatcaaccccgacactggcgacacaaaagtctgcacatgactttacagggcagagtccacctcgacccgggacatcgtccagcaactaccgcctacatagaactcagtacacctaaaactcgtagaccgacacggccttacttattacctgtacacgagaggacgaagagttacccgacgtgggtaataaggtcggaccgtaccgtcccggtatcgtttcgg

SEQ ID NO: 110659 - DNA, 567 bp, Homo sapiens
  misc_feature: GYAE6OF02HV76A.37.35.D02.1.454.CMB.1.raw
  modified_base (340)..(340): a, c, t, g, unknown or other
  misc_feature (340)..(340): n is a, c, g, or t
  modified_base (440)..(440): a, c, t, g, unknown or other
  misc_feature (440)..(440): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattactatacactggtgcgccaggcccctcgacaaggggcctggagtcggatggggatacatcaaccccganactggcacacaaagtctgcacatgactttcagggcagagtcaccctggacccggacagtgtccagcaactaccgctacataacgactcatagcctaaaanctagacgacaccggccgtactaacttactgttgccggtagacgggcgaacggtacgtttacccgaacggttagggggtaacgttaaaggtcggtacgtaaccggtaccccggagttcggtttaccgg

SEQ ID NO: 110660 - DNA, 678 bp, Homo sapiens
  misc_feature: GYAE6OF02G86Z5.37.35.D02.1.454.CMB.1.raw
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
  modified_base (390)..(390): a, c, t, g, unknown or other
  misc_feature (390)..(390): n is a, c, g, or t
  modified_base (438)..(438): a, c, t, g, unknown or other
  misc_feature (438)..(438): n is a, c, g, or t
tcagtagtgtagatcacgaccggtgctcgatttagcacacgatagttgggtttgggggcatcacccagcaaccacatctgtcctctagagaatcccctgagagctccgttcctcaccatgactggacctggagatcgtcttcttggtggcagcagtcacaggagcccactcccaggtagtaaattggtgcagtcctttcctttggaggttgaaagaacgccgtggggcctcgagtggaacggtccctgccaggtcttctggatactatctcaacgctattatatacacgtgggtagccgccgaccggcccctcgaaccgaacgggtctcggaggtcggagtgggatacactaccgaaccccgtanacgtgaccganaacgaaagtcgtanacacatcgtactttcgagggacaggactaccaccgtacgacccggtanacgtcgtaccagtacgaaacctaccgtacctaacgaacgtaacgtaacctacgtaacgtacgtaaaccttaaaacgtcgttaacggacctaaccgaacccggtcccgtaacctttacgttaaacgttcgttacggcggtaacgacggtacgtaacgggtaccgtttacccgtaacgggttacgggtaaattaccggggtatcccggtaaacccggtcccggtaacgttcgttttaaccgg

SEQ ID NO: 110661 - DNA, 540 bp, Homo sapiens
  misc_feature: GYAE6OF02GCMYR.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactgggtgcgccaggcccctcgacaagggccctgagtggatggggatacatcaaccccgacactggcgacacaaagtctagcacatgactttcagggcagagtcaccctgacccgggacagtcgtccagacaactacccgcctacatagaaacctcaagtacgacctaaaatctagacgacacggccgttactacttactgtcgacgagaggcgaaggacgttaccgacgtagggatacggtgaccgactcccgtatcgttcg

SEQ ID NO: 110662 - DNA, 682 bp, Homo sapiens
  misc_feature: GYAE6OF02FJZO3.37.35.D02.1.454.CMB.1.raw
  modified_base (292)..(292): a, c, t, g, unknown or other
  misc_feature (292)..(292): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagttcttcctttgaggtgaagaagcctggggcctcagtgaacggtcccctgccaggcttcgtggactacactcttcaacgccttatactatacactgggtcnccggtccacggcccctagacaagggcctgagtggagtgggactacgataccaacccccgacaccgtggacctacaacgaaacgttcctaggctaacgtactacgtaacctttacggacgggtccaagggtaccgtaccgaaccccgttaccggaccccgggtacgacgttcggtacccacgtacctaaacctacccggtaccctaacgtactaaccgtaactaccgtaacgtaacgtaacccttaaaaacgttccgtaacggaaccgtaaccgtaccgggtaccctttacgttaacttaccgtgtacgacggtagacggtacaaggtaccgttacccgaacggttacggggaacttaggtccgaccgtaccgcccgtagtccgtttacgg

SEQ ID NO: 110663 - DNA, 568 bp, Homo sapiens
  misc_feature: GYAE6OF02GRVMZ.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactgggtgcgccaggcccctcgaccgaagggcctggagtggatgggatacatccaaccccgacacgtcggacgacaacgaaagtctagacacatcgactttcgagggcagacgtccgaccgtcggacccgggactactacgtccagacaactaccgacctacagtaacgactacgagtagaccttaaatcgtacgaccgacgaccggtcgtactattacgtgtacgacgtagaggacgtacggtacgtaccgagtagggtaataggcgacgtaccgtccgtagtcgttacg

SEQ ID NO: 110664 - DNA, 720 bp, Homo sapiens
  misc_feature: GYAE6OF02F89FM.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagccgtggggcctcagtgaacggtcccctgccaggcttctggatacattcttacaacgccttaattatatacacgtgggtgccgaccacggcccctacggaccgaagggccctggaggtggatggggatacatacccaaccccgacacgtcggacaacaacgaaagtcctagaccaactagtgtacctttcgaggggcaagggtacgtaccgtacccgtaccgggacccggggtaacctagtaccggttacccaaggtaccctaaacgttaccccggacccttaacgtaaacgtaaccggtaaccttaccgtaaacggttaaccaaacccttaaaattccgtaacggtaaccgaaccgtaccggtaacccgttacgttaactttacggtacgtacggcggtacgggacggtaccgtaacggttaaccggtttacccgaacgggttaacgggggaacgttaacgggtcggtacccgtaaccggtccccggttagttccggttttaaccgg

SEQ ID NO: 110665 - DNA, 613 bp, Homo sapiens
  misc_feature: GYAE6OF02FPFWF.37.35.D02.1.454.CMB.1.raw
  modified_base (382)..(382): a, c, t, g, unknown or other
  misc_feature (382)..(382): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctgaggatcgtcttcttggtggcagcagtcacaggagcccactcccaggtgaaattggtgctagtcttccttgaggtgaagaagcctggggcctcagtgacggtcccctgccaggcttcctggactacgactcttccaaccgccctattctactaccacgtgggttcggccgcccacggcccctcgacaacggcctgagtggtatgggataacactccaaaccccccggacaccgtggcgacaccaaacgtccngcacactcgtacttcgacgggcacgcgtaccaccctcgacccgggacactcgtccacgacctaactcccgacctacacgtacgaacctacaagtacgaccctaaaactccgacgaccgaaccgacgggtacccgttactaaactttaccgtagtcgacgacgacggtcgaacgtcgttacccacgttacggggaacttacgtcgaccgtaccgtcccgtattcggttaccg

SEQ ID NO: 110666 - DNA, 661 bp, Homo sapiens
  misc_feature: GYAE6OF02GP1FG.37.35.D02.1.454.CMB.1.raw
tcagtagtgtagatcacgaccggtgctcgatttagcacacgatagttgggtttgggggcatcacccagcaaccacatctgtcctctagagaagtcccctgagagctccgttcctcaccatggactggacctggaggatcggtcttcttggtggcagcagtcactaggagcccactcccaggtgaaattggtgcagtcttcctttgaggtgaagagccgtgggcctcgagtgaacggtcccctgcccaggccttcgtggactacatcttcaacgcctatatatacactgggtgcgtccacggccccgtcggaccgtaacgggccctaggacggttagggagtagggggaacttaacgacgttaccgaaacccccggactaccgtcgggtacgaaccgaacgtaaaacggttcgtacgactaacgaacgtacgtaactttacgaggggctaaggacgtaccacccgtccggacccgggactacgtcgtaccagtacaaacgtacccgacctaactacgtaacgtaactctaagtacgaacctaaaagtctagaaccgacgtaccggccttacgtacttacgtgtcgcgtagtacggctaaggtacgttccgaagtaggggtaatagggtcggtaccgaccgttacccggtagttcgtttacgg

SEQ ID NO: 110667 - DNA, 570 bp, Homo sapiens
  misc_feature: GYAE6OF02GBLKP.37.35.D02.1.454.CMB.1.raw
  modified_base (248)..(248): a, c, t, g, unknown or other
  misc_feature (248)..(248): n is a, c, g, or t
  modified_base (284)..(284): a, c, t, g, unknown or other
  misc_feature (284)..(284): n is a, c, g, or t
  modified_base (512)..(512): a, c, t, g, unknown or other
  misc_feature (512)..(512): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagagcctggggcctcagtgaaggtcccctgccaggcttcnggatacatcttcaacgcctattatatacactgggtncgccacggcccctcgacgaagggcctggagtcggatgggatacgatccgaaaccccgacacgtcggccgaacgacaaacgtctcgcaactatcgtactttcgaagggccacggtatccgacccttcggaaccccgggacacgtacgtaccagacaaacgtacccgaccttaacatacgaactcgaagtacgaccttaaaatctacgacgacgaccgcgtctacttacngtgcgagaggcagtacttcacgtagggataaggtcgaccgtacgtcccgtatgttcgg

SEQ ID NO: 110668 - DNA, 602 bp, Homo sapiens
  misc_feature: GYAE6OF02G1RQZ.37.35.D02.1.454.CMB.1.raw
  modified_base (347)..(347): a, c, t, g, unknown or other
  misc_feature (347)..(347): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagccgtggggcctcagtgaacggtcccctgccaggcttcgtggatacactcttacaacgccttattatatacacgtgggtgcgccacggcccctcggacaagggcctggagtggatgggatacatccaaccccganactcggacgacaacaaagtctagcacagtgtactttcgagggcaggtacgtccacccgtacggacccggacacgtcgtaccgaagcaacgtaccgacctaacaacgtaacgtaacctcgaagtaccgaacctaaaagtccgtacgaaccgacgaccggtcgtacttaacttacgtcgtgacgaggacggacgacggtacgttaccgtaaggtcgggaattacggtacgaccggtaccgtcccggtagttcgttcg

SEQ ID NO: 110669 - DNA, 560 bp, Homo sapiens
  misc_feature: GYAE6OF02I0KER.37.35.D02.1.454.CMB.1.raw
  modified_base (268)..(268): a, c, t, g, unknown or other
  misc_feature (268)..(268): n is a, c, g, or t
  modified_base (289)..(289): a, c, t, g, unknown or other
  misc_feature (289)..(289): n is a, c, g, or t
  modified_base (324)..(324): a, c, t, g, unknown or other
  misc_feature (324)..(324): n is a, c, g, or t
  modified_base (528)..(528): a, c, t, g, unknown or other
  misc_feature (528)..(528): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagttcttcctttgaggtgaagaagcctggggcctcgagtgaaggtcccctgccaggcttctggatacatcttcgaacncctaattatatacactgggtncgccgacgcccctcgacgaagggcctgaggtggangggatacataccgaacccccacacgtggacgacaacgaaagttctagacacaagtcgtactttcgaaggcaggactcaccgcgaacccgggacactcgtccgagcgaactaccgaccctactaagactacgacacgtacggacctaaaactctacggacacgacgtcctattatacgtcgagtcgaggagtcgaggtactacgngtaggagtagcgaccgacgtccagtctttacg

SEQ ID NO: 110670 - DNA, 719 bp, Homo sapiens
  misc_feature: GYAE6OF02G4TFN.37.35.D02.1.454.CMB.1.raw
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
  modified_base (302)..(302): a, c, t, g, unknown or other
  misc_feature (302)..(302): n is a, c, g, or t
  modified_base (557)..(557): a, c, t, g, unknown or other
  misc_feature (557)..(557): n is a, c, g, or t
  modified_base (619)..(619): a, c, t, g, unknown or other
  misc_feature (619)..(619): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtctttcttggtggcagcagtcacaggacgcccactcccaggtagaaattggngcagtcttcctttgaggtgaagagcgtggggcctnagtgaacggtcccctgccaggtctttcgaggtataccattcttaccaacgtcctaatttactattaacacgttggngaccgtaccgaccggtccccctacggaaccgtaacgggccctaggtacggtggaagtagggtacaacacgtaacccaaccccgtacacgtcggaacgaaccaaacgtaaacgttccaacggactaaccgaagttacgtaaaccggttttacgaaccggggactaacggaacgttccccgtaaccacccgggtaccccgggtaataccgtacgtacccgaagtaccaaacgtaccccgactaacaagtacaactanaacgtcgaaaccttaaagtccacgaacaaccgtcggtaccttactttaacgtacgttacggngaaacgtcgggacgtacggtaacggttaaccggttccgaaacgggttacggaaagtttaacggtccggaacgttacccgacggtacgttaggttttaccg

SEQ ID NO: 110671 - DNA, 557 bp, Homo sapiens
  misc_feature: GYAE6OF02G50S8.37.35.D02.1.454.CMB.1.raw
  modified_base (249)..(249): a, c, t, g, unknown or other
  misc_feature (249)..(249): n is a, c, g, or t
  modified_base (278)..(278): a, c, t, g, unknown or other
  misc_feature (278)..(278): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttcnggatacatcttcaacgcctattatatacncgtggtgcgccacggccccgtccgacgaacgggacctcggagtggagtgggatacatccaacccccgacgactcggcgacacaaagtctgacacatgtactttcagggcagagtcacctcgacccgggacagtcgtccagacaactacccgcctaactatacgaactcagtacgacctaaaactctacgacgacgacggcccgtacttacttacgtgtgcgagacgacgtacgacgttcaacgtgggtaagtaggtgtccgacgtacccgtgtgttccg

SEQ ID NO: 110672 - DNA, 632 bp, Homo sapiens
  misc_feature: GYAE6OF02GZK9T.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagccgtggggcctcgagtgaaggtcccctgccaggcttctggatacatcttcaacgcctattactatacactgggtgcgccaggcccctcgacaagggcctgagtggatggggatacataccaaccccgacacgtggacgacacaaagtctgcacatgactttcagggcagtagtcccacccgtcgacccggtacgacgtagtccgtacgaccgaacgtaacccgtaccgtaccctaataacgtaaccgtacctacggtaacgtaaccgtaaacttaacgtacgtaacgaaccgtaaccgggaccgtacgttaaccttacgttacgttacggtcgtacgacgggacgtacggaacgtttaccggtacggtaacgggtaggtaaggtacgtcggaacccgtacccgttacgtacgtttacgg

SEQ ID NO: 110673 - DNA, 758 bp, Homo sapiens
  misc_feature: GYAE6OF02IQS8P.37.35.D02.1.454.CMB.1.raw
  modified_base (591)..(591): a, c, t, g, unknown or other
  misc_feature (591)..(591): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttccttggtggccagcagtcacgaggacgcccactccccgaggtgaaattcggtgccagtcctttcctttgacggtgaagaagcccgtaggggccttcgaagtcggaacggtcccccttaggcccagggtccttgtaggataacctattacttaccaaaccgccttaatttaataacgttaacaaccgttggggtcgccgaccccgtaacggccccccttacggaaccgtaaacggggccccgttagaacgggtacgggaagttaggggtaacttaaccgaacgttacccaaaacccccgtaacgtaccgtacggtccgaaaccaactaaaacgtccgtacgacgtaaacgtactcggtaactttacgacggggtacagtacgtaccacccgtacgacccgggactagtacgtaccacggtacaacgtacccgtacttaaccaagtttanaacccgtaataagttaccgaaaccttaaatccgtaacgaaccgtaacgaacccggtaccgttatttaacgtaccttacgcggtaaccgtagaacggacgaaggttaccgtaccctacggtaaggtacttaaggtacgtccggtaaccgtacccgagtttccttacgg

SEQ ID NO: 110674 - DNA, 734 bp, Homo sapiens
  misc_feature: GYAE6OF02FTCX6.37.35.D02.1.454.CMB.1.raw
  modified_base (294)..(294): a, c, t, g, unknown or other
  misc_feature (294)..(294): n is a, c, g, or t
  modified_base (475)..(475): a, c, t, g, unknown or other
  misc_feature (475)..(475): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtgcagcagtcacaggacgcccactcccaggtgaaattggtgcagtcttccttgaggtgaagaagccgtggggcctgagtgaacggtcccctgccaggcttcctggatacatcttcgaacgccttaattataactaccacgttgggngtccgccacggtcccctcgaacgacgggtcctggacggtggacgtggggactaacgtactaccgaaaccccggacaccgtgggaccgtaacgaacgtaaacgtctagacctaacgagttacgtaccgttttacgacgggacctaaggaccgttcccgacccgttaccggaaccccgggtanacgtacgttaccgacgtaccaacggtacccgtcccttaacgaacttaacgaaccgtaccgtaacggtaactacctaaaacgtccgtaacggtaaccgacccgggtaaccggtacccgggttactttaaccggttacgtttaacggtcgtaaccgggtaggaaccggtacgtaaccggtacgttaccggacggttacggggtaaacgttaacgggtaccggaccggttacccgtacccgggtacgttacggttttaccgg

SEQ ID NO: 110675 - DNA, 814 bp, Homo sapiens
  misc_feature: GYAE6OF02IDIQJ.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttctcaccatggactggacctgggagactcgtcttcttggtggcagcagtcacgaggacgccccaaccgtcccgtaggtacgaaagtttgggtgctacgttccttttccgttttaggagggttaggaaggtaacggccggttcgggggtcccttacgagggttacggtaaaccgggttcccctaggacccgtaggggttccctttaggtcgggtaacttaaccgtactttaccttaccgtaaaccggttaccctttagttaacttactaaacgttaccgggtggggttcgacccggtacccgtaccggggtaccccccttcgggtaaaccggacggggttacccgtagggtaacggtcggtaggttacggggtaactaccgtaacttacccccggaaccccggtacgtaccggtacgggaaccgaaccgtaaacgtaaacggtctacggacccttaacgaattcggttactttacggacgggtacaaggtcgaccctaccgcgggtaacccggacgtactcgacgtacgaccgaccgtaccgctaacaactacgacttacgacgtacaccttaaagtctacgtaccgaacctccgttaccgtactttacgtcgacggttacaccggttagaccggtacgtagtaacccgtcgtacgggtacggtaagttacgtcggaacccggtctccggttagttccgtttacgg

SEQ ID NO: 110676 - DNA, 697 bp, Homo sapiens
  misc_feature: GYAE6OF02I9WWZ.37.35.D02.1.454.CMB.1.raw
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagttctttccgtttggaggttgaagaacgccgtggggcctcgaggtacgaacggttcccctgccgtacggtcttcgtggactacgtattcttacaacgcctaattatataacacgttgggtagccgtccgacggtccccctacgaccggtaacgggccgtggacggtggacgtggggactaacacgtaccgaaacccccgacaaccggtcggtaacgaaccaacgtaaacgtcctagacaccgatacgtactttcgaaggctaggacgcccgtaccgtcgggaacccggtactacgtcgtaccgaacgtactaaccgtacccgtacctaactaacgtaaccgaacgttacaacgtaaccgaccttaaaatccgtacgaaccgacgtaccggtccttactacgttacgtagtacgacgtaggacggtacggtaacgtacggttacccgtaggtagggtaacgtaacggtcggacccggtaaccgttccgtacggttcgtttaaccggg

SEQ ID NO: 110677 - DNA, 607 bp, Homo sapiens
  misc_feature: GYAE6OF02GOTOT.37.35.D02.1.454.CMB.1.raw
  modified_base (285)..(285): a, c, t, g, unknown or other
  misc_feature (285)..(285): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactgggtncgccaggcccctcgacaagggcctgagtggagtgggatacatcaaccccgacacgtggcgacacgaaagtctgcacatgactttcgagggcagacgtcacccgtggacccgggacatcgtaccacgactaaactacccggaccctaacaactaacgaacctacgaacgtaacgtacctaaaactcttaacggaaccgaaccgaaccggtccgttacgttaactttacttgtacgaccggaggacggcgaaggtacgttacccgtaacggtacggggtaacttaacggtacgaccggtaccctcccggtagttcggtttaccg

SEQ ID NO: 110678 - DNA, 789 bp, Homo sapiens
  misc_feature: GYAE6OF02GNAXA.37.35.D02.1.454.CMB.1.raw
tcagtagtgtagatcacgaccggtgctcgatttagcacacgatagttgggtttgggggcatcacccagcaaccacatctgtcctctagagaaatcccctgagagctccgttcctcaccatggactggacctggaggatcgtcttcttggtggcagcagtcacaggagcccactccccaggtagaaattggtgcagtccttcctttgaggtgaagaagccgtggggcctcagtgacggtcccctgccgaggtctctggactacatctacgaacgcctatatactacacgtgggtgccgccgacgcccctcggaacgaacgggtcctaggacggtaggagtacgggactacgactacccgaaaccccggacgacgtacggaccgaacaacgtaaacggtcctacgacctaactagttacggtacctttacggaacgggtaccaacgggtaccgttacccgaaccccggttaaccgggaaccccgggtaactaccgttaaccggtaccccgtaaacggaaccctaaaccggtaaccccgtacccgtaaaccgttaacgtaaacggtaaacccgttaccgaaacggttaacgtaaacccgttaaaaacgttcgtaaaccggaccgtaaccggacccgggttaccgtttaacgttaacgttaccgttacgtaccgggacggtaacgggtacggtaaccggtaacggttaacccgttaccggtaaccggtaacggggttaacgtaacggtcggttacccgacccggttacccgttacggtttaggtttacccggg

SEQ ID NO: 110679 - DNA, 727 bp, Homo sapiens
  misc_feature: GYAE6OF02IR73I.37.35.D02.1.454.CMB.1.raw
  modified_base (193)..(193): a, c, t, g, unknown or other
  misc_feature (193)..(193): n is a, c, g, or t
tcagtagtgtagatcacgaccggtgctcgatttagcacacgatagttgggtttgggggcatcacccagcaaccacatctgtcctctagagaatccccctgagagctccgttcctcacccatggactggacctgggaggatcgtcttcttggtggcagcagtcacaggagcccactcccaggtgaaattggtgnacgtctttcctttgagggtgaagaagccgtggggcctctagtgaacggtcccctgccaggcttctggatacacttcttcaacgccttattactataacgaccgggtgccgccgaacggcccctacgacgaacgggccgtgaggtggagtggataacactccaaccccgagactcggacgaacaacgaaagctccggcaacgtagtacgttacgtttcgaaggggacaaggaccgtcccgaaccccgttaccgggaaccccgggactacgtccggtaccacggtacgtaactaacccggtcctaaccgtacttaaacgtaccacttacgtaaccgtaacccttaaataccgttaacggaacgacccgtacggtacccgttacgttaacggttaccttaggtaccggacggaccgagggtaaccgtcgggtaaccgtttaaccgggtaccggttaacgggggtaccgttaaagggttcccgtaacccgggtacccgttaccccgggtaagtttccgggtttacttttacccggggg

SEQ ID NO: 110680 - DNA, 657 bp, Homo sapiens
  misc_feature: GYAE6OF02FYE6H.37.35.D02.1.454.CMB.1.raw
  modified_base (286)..(286): a, c, t, g, unknown or other
  misc_feature (286)..(286): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaacggtcccctgccaggcttctggatacatcttcaacgcctattatatacactgggtncgccaggcccctcggacaagggcctggagtggatggggatacgactaccgaaccccgacacgtggccgaacacgaaagtcctagcaactatacgtacctttcgaacggggcaacggtacgtccgaccccgttacgggaaccccgggactacgtcggtacccagacccaaacgtacccgaccttaacaacgttaacgaaaccttcgaacgttaacgtaacccttaaaattccgtacgaaccgtaacccgtacggtcccgttacttaacgtttacgtggtacgacggacgtaaggaccgtaacggtaaccgttaccgacgttaggggtaacgttaaggtcggtaccgtaccgtcccggtagtacgtttaccgg

SEQ ID NO: 110681 - DNA, 762 bp, Homo sapiens
  misc_feature: GYAE6OF02JPM0E.37.35.D02.1.454.CMB.1.raw
  modified_base (259)..(259): a, c, t, g, unknown or other
  misc_feature (259)..(259): n is a, c, g, or t
tcagtagtgtagatcacgaccggtgctcgatttagcacacgatagttgggtttgggggcgatcacccagcaaccacatctgtcctctagagaatccctgagagctccgttcctcaccatggactcggacctggaggatcgtcttcttggtggcagcagtcacaggacgcccactcccaggtagaaattggtgcagtcttctttgaggtgaagagccgtgggcctgagtgaacggtcccctgccaggtctcgtggatacntcttacaaccgtccttattagtactactacgtgggtctcgaccgacgtcccctcggaaccgacggggtcctaggaacggtcgggacgtacggggtaataacctacgtaccgaaacccccggtactaccggtacgggaccaacgtaaaccgtaaagcccgtacgacccaacgtacgttaccgttactttcggaacggggactaagaccgttaccacccgtacgggtacccggataaccggtacgtacccgtaagaccgtaaaccgtacccgaaccgttaacaacggttaaaccgtaactaccgaaacggttaccgtaaaccgttaaacgttccgtaaccgtaaccggtaacccgtaaccgggttacccgttaacctttaagtaacccggtggtacccgacggtacgggtaacggtacgtaacggtaccggtttacccggaacggtttaacggggtaataacgggtccggaccgtaaccggttccgtaacgttcggttttaacgg

SEQ ID NO: 110682 - DNA, 857 bp, Homo sapiens
  misc_feature: GYAE6OF02IGEXX.37.35.D02.1.454.CMB.1.raw
tcagtagtgtagatcacgaccggtgctcgatttagcacacgatagttgggtttggggcatcacccagcaaccacatctgtcctctagagaatcccctgagacgctccgttcctcaccatggactggacctggagatcgtcttctggtggcagccagtcacaggacgcccactacccagggttagaaacgtttggtcgacagttcctttcctttggaggttggaagtaacggtaccgtgggggtccctacgtaggtacggtaacggttcccctcgaccgtacggtaccttcgtcggacttaactacttcctttacgaaccgtaccgttaattattaaccgttactaacggttcgggttacgccgtaccgaaccggccccttaaccggaacgtaaccggggtacccgtaggtacggtacgggtacggttacggggtaactaaccgtaaccgttaaccccgaaaaccccccggtaacgtaacccggttacggaacccggaaccccgtaaacggtaaaccggttaccgttccgaaccgtaaaccgtacgttacgttaacccgttttaacggaaccggggtactaaccgggacgttacccgaaccccggttaccgggaacccggacgtaacgttcgaacccgtagaaccgtaaccgttacccgtacgttaacgtaaacaccgtaaaccgtacgtaaccttacggaaaccttaaacgtccgtaactaaccgacccggtaccggtaacccttaccgttaagtttaaaccggtccgttaggaacgggtacgtacgacgtaaggttacccgttacgacggacggtaacttacgacgtaccgtacccgtacgttgtaccgtttacgg

SEQ ID NO: 110683 - DNA, 707 bp, Homo sapiens
  misc_feature: GYAE6OF02H9OZO.37.35.D02.1.454.CMB.1.raw
  modified_base (180)..(180): a, c, t, g, unknown or other
  misc_feature (180)..(180): n is a, c, g, or t
  modified_base (386)..(386): a, c, t, g, unknown or other
  misc_feature (386)..(386): n is a, c, g, or t
  modified_base (617)..(617): a, c, t, g, unknown or other
  misc_feature (617)..(617): n is a, c, g, or t
tcagtagtgtagatcacgaccggtgctcgatttagcacacgatagtgggtttgggggcatcacccagcaaccacatctggtcctctagagaatcccctgagagctccgttccttaccatggactgacctggagatcgtctcttggtggcagcagtcacgaggtacgcccactcccaggtnaaacttggtgacagtcttcccgtttaggacggtagaaagacgccgttcgggccttcgaggttacggaaccggttcccctaggaccgaaggtctttacgtcggatactacttccgttacaacgtacctattacgtaacgactacggtgggtacgtcgacccgtaccgcccgtacgaaccggaacggggtcctaggacggtgggtagnggggtactaccgactaccgaaaccccgtcaccgtggaccgactaaccaagttccacgacacgtcgtacgtcctttacgaggtcaggtactaccgaccgtaccggtacccggactacgtcgtaccgacgtacaacgttaccgtacctaacgtacgtaacgacctacgtagtacgtaaacctaaattcgtacggtaaccgaccgttaccgggacccttacgtaacgttaccgngttaaccgcgtaagtacgggacacggtctacccggtacgtagggtacttaaggccgtacgaccgttaccgacttacggtacttttacggg

SEQ ID NO: 110684 - DNA, 763 bp, Homo sapiens
  misc_feature: GYAE6OF02FXV9S.37.35.D02.1.454.CMB.1.raw
tcagtagtgtagatcacgaccggtgctcgatttagcacacgatagttggggtttgggggcatcacccagcaaccacgatctgtcctctagagaatcccctgagagctccgttcctcaccatggactggacctggaggatcgtcttcttggtggctagcagtcacaggagcccactcccaggtgaaattgggtgcgtagttcctttccgtttggaggtagaagtaacgccgtgggcctcgagtgaaccggtcccctggccgtacggtcttcgtaggactactacgttcttacaaccgtccttaattacttactactacgtgggttacgccgtaccgacggtccccctcggaacgtaacggggtccctaggaggtacgggagtcgggaacttaaccgacgttacccgaaacccccggtactaccgttacggaccgtaaacaaacggtaaacgttcgtacggacctaacgtagttacggtaacttttacggacgggtactacggtacgtacccgtaacccggtaccgggtacccgggactaaccggtacgttacccgacgggtaactaaccgtacccgtacctaacgtaacgtaacgtaacgtacgtaacgtacgtaaaccgttaaactcggtaacgtaacgaacgtacccgtacgttactttaacgttacgtcggtaacgcgtacggaagtacggtaacggtccgttaccgtaaggtaggtaagttacggtcgtacccgtaccggtccgtagttcggtttaccgg

SEQ ID NO: 110685 - DNA, 588 bp, Homo sapiens
  misc_feature: GYAE6OF02JE0Q6.37.35.D02.1.454.CMB.1.raw
  modified_base (502)..(502): a, c, t, g, unknown or other
  misc_feature (502)..(502): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtcttctttgaggtgaagaagccgtggggcctgagtgaacggtcccctagccaggtcttcgtggatacattcttacaacgcctattactatacacgtgggtacgcgccacggccccgtacgacgaacgggcctggacgtggagtggatacagtccaacccgacacgtcggaccgacgaacaaacgtctacgacacagtacgtactttcgaagggtcaaggacgtaccacccgtacggaacccggactactcgtaccgacgacaacgtacccgacctaacgaactacgaactcaacgtacgacctaaatcanaccgacacgtacctatactctcgtgaccgagacggagagtacgtccgagtaggtagtaacgcggtacgtccgtaccgtagtgttcg

SEQ ID NO: 110686 - DNA, 663 bp, Homo sapiens
  misc_feature: GYAE6OF02IG2TF.37.35.D02.1.454.CMB.1.raw
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (289)..(289): a, c, t, g, unknown or other
  misc_feature (289)..(289): n is a, c, g, or t
  modified_base (391)..(391): a, c, t, g, unknown or other
  misc_feature (391)..(391): n is a, c, g, or t
  modified_base (442)..(442): a, c, t, g, unknown or other
  misc_feature (442)..(442): n is a, c, g, or t
tcagtagtgtagatcacgaccggtgctcgatttagcacacgatagttgggtttgggggcatcacccagcaaccacatctgtcctctagagaatccccctgagagctcccgttcctcaccatggactggacctggaggatcgtcttcttggtggcagcagtcacaggacgcccactcccgaggtgaaattggtgcagttcttcctttgaggtgaagaagccgtgggcctgagtgaacggtcccctgccgaggtcttcgnggatacntcttcgaacgtcctattatatacncgtggtcgcgcccgacggccccctcgaacgacgggtccctaggtaggtggagtgggatacgatacccaaccccgctacgtcggacgaaccaacaaagtccgngacacagttgtactttcgacggcagtcgtaccgacccgacggacccggtanagtcctacgacgaccgtaaccgtaccctaccgtaacacgtaaccgtaacttcgaacggtacctaaacccttaaagtccgtacgtaaccgacccgtacccggtaccgttaccttacgttaacgcggtacgtaccggaggtacggtacgacgttaccggttaccgtaacggttgggtaagttacggtacggtccgtaacccgccggttattcggtttaaccgg

SEQ ID NO: 110687 - DNA, 601 bp, Homo sapiens
  misc_feature: GYAE6OF02IYYDW.37.35.D02.1.454.CMB.1.raw
  modified_base (283)..(283): a, c, t, g, unknown or other
  misc_feature (283)..(283): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtcttcttggtggcagcagtcacaggagcccactcccaggtgaaattggtgcagtctttcctttgaggtgaagaagccgtggggcctcgagtgaacggtcccctgccaggcttctggatacatcttacaacgcctattatatacncgtaaaaggtgcgcacgccctcgacaagggcctgagtggagtgggatacgataccaaccccgacactggacacgacaaacgtctagacacagtactactttcgaggacaggacgtaccgtacccgacggacccggacacgtgtccagacaactaccgacctacaactacgaacctactaacgtacgaactaaactacgtacgacgaccgacggtccgttaccttaagttacgtgtacgtacgtacgaggacgacggtacgttaccggacgttagggaacttaaggcgtacgtaccgtacccgttagtacgttttacgg

SEQ ID NO: 110688 - DNA, 558 bp, Homo sapiens
  misc_feature: GYAE6OF02HYR7Y.37.35.D02.1.454.CMB.1.raw
  modified_base (474)..(474): a, c, t, g, unknown or other
  misc_feature (474)..(474): n is a, c, g, or t
  modified_base (503)..(503): a, c, t, g, unknown or other
  misc_feature (503)..(503): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtctttcttggtggcagcagtcacaggacgcccactcccaggtgaaattggtgcagttcttcctttgaggtgaagaagccgtgggctcagtgacggtccctgccaggcttctggatacattcttcaacgcctattatatacactgggtgcgccgaggccccctggaccaaggggcctggagtggatgggatacatccaaccccgacacgtggacgacaacaagtctgacacagtcgtactttcgagggcagactccaccgtcggacccgggatatcgtccagtcaactacccgacctacagtaacgactcgagtacaacctaaatccagaccgacnccggaccttctattactgtgcgagacggngtagtcgttaccgacggtggggataacggcgtaccgaacctccgtatcgtttacg

SEQ ID NO: 110689 - DNA, 794 bp, Homo sapiens
  misc_feature: GYAE6OF02H8UPP.37.35.D02.1.454.CMB.1.raw
  modified_base (197)..(197): a, c, t, g, unknown or other
  misc_feature (197)..(197): n is a, c, g, or t
tcagtagtgtagatcacgaccggtgctcgatttagcacacgatagttgggtttgggggcatcacccagcaaccacatctgtccctctagagaactcccctgagagctccgttcctcaccatggactggacctggaggatcgtcttcttggtggcagcagtcacgaggacgcccactcccgaggtagtaaagttggtnctagttcctttccgtttggaggtagaagtaagccgtcgggacctcgaggtcgaacggtccctgccgtaggtcttcgtggatacgtacttccttacaaccgtaccttaagttactaactactacgtgggtcgccgtccgtaccggcccctacggacgtaacgggtcctggtaggtcggtaggtacggacgttacaacgttaccccgaaccccgtaacgtacgtacggaaccgaccgaaacgtaacgtacgtacgacactagttacgtacctttacggaggtactaacgggtactacccgtacccggtaccggtaacccgggaaccgttacgtacggtaaccgtacgtaaccgtaaaccgtaccgtacctaacgtaacgtaaccgtaactaccggtaacgtaccgtaaaccttaacgttaccgtaaccgtaaccgtccgggtaaaccggttcccgttaacgtttaccgttacgttcggtacgggacgtacgggtacggacgtaacggtaaccggttaccggtaaccggggtaacggttaacgttacgggaccggttaacccgtaacccggttaccgttacgtacggttttttaaccggg

SEQ ID NO: 110690 - DNA, 780 bp, Homo sapiens
  misc_feature: GYAE6OF02HXC69.37.35.D02.1.454.CMB.1.raw
  modified_base (169)..(169): a, c, t, g, unknown or other
  misc_feature (169)..(169): n is a, c, g, or t
tcagtagtgtagatcacgaccggtgctcgatttagcacacgatagttgggtttgggggcatcacccagcaaccacatctgtcctctagagaatcccctgagagctccgttcctcaccatgactggacctggaggatcgtcttcttgggtggcagcagtcaacagggacncccaccgtcccaggtacgaacgtttggtgcagttcttccgtttggaggtgaagacgccgtggggcctcgagtcggaacgtcccctcggccgtaggtccttcgtacggtactactcgtttaccttaccaaccgtccttactttaacgtaaccttacgtaaccgttgggtacgaccggtccccgaccggtcccccgtacggtaaccgtaacggggtacccgtggaacggttagggaactacggggtaccttaacgtaaccgtccccgtaaaacccccggaacttacggtaccggggaaccgaccgttaaaaccgaaacggttccgacggtaaccgtaccgttaggtaccgtttaccttacgggaaccggggttcctaaggtcccggttaccgaacccgttcccggggaaccgtactacgtccggtacaggactaaacccgtcctaaccgtaaaacgttacaacctcgtaagtacctaaactacgtactacgaccgtacgacggtaccctttagtctacgtgacggaacgtcggacgacggtattacccggtagtacgggacggttaacggtaaggtcccggtactaacccggtcgttaggttcttttaccggg

SEQ ID NO: 110691 - DNA, 771 bp, Homo sapiens
  misc_feature: GYAE6OF02FNM4W.37.35.D02.1.454.CMB.1.raw
  modified_base (167)..(167): a, c, t, g, unknown or other
  misc_feature (167)..(167): n is a, c, g, or t
  modified_base (386)..(386): a, c, t, g, unknown or other
  misc_feature (386)..(386): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggagatcgtcttcgttggtggcagcagtcacaggacncccactcccgaggtagaaatttggtcgctacgttctttccgtttaggaggtagaacgtacggccggtcgggcctagaggtacgaaccggtccctcggaccacggtccttcggtacggtaactactacttcttaaccgaccgtaccttaagttacttaacacgtacgttgggtcgaccgaccgtacccgtccccgtaccggaaccggtacgggttaccgngtaacgggtggtacgttaacgggaaccttaaccgtaccgtaaaccccgaaaccccggacctaccggtaccggaccgaaaccgttacgaacttaccgcggtaacacgtagttacgttaaccgttacggaacggtcaacgggtacctacccgtaaccgacccgggaccgtaactcggttacccgacaacgtacgaaaccctcccgtaaccttcgaaactaccgttacacgtaacgaaccgtaaccttaaagcctaacggaccgacgtcccgtaacgtttactaacgttcggtacgagtacgacggacgaggtaacggaacgtttacccggaggtaacggtaacgttacgaccggtaaccgtcccgtacgtaccgtttacgtttacgg

SEQ ID NO: 110692 - DNA, 800 bp, Homo sapiens
  misc_feature: GYAE6OF02FIT8F.37.35.D02.1.454.CMB.1.raw
  modified_base (166)..(166): a, c, t, g, unknown or other
  misc_feature (166)..(166): n is a, c, g, or t
tcagtagtgtagatcacgaccggtgctcgatttagcacacgatagttgggtttgggggcatcacccagcaaccacatctgtcctctagagaatcccctgagagctccgttcctcaccatggactggacctggaggatcgtctcttggtggcagcagtcacaggacnccccactcccaggtgaaacttggtgcagtccttcctttgacggttgaacgaacgtcctcgggggtccttcgacgtcgaacggtccccctggccacggtcctttccgtggtactacgtacttccgttaccgaaccgccttaattacgtaactacctacgtcgggtctccgcctaaccgggtccccctacggaaccgtacgggtacctagacggttacggacgttcgggaacctaacggtactaacccgaaacccccgtaacgaccgttaccgggccgaaccgtaaactaacggtcctaaccggactaaccgaagttcgtaaccgttttaccggaacggggtcctaacggtacgtacccgtacccgtaaccgggaccccgggtaaccgtacgtaccgttaccgaaactacccgtaaccgtaaccccgttacctaacctaacgtaacggaaccctacgacgtacgtacccttaaaacgtaccgtagtaaccgaccgtacccggacccgtttaccgtactttaaccgtcggtaccacggtaggaaccgtccggtaaacgtaaccggtttccgtaaacggtaacgggtaacttaacgggcggaacccggtttccgacccggtagttcggttttaaccgg

SEQ ID NO: 110693 - DNA, 681 bp, Homo sapiens
  misc_feature: GYAE6OF02F8XAW.37.35.D02.1.454.CMB.1.raw
  modified_base (304)..(304): a, c, t, g, unknown or other
  misc_feature (304)..(304): n is a, c, g, or t
  modified_base (372)..(372): a, c, t, g, unknown or other
  misc_feature (372)..(372): n is a, c, g, or t
  modified_base (612)..(612): a, c, t, g, unknown or other
  misc_feature (612)..(612): n is a, c, g, or t
tcagtagtgtagatcacgaccggtgctcgatttagcacacgatagttggggtttgggggcatcacccagcaaccacatctgtcctctagagaatcccctgagagctccgttcctcaccatggactggacctggaggatcgtcttcttggtggcagcagtcacaggagcccactcccaggtgtaaattggtgcagtctttcctttggaggtagaagaacgccgtggggcctcagtcgaacggtcccctgccaggtcttcgtggactactatcgttacaacgccttaattactatacactgggtancgtccacggtcccctacgacgaacgggtcctaggaggtggagtgggactaactataccgaaccccganaccgtaggaccgaaccgaacaaacgtcagtaccaactatcgtactttcggagggctaagtacgtaccacccggtacggacccgggtactacggttcgtactaaccggctaaacgttacccgacctaacgtaactaacgtaacctcctaaagtaccgtaaccttaaacgtccgtaacggaaccgaaccgaaccgggttacccgttacttaacgttacgtcgtacgggacgacggaacggtnaacgggtacgttccgaacgggtaggtaacgtaaggtccgacggaccgtacccggtagttcggtttacgg

SEQ ID NO: 110694 - DNA, 722 bp, Homo sapiens
  misc_feature: GYAE6OF02J1BEA.37.35.D02.1.454.CMB.1.raw
  modified_base (167)..(167): a, c, t, g, unknown or other
  misc_feature (167)..(167): n is a, c, g, or t
  modified_base (226)..(226): a, c, t, g, unknown or other
  misc_feature (226)..(226): n is a, c, g, or t
  modified_base (537)..(537): a, c, t, g, unknown or other
  misc_feature (537)..(537): n is a, c, g, or t
tcagtagtgtagatcacgaccggtgctcgatttagcacacgatagttgggtttgggggcatcacccagcaaccacatctgtcctctagagaatcccctgacgagctccgttcctcaccatggactggacctggaggatcgtcttcgttggtggcagcagtcacaggngccctactcccaggttcgaaagttcgggtgcgacggttcctttccgtttggacgggtanaacggtaacggtccgtggggaccctacaagggttcgaacgggttacccctcgacccgtaggtccgtttaccgtgggtactaaccgtacttccttacaacggttacctaattaactacgttaactcggtaggggttcgaccgtcctaacggccccgtcggaacgtaacgggccgttagagggttacggacgtagggtactaccgtactaccgaacccgtacaccgtcggtacacacgtaacggtctacggctaacgacgtacggttaccttacggacggtacgaagtctaccgtaccgacgtcccggaactntacgctagacctacgtaccgcttaacacgttacgacttacgacgtacgtacctaactctacggacgtacgtacggtacctacttacgttaaccgtgtaggaccgacgggtataccggtaggtaccgttcgtaacggtaggtacggaacgttccggacggttaccgacggtacgtttacttacggg

SEQ ID NO: 110695 - DNA, 529 bp, Homo sapiens
  misc_feature: GYAE6OF01BLQL6.8.10.A10.1.454.CMB.1.raw
  modified_base (448)..(448): a, c, t, g, unknown or other
  misc_feature (448)..(448): n is a, c, g, or t
  modified_base (458)..(458): a, c, t, g, unknown or other
  misc_feature (458)..(458): n is a, c, g, or t
  modified_base (522)..(522): a, c, t, g, unknown or other
  misc_feature (522)..(522): n is a, c, g, or t
tcagctcgcgtgtccacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggcccctggacaagggcttgagtggattggatggatcagcgcttacaatggtaagacatacacaaactatgcacagaagttccagggcagagtctccatgaccatagacacatccgcgaccacagcctatatggagttgacgagcctgagatctgacgacacggccgtgtattactgtgcgagggatgtagtagtgacgtggtacgcgggggaaacttgactactggggccagggatcccgtggtcaccgtctcctcagcctccaccagggcccatcggtcttccccngcaccctccnccaagcgcacctcgtcggggcacagccggccctgggctggcctggtcaacggctacttccgacncgcgacg

SEQ ID NO: 110696 - DNA, 547 bp, Homo sapiens
  misc_feature: GYAE6OF01CRB0O.8.10.A10.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (397)..(397): a, c, t, g, unknown or other
  misc_feature (397)..(397): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaangccaccctctcctgcagggccagtcttagtgttagcaacttagcctggtaccaacagaaacctggaccaggcctcccaggcctcctnatctctgatacagtcccaaacgagggccactggcactcccagcctaggttcagtggcaggtgggtctgggacagtacttcactctcaccatcagcagcctagcgcctagaagtntttgacttagtttattactgtacaactatcgtacgagtcggccgtccggggcctacgtttccggcccgtaggaacctaaagttgagtactacgaaacgtaactgtagcgtgccactactctgtcttctacttccttcccgctctcgtacg

SEQ ID NO: 110697 - DNA, 248 bp, Homo sapiens
  misc_feature: GYAE6OF01EUXAB.8.10.A10.1.454.CMB.1.raw
  modified_base (243)..(248): a, c, t, g, unknown or other
  misc_feature (243)..(248): n is a, c, g, or t
tcagctcgcgtgtccacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccgacacgcgagctgagcgggctggcaaggcgcatagnnnnnn

SEQ ID NO: 110698 - DNA, 492 bp, Homo sapiens
  misc_feature: GYAE6OF01A5LV3.8.10.A10.1.454.CMB.1.raw
  modified_base (484)..(492): a, c, t, g, unknown or other
  misc_feature (484)..(492): n is a, c, g, or t
tcagctcgcgtgtccacgaccggtgctcgatttagcgtcgatctcaggggtccgggagatcatgagggtgtccttgggttttgggggaagaggaagactgacggtccccccaggagttcaggtgcccactcccaggttcagctggtgcagtctggagctgagaagttccagggcagagtctccatgaccatagacacatccgcgaccacagcctatatggagttgacgagcctgagatctgacgacacggccgtgtattactgtgcgagggatgtagtagtgacgtggtacgccggggggaaacttgactactggggccaggggatccctggtcaccgtctcctcagcctccaccaagggcccatcggtcttcccccctggccaccctcctccaagacgcacctctgggggcacagcggccctgggctgcctggtcaaggctacttccgacacgcgagctgagcgggctggcaaggcgcatagnnnnnnnnn

SEQ ID NO: 110699 - DNA, 613 bp, Homo sapiens
  misc_feature: GYAE6OF01DM3ZF.8.10.A10.1.454.CMB.1.raw
  modified_base (202)..(202): a, c, t, g, unknown or other
  misc_feature (202)..(202): n is a, c, g, or t
  modified_base (389)..(389): a, c, t, g, unknown or other
  misc_feature (389)..(389): n is a, c, g, or t
  modified_base (597)..(597): a, c, t, g, unknown or other
  misc_feature (597)..(597): n is a, c, g, or t
tcagctcgcgtgtccacgaccggtgctcgatttagcgtcgatctcggagggggaggaactgctcagttaggacccaggagggaaccatggaagccccagctcagcttctcttcctcctgctactctggctccagataccaccggagtaaatttgtgttgacactagtctccagccaccctgtcttgcctaccgagggaaagngccaccctcgtcctgcgagggccagtcgttagtcgttagctaactttagcctggtaccaaacacgaacctggaccaggcctcccaggccttccgtcatcctctgactaccataccaacgcgggccacgtgggcacgtcccgagcctaggttcaggtcgcaggtggtctaggacaagtacttcactcncacatcgagcacgcctagacgcctagaagtactttgacttaagtttacttactgtacagctagtacgtataacgtcggtcttttcgacgtttccggacccgttggaacctaaggtggtaacttacgtacgaaaacgtacgttggtacggtacgtacggtacctacttagttccttacggtttccttaccgtaactttcccgttacccnccttagtccgtaacgg

SEQ ID NO: 110700 - DNA, 720 bp, Homo sapiens
  misc_feature: GYAE6OF01A6ZI8.8.10.A10.1.454.CMB.1.raw
  modified_base (139)..(139): a, c, t, g, unknown or other
  misc_feature (139)..(139): n is a, c, g, or t
tcagctcgcgtgtccacgaccggtgctcgatttagcgtcgatctcagggggaggaactgctcagttaggtaccgacgagggaaccgactggaagaccccagctcagcttctcttcctcctgctactctggctcccaggntaccaccggaacgaacgttgtagttgactacagtctcagccaccgtgtcctttgccttcgagggaacgaggaccaccctcctaccctgccagggccagtccttacgtgttacgctaacttagccctaggtaccaactacgtaaacctggaccacttcggacctaccgaggacctaccgtcctagtcctacgtcgtacctacgtactccaactcgggtcctacggtcggccgtacctcccgaaggccctaggttcgacgttcggccaggtcggtacgttgggactaggaccttcgacgttctacgacctatcacgccacggtccctagtacgtccttagaacgtacgttttacgactaacgttttacttaacgtacgttactacggtcgtagttaccgtttaagttaaccgttcggtaccctttacggtaccgttttaccgggtacccgttaggggtaacccttaaacggttcggtaactttacggtaccggtaaaccggaccttagggtaccggtacgttacggtaccaacgtacgttcgttcgttacgttcctacgttacccttcccgccttacgttccg

SEQ ID NO: 110701 - DNA, 582 bp, Homo sapiens
  misc_feature: GYAE6OF01BBZJI.8.10.A10.1.454.CMB.1.raw
  modified_base (196)..(196): a, c, t, g, unknown or other
  misc_feature (196)..(196): n is a, c, g, or t
  modified_base (251)..(251): a, c, t, g, unknown or other
  misc_feature (251)..(251): n is a, c, g, or t
  modified_base (366)..(366): a, c, t, g, unknown or other
  misc_feature (366)..(366): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaangccaccctctcctgcagggccagtcttagtgttagcaacttagcctggtaccaanagaaacctggccaggctcccaggctcctcatctctgatacatccaacagggccactggcatcccagccaggttcagtggcagtgggtctgggacagacttcactctcaccatcancagacctagacgcctagtaagtattttcgacttacttttattactgtacagctagtcgttagtaacttggtcccttttacgaccgtttccgggcccttaggggaaccctaaaggttggaattacgtacgaaacgtacttaggtcggtactcgccgtaacctacgttccgtacgttccctttacactttcccgttaccccgcctattcccgtaacgg

SEQ ID NO: 110702 - DNA, 513 bp, Homo sapiens
  misc_feature: GYAE6OF01CTMT1.8.10.A10.1.454.CMB.1.raw
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacaatctccagccaccctgtcttcgtctccaggggaaagagccaccctctcctgcagggccagtcagaatgttggcgcctagtatcctggtaccaacagaaacctggccaggctcccaggcccctnatctatggtncatccaacagggccactggcatcccagccaggttcagtggcagtgggtatgggacagacttcactctcacatcatcagcctgagctgagatgtgcagtttattactgtcaacatcgtaccgagtggccgtccgggggcctacgttcggcccgtcgggaccaaagtaggatatacaaacgaactgtaggctgcaccatctgtcttacatctcccgtcctac

SEQ ID NO: 110703 - DNA, 545 bp, Homo sapiens
  misc_feature: GYAE6OF01B6L25.8.10.A10.1.454.CMB.1.raw
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaanagaaacctggccaggctcccaggctcctcatctctgatacatcccaaacaggggcccactggcactcccagccaggttcagtggcaggtgggtctgggacaggcttcactctcaccatcagcagcctagcgcctgaatattttgctactttattactgtcagctagcgtagtaacgtcggtcctttcactttccggcccttgggaaccctaagtgaattatacaaacgtactggtcggactcgaccaccattctcgttccttactacttcccttaccccgcctcttcgtacgg

SEQ ID NO: 110704 - DNA, 606 bp, Homo sapiens
  misc_feature: GYAE6OF01COSKI.8.10.A10.1.454.CMB.1.raw
  modified_base (351)..(351): a, c, t, g, unknown or other
  misc_feature (351)..(351): n is a, c, g, or t
  modified_base (594)..(594): a, c, t, g, unknown or other
  misc_feature (594)..(594): n is a, c, g, or t
tcagctcgcgtgtccacgaccggtgctcgatttagcgtcgatctcagggtcttcgtggctcacgtccaccaccacgcatgtgacctcaggggtccgggagatcatgagggtgtccttggggttttggggggaagaggaagactgacggtccccccaggagttcaggcccctggacaagggcttgagtggattggatggatcagcgcttacaatggtaagacatacacaaactatgcacagaagttccagggcagagtctccatgaccatagacacatccgcgaccacagcctatatggagttgacgagcctgagatctgacgacgacggccgtgtattactgtgcgagggntgtagtagtgacgtggtacgcgggggtaaatggactacgtggggccagggactcccgtggtcaccgtctcctcgacgcctccgaacccgaacgggacccacgtccggtccttccccccgtggccctacccctccctacccgaacgacgcctaccctcggcggggtccaccgacggcccggccccgtggggtccctcggcccgtcgggtaccaaacgggtacccttacccggttacccggaacncccggtcgacgg

SEQ ID NO: 110705 - DNA, 527 bp, Homo sapiens
  misc_feature: GYAE6OF01DUFL0.8.10.A10.1.454.CMB.1.raw
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacacgggccactggcactcccagccaggttcagtggcaggtggtctgggacagacttcactctcaccatcagcacgctagcgccgtagaagtattttagctacttttattactgtcagcagcgtagtactcggtcctttcgacgtttccggcccgttacgggacctaaaggtgatactacaaacgacgtgtcgctgcacctatctgtctctactctcccgctatcgtacg

SEQ ID NO: 110706 - DNA, 249 bp, Homo sapiens
  misc_feature: GYAE6OF01B1H8F.8.10.A10.1.454.CMB.1.raw
  modified_base (240)..(240): a, c, t, g, unknown or other
  misc_feature (240)..(240): n is a, c, g, or t
  modified_base (243)..(249): a, c, t, g, unknown or other
  misc_feature (243)..(249): n is a, c, g, or t
tcagctcgcgtgtccacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactactccgacacgcgagctgagcgggctggcaaggcgcanagnnnnnnn

SEQ ID NO: 110707 - DNA, 576 bp, Homo sapiens
  misc_feature: GYAE6OF01AOZ4X.8.10.A10.1.454.CMB.1.raw
  modified_base (198)..(198): a, c, t, g, unknown or other
  misc_feature (198)..(198): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaagngccaccctctcctgcagggccagtcttagtgttagctaacttagcctggtaccaacagaaacctggccaggcctcccaggcctcctcatctctgatacatccaacagggccacgtggcactcccagccaggttcagcggcaggtgggtcgtgggtacttcggttcacttctacacctatacaaactaacctgacaatctagtaccgtactttgctagttttatttctgtcagtctagtcgtagaacgtcgtcggtcccgtttctaccgtttcgggaccgggagggtaccggagggtcggacctacgaaacgtacgtgtcggctcgactaccgtcttcgtgttccttctacttcccgttccgctactcgtcgagtaccg

SEQ ID NO: 110708 - DNA, 629 bp, Homo sapiens
  misc_feature: GYAE6OF01D62B6.8.10.A10.1.454.CMB.1.raw
  modified_base (197)..(197): a, c, t, g, unknown or other
  misc_feature (197)..(197): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctcgaggggaaagngcccaccctctcctgcagggccagtcttagtgttagcaacttagcctggtaaccaacagaaacctggccaggctcccaggctcctcatctctgatacactccaacgacggggccacgtcggcactcccgagtcctaggttccaggtcggcgaggtgggtcgtgggacaggtacttcgactctacaccatcagcacgcctagacgtcctagaacgttattttcgacttacttttacttactgtacacgtactacggtcgttaagtaaccgtcggttaccctttacgtaccgtttcccggtacccgtagggtaacccgtaaaggttcgtaacttacgtacgaaaacgtacgtggtacggtcgtacgacccgtacctacttccgttacgttctttacgtacctttccccgttaccccgaccctagtccgtaccgg

SEQ ID NO: 110709 - DNA, 732 bp, Homo sapiens
  misc_feature: GYAE6OF01AXA3Q.8.10.A10.1.454.CMB.1.raw
  modified_base (253)..(253): a, c, t, g, unknown or other
  misc_feature (253)..(253): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaagcgccaccctctcctgcagggccagtcttagtgttagcaacgttagcctaggtaccaanacgaaacctggaccaggcctcccgaggcctcctcactctctgactactactcccgaaacgacgggcccacgtggaccacgtaccccaggcccctaagggtttccaagggttcggaccgtaagggttcgggtccgtacgggaactacgggtaccttccgactcctaccgacctactccgacgtacacgtacccgtaacgggcgtaccgtaagtaaggtttacgttttacggtactttaacctttattaaccgttcgtacgacgtacgaggtaccgtaacggttaaccgtcgggttccctttacgttaccgtttccggtacccgttacgggaaccttaaacgggtacggtaactaacgttaaccgaaaccggttaacgtcgttacggtaccgtaggtacccgtaccttaacggttctttaccggttacctttaccgttaacccgtttccgttaacccccgcccttagttccgttaaccggg

SEQ ID NO: 110710 - DNA, 799 bp, Homo sapiens
  misc_feature: GYAE6OF01CLFRG.8.10.A10.1.454.CMB.1.raw
tcagctcgcgtgtccacgaccggtgctcgatttagcgtcgatctcaggggggaggaactgctcagttaggacccagagggaaccatggaagcccagctcagcttctcttcctcctgctactctggcctcccagactaccaccggagaaattgtgttgacacagtctccacgcccacccttgttctttcgcctaccgaagggggaaacgacgccaccctctcctgcgacggctacgtcttagttgtagactacttacgccgtacggtaaccaacaacgaaaccgtcggacccgacggtccctaccccgacgggccttaccgtacctacgttcctaccggtagtaaaccttaaccgaacctaacccgaaacggaccggggtacccaacggttccggaccaaccgttcccgaacggtccgtaacgggttcacgggtcggtacggtaacgggtcgggggtaccgtagggtaaccaacggttaccttacacccgtttaccaccctaaccacgttaccacggacctaacggtacccgtaaggacccgttaccggtaacggttaaacgttacgtttacgttaactttaacttttaacttacgtacgttaacaacgttcgtaaccggtaccggtacggtcccgggtacccggtccgggtaccctaacggttcccggaacctaacgggtaaaccctaaagtacgtaactaaccgaaccgaacgtacgtacgtcggacgtaccggacctacgtacttcggttcttacccgttctaacccgtttccctacccgtactcgtcgtaaccggg

SEQ ID NO: 110711 - DNA, 898 bp, Homo sapiens
  misc_feature: GYAE6OF01CS8VA.8.10.A10.1.454.CMB.1.raw
tcagctcgcgtgtccacgaccggtgctcgatttagcgtcgatctcagggtcttcgtggctcacgtccaccaccacgcatgtgacctcaggggtccgggagatcatgagggtgtccttggggttttggggggaagaggaagactgacggtcccccaggagttcaggcccctggacaagggcttgagtggattggatggatcagcgtcttacaatggtaagacatacaacaaacgtatgcacagaagttccagggcagagtcctccatcgaaccataagacacaactccgaccgaaccacacgtacctatacgtaggaggttgacgacgcctgaacgtatctaggaccgacgaccgggtacccgttagttaactttaacgtggttacggacgggaaggggtattaggttaagggtaaggtttcgggaacggggtttacggggttaacccgggaccggggggggttaaaacgtttcgggtaaaccgtttaccgggggtacgggggtcccggtaaacgggggtaccttacccccgggtacgggttaaccccgtaccccggtttccgttaccccgttaccgtaccggtacccccttaaccccggaaccggtaaacccggggtccccttaacggttcccccggtttaccccggtttccccccgtacgggtacccccctaacccccgtttaccctacccggtaaacccggtaccgtaccccttaacccgggtcccggggttaccgggggaacccgtaacccggacccgggtaccccggggttccccgggttaccggggaccccgtttaccgggtccccgggttacccgggttaaccgggaaaccgggttaccccgtttaccccggtaacccgggtaccccggacccggacccgggtaacccgggg

SEQ ID NO: 110712 - DNA, 779 bp, Homo sapiens
  misc_feature: GYAE6OF01BANHC.8.10.A10.1.454.CMB.1.raw
tcagctcgcgtgtccacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggcccctggacaagggcttgagtggattggatggatcagcgcttacaatggtaagacatacacaaactatgcacagaagttccagggcagagtctccatgaccatagacacatccgcgaccacagcctatatggagttgacgagcctgagatcgtagacgacacggtccgtagtattacgtggtacgcggaaggggtatggttaagtaggtacggtacggtcggggtaccgggaccggggggtaaaacttggaaccgttacgggtcgggggtaccgaacggggaccgtttccccgtgggtaccctaaccccggttccgttaccctaccgtacgcccccttacccgaacccggtaacgggcccctacggttcccggttaccccttccccccggtaggccccctaccccccgttacccgtaccccgtaaaccggaccgtaccctaccccggttaccggggtcgggggaccctaacccggtaccgggtccccggggttacccccggtcgggggtacccttaccggggtacccccgttcgggggttaaacccgaaaccggggttacccctttacccggtttaacccccggaaccggttaccccgggacggtaaccccggg

SEQ ID NO: 110713 - DNA, 792 bp, Homo sapiens
  misc_feature: GYAE6OF01AUXF8.8.10.A10.1.454.CMB.1.raw
  modified_base (197)..(197): a, c, t, g, unknown or other
  misc_feature (197)..(197): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagactaccaccggagaaattgtgttgacacagtctccagcccacctgtcttcgcctcgaggggaacncgccaccctctcctgccgacgggcctagttccttaggttcgttagacctaaacgttacggccctagggtaacccaaacgtaacggtaaacctggggaccctaagggtcccttacccgaggtccttcccgtacacttcctgtacggaacttaccgaacttacccgaaaacggtacggggacccctacgtaccgggcctaaaccgttccccgaagggccccgttaagggtttccgaacgggttcgggaccgtaaggggttccggggtacttacgggggaacctaacggtaccctttccgaaccgtttcctaccgaaaccctgtaccgaacggtcaacgggtccctaaggacgtccgtaaggtaacgttacgtttcgtaacctttaacgttttacgtaccgttcgtacgtaccgtacgtacggtaccgttaacgttaccgttcggttacctttaccgttacgttacccggtacccggtagggtaaacccgtaaggttcggtaaattaccgaacggtaaaccgttacgtcgggtacgtccgtacgtcctacgtacttcgtacgttctaccgtacttcccttaacccgcttgtcgtaacg

SEQ ID NO: 110714 - DNA, 771 bp, Homo sapiens
  misc_feature: GYAE6OF01EGOUX.8.10.A10.1.454.CMB.1.raw
  modified_base (218)..(218): a, c, t, g, unknown or other
  misc_feature (218)..(218): n is a, c, g, or t
  modified_base (754)..(754): a, c, t, g, unknown or other
  misc_feature (754)..(754): n is a, c, g, or t
tcagctcgcgtgtccacgaccggtgctcgatttagcgtcgatctcagggggaggaactgctcagttgggacccagagggaaccatggaagccccagctcagcttctcttcctcctgctactctggctccagataccaccggagaatttgtgttcgaccacgtagtcctaccacgccctacccgtgttcctttacgcccgtaccggaagggggaaaacncggtccctacccttcgttcccgtggaccgaaccggggtaccaggttccgtttaaggttcggttaacggtacctaaaacgtttacggacccttggaaccaaacgtacgtaaaaccgtggaccaacggtcctacccgaggtcctcctacattcctactgtaacactactaccaacgccgggtacaacgtggaccacgttcccagccgttaacgttcgacgtggacgtacggtcgggtactagggtactagtccttacacttctaacgacctagttcccaagggtccagtacccgtaagtacgtacgtacgtaagttacgtttcggtacctttaacgtttaactacgttaagccgtactaaccgtagtaacgtacgttaaacgttcgtttacccgttagttaccgttacgggtacccgtaacggtaacgtaaacgttacgacgttaacgttaacgaaacggtaaccgtgggtttaccgacgttacgtcgttaacccgtattcccgttacgtaccgtttcaacccgttccgttaccccgngtttaccgccgggtaac

SEQ ID NO: 110715 - DNA, 854 bp, Homo sapiens
  misc_feature: GYAE6OF01DCWWI.8.10.A10.1.454.CMB.1.raw
tcagctcgcgtgtccacgaccggtgctcgatttagcgtcgatctcagggtcttcgtggctcacgtccaccaccacgcatgtgacctcaggggtccgggagatcatgagggtgtccgttggggtttggggggaagaggaagacgtgaccggtccccccaggagttcacggccctggacaagggcttgaggtggattggatgggatcagcgtactacaatggtaacgacatacaacaaactatagcaacaagaagtccgaggacagagtctacgatacgaaccagtaacgacaactacgtaccgaccggtaaccacacgtacctatagtacggtagttacgaacgtacgaccgtagaagacgttcacggacgaaccggtacgggtcgttaagttaactaagttgggacgacggggtaaggtagttaggtaaggtacggtacgggtaacggttacgggggtaaacccggggtaacggggggttaaacgttacggtaacggttaaccgggtccggggggtaacccggtaacggggtacccgttaccccgggttacggaccccggttaacccggttacccgttcccggtaacccgaccggttacccccgtaacccggtaaaccggaaaccccgggtcccgtaaccggtttccccggttaccccgtttaccccccggaccggtaccccgtaacccccgtcccgttaaccccgaaggtacccgtaccgtacccgggtcgggaacccgggacgaacccggtacgggcccggttcccgggaccgggtaccgttcggccccggttagggaacccttaaccggggtaccttacccgtaacccgggacttacccggcggtaaccgg

SEQ ID NO: 110716 - DNA, 681 bp, Homo sapiens
  misc_feature: GYAE6OF01EJGBQ.8.10.A10.1.454.CMB.1.raw
  modified_base (660)..(660): a, c, t, g, unknown or other
  misc_feature (660)..(660): n is a, c, g, or t
  modified_base (662)..(662): a, c, t, g, unknown or other
  misc_feature (662)..(662): n is a, c, g, or t
  modified_base (666)..(666): a, c, t, g, unknown or other
  misc_feature (666)..(666): n is a, c, g, or t
  modified_base (668)..(669): a, c, t, g, unknown or other
  misc_feature (668)..(669): n is a, c, g, or t
  modified_base (671)..(673): a, c, t, g, unknown or other
  misc_feature (671)..(673): n is a, c, g, or t
  modified_base (675)..(679): a, c, t, g, unknown or other
  misc_feature (675)..(679): n is a, c, g, or t
  modified_base (681)..(681): a, c, t, g, unknown or other
  misc_feature (681)..(681): n is a, c, g, or t
tcagctcgcgtgtccacgaccggtgctcgatttagcgtcgatctcaggggtccgggagatcatgagggtgtccttgggttttggggggaagaggaagactgaccggtccccccaggagttcaggtgcccactcccaggttcagctggtgcagtctggagctgagaagttccagggcagagtctccatgaccatagacacatccgacgaccacagcctatagtggagttgacgagcctgagtactctaggaccgaccgacggtccgttagttacttacgtgtgcggagggtatggtagtaggtgacggtcgggtaccgggaccggggggtaaactttggacgttacggtcgggggaccgagggtactcccgtcggtccacccgttctccgtcacgccctccgaaccgaaccgggccctacgttcccggttcccttcccccgtcggcccctacccccgttcctacccgaaacggtccgacccgtacccgttcggggtaccgggggacctaccggacgggtccccggtccccggttgggtccttccggccggttacgggtaacccgtaaacgggtacccttacccgttacccggaccgtaccggacggacgtcgtacgggaccgggcgggtccgtgggaccgtaacgggccgacgaagtggcngngagntnngnnncnnnnngn

SEQ ID NO: 110717 - DNA, 701 bp, Homo sapiens
  misc_feature: GYAE6OF01AQ1I5.8.10.A10.1.454.CMB.1.raw
  modified_base (402)..(402): a, c, t, g, unknown or other
  misc_feature (402)..(402): n is a, c, g, or t
  modified_base (677)..(677): a, c, t, g, unknown or other
  misc_feature (677)..(677): n is a, c, g, or t
  modified_base (686)..(686): a, c, t, g, unknown or other
  misc_feature (686)..(686): n is a, c, g, or t
  modified_base (688)..(689): a, c, t, g, unknown or other
  misc_feature (688)..(689): n is a, c, g, or t
  modified_base (691)..(692): a, c, t, g, unknown or other
  misc_feature (691)..(692): n is a, c, g, or t
  modified_base (694)..(694): a, c, t, g, unknown or other
  misc_feature (694)..(694): n is a, c, g, or t
  modified_base (696)..(697): a, c, t, g, unknown or other
  misc_feature (696)..(697): n is a, c, g, or t
  modified_base (699)..(699): a, c, t, g, unknown or other
  misc_feature (699)..(699): n is a, c, g, or t
  modified_base (701)..(701): a, c, t, g, unknown or other
  misc_feature (701)..(701): n is a, c, g, or t
tcagctcgcgtgtccacgaccggtgctcgatttagcgtcgatctcaggggtccgggagatcatgagggtgttccgttggggttttggggggaagaggaagactgacggtccccccaggagttcaggtgcccactccaggttcagctggtgcagtctggagctgaaggtaagttccaggggcaggacgttctcccagtgaccatacgacacactccgccgaccacagcctagtagtggattggaccgagcctgagtatcgtcgaccggacgacgggaccgttgtaacttacgtcggtggcggaggtaggtgtaacggtaggttaggagggtacgggtaccgggtaccggggggtaactttaggaccgttacggtcgggacggtagggtacctcccgtgtcccncggttccctcctccgactccgtccaaccgacggtcctaacgtcccggttaccctttacccccgcggtaccctacccccgtacccgtacctaacggtaccgcccgtaacccggtccggttacgggggacctacccgaccggacccggtcccggtcggcgtccgcggtacgtacgaacgtaccttacccgtccgaccgcggtacgaccgtgtccggacgggtccgggtcggttacccggacgggtaccggtcccgaagtaccgtaggcctacgtcgngccgtgacncnngnnananngngn

SEQ ID NO: 110718 - DNA, 831 bp, Homo sapiens
  misc_feature: GYAE6OF01AUEOV.8.10.A10.1.454.CMB.1.raw
  modified_base (198)..(198): a, c, t, g, unknown or other
  misc_feature (198)..(198): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttcgcctccgaggggaaanacgccaccctctcctgccagggccagtcttagtcgttagcctaacttacgccgttggtaacccaaacgacggaaaacctcggggcccaagggtccctccccgaagggtcccttccctaccgaacttctaccgtgtaactaacgacttacccaaacggtcggggtacccacgttgggaaccctagtacccccgtacggaaccccttagggtttaccaacgggtgggtaccgtaacggggttcggggtacccttagggggaacctaaacgttcccgttaccgtaaccgtccttacccgaaccgtaacgtcccaacggtacgtaccgtaccctaaggaccgtcgttaacggtaacgttacgttttccaacgtttaccgttttaaacgttacgtacggttaaccacggtaacgtacggaccggtttaagttaaccgttccgggttacctttcggttacccgtttccggtacccgggttaccgggtaacggttaaacggttacggtaacgttaacgtaaccggtaaagttaccgttagggtacccgtacggtaacccgtaccgtaccgtaactttccgtccgtttaacccttacgttaacccgttcccttaccccgtaccttcgttaaccgtaaccgg

SEQ ID NO: 110719 - DNA, 384 bp, Homo sapiens
  misc_feature: GYAE6OF02GPF8K.8.10.A10.1.454.CMB.1.raw
  modified_base (382)..(384): a, c, t, g, unknown or other
  misc_feature (382)..(384): n is a, c, g, or t
tcagctcgcgtgtccacgaccggtgctcgatttagcgtcgatctcagggtcgtcaactccatataggctgtggtcgcagagtctccatgaccatagacacatccgcgaccacagcctatatggagttgacgagcctgagatctgacgacacggccgtgtattactgtgcgagggatgtagtagtgacgtggtacgccgggggaaacttgactactggggccagggatccctggtcaccgtctcctcagcctccaccaagggcccatcggtcttccccctggcaccctcctccaagagcacctctgggggcacagcggccctgggctgcctggtcaaggctacttccgacacgcgagctgagcgggctggcaaggcgcatagnnn

SEQ ID NO: 110720 - DNA, 256 bp, Homo sapiens
  misc_feature: GYAE6OF02I2KSR.8.10.A10.1.454.CMB.1.raw
  modified_base (241)..(256): a, c, t, g, unknown or other
  misc_feature (241)..(256): n is a, c, g, or t
tcagctcgcgtgtccacgaccggtgctcgatttagcgtcgatctcagggtcttcgtggctcacgtccaccaccacgcatgtgacctcagggtccgggagatcatgagggtgtccttgggtttgggggaagaggaagactgacggtcccccaggagttcaggtgctggcacagcggccctgggctgcctggtcaaggactacttccgacacgcgagctgagcgggctggcaaggcgcatagnnnnnnnnnnnnnnnn

SEQ ID NO: 110721 - DNA, 489 bp, Homo sapiens
  misc_feature: GYAE6OF02JCDJU.8.10.A10.1.454.CMB.1.raw
  modified_base (480)..(489): a, c, t, g, unknown or other
  misc_feature (480)..(489): n is a, c, g, or t
tcagctcgcgtgtccacgaccggtgctcgatttagcgtcgatctcaggggtccgggagatcatgagggtgtccttgggttttgggggaagaggaagactgacggtcccccaggagttcaggtgcccactcccaggttcagctggtgcagtctggagctgagaagttccagggcagagtctccatgaccatagacacatccgcgaccacagcctatatggagttgacgagcctgagatctgacgacacggccgtgtattactgtgcgagggatgtagtagtgacgtggtacgccggggggaaacttggactacgtggggccagggatccctggtcaccgtctcctcagcctccaccaagggcccatcggtcttcccctggcaccctcctccaagacgcacctctggggcacagcggccctgggctgcctggtcaaggactacttccgacacgcgagctgagcgggctggcaggcgcatagnnnnnnnnnn

SEQ ID NO: 110722 - DNA, 563 bp, Homo sapiens
  misc_feature: GYAE6OF02JTTIR.8.10.A10.1.454.CMB.1.raw
tcagctcgcgtgtccacgaccggtgctcgatttagcgtcgatctcagggtcttcgtggctcacgtccaccaccacgcatgtgacctcaggggtccgggagatcatgagggtgtccttgggtttgggggaagaggaagactgacggtccccccaggagttcaggcccctggacaagggcttgagtggattggatggatcagcgcttacaatggtaagacatacacaaaactatgcacagaagttccagggcagagtctccatgaccatagacacatccgcgaccacagcctatatggagttgacgagcctgagatctgacgacacggccgtgtattactgtgcgaggatgtagtagtgacgtggtacgcggggggaaacttggactacgtggggccagggatcccgtggtcaccgtctcctcacgcctccaccacgggcccagtccggtcctcccccgtggccaccctcccgtccaacgacgccacctcgtcggggccacgacgccggcccgtgggcctggcccgtggtccgacggtacctaccgttccgactaccgcgtacgg

SEQ ID NO: 110723 - DNA, 250 bp, Homo sapiens
  misc_feature: GYAE6OF02JCVGW.8.10.A10.1.454.CMB.1.raw
  modified_base (240)..(250): a, c, t, g, unknown or other
  misc_feature (240)..(250): n is a, c, g, or t
tcagctcgcgtgtccacgaccggtgctcgatttagcgtcgatctcagggtcttcgtggctcacgtccaccaccacgcatgtgacctcagggtccggagatcatgaggtgtccttgggtttgggggaagaggaagacgtgacggtcccccaggagttcaggtgctgggcacagcggccctgggctgcctggtcaaggactacttccgacacgcgagctgagcggctggcaaggcgcatagnnnnnnnnnnn

SEQ ID NO: 110724 - DNA, 500 bp, Homo sapiens
  misc_feature: GYAE6OF02GSQBT.8.10.A10.1.454.CMB.1.raw
  modified_base (486)..(500): a, c, t, g, unknown or other
  misc_feature (486)..(500): n is a, c, g, or t
tcagctcgcgtgtccacgaccggtgctcgatttagcgtcgatctcaggggtccgggagatcatgagggtgtccttgggttttgggggaagaggaagactgacggtcccccaggagttcaggtgcccactcccaggttcagctggtgcagtctggagctgagaagttccagggcagagtctccatgaccatagacacatccgcgaccacagcctatatggagttgacgagcctgagatctgacgacacggccgtgtattactgtgcgagggatgtagtagtgacgtggtacgccggggggaaacttgactactggggccagggatccctggtcaccgtctcctcagcctccaccaagggcccatcggtctttcccctggcaccctcctccaagacgcacctctcgggggcacgacgcggccctgggctggcctggtcaaggactacttccgacacgcgagctgagcgggctggcaaggcgcagtagnnnnnnnnnnnnnnn

SEQ ID NO: 110725 - DNA, 534 bp, Homo sapiens
  misc_feature: GYAE6OF02GCTIZ.8.10.A10.1.454.CMB.1.raw
  modified_base (196)..(196): a, c, t, g, unknown or other
  misc_feature (196)..(196): n is a, c, g, or t
  modified_base (524)..(524): a, c, t, g, unknown or other
  misc_feature (524)..(524): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggccaggctcccaggctcctcatctctgatacatcccaaacgacgggccacgtggccaactccccagcccagggttcaggtggcaggtgggtctgggacagacttcactctcaccatcagcagcctagacgcctagaagtattttgcttaatttattactgtcagcagtcgtagtacgtgtcctttcacgtttccggccttgggacctaaggtgaatatacaaacgactggtcgctggcactatcttgtcttcacttcctcccncctatctacg

SEQ ID NO: 110726 - DNA, 599 bp, Homo sapiens
  misc_feature: GYAE6OF02F4X6K.8.10.A10.1.454.CMB.1.raw
  modified_base (213)..(213): a, c, t, g, unknown or other
  misc_feature (213)..(213): n is a, c, g, or t
  modified_base (299)..(299): a, c, t, g, unknown or other
  misc_feature (299)..(299): n is a, c, g, or t
tcagctcgcgtgtccacgaccggtgctcgatttagcgtcgatctctaggggggtagggaactgctccaacgttaggacccagagggaaccatggaagccccagcgtccagcttctcttcctcctggctactctggctcccagactaccaccggagaaattcgtgttgacacagtctccagccaccctcgtctttgccctccgaggggtaaacngccaccctctcctgcagggccagtcagatgtgcgcctacgtactccgtggtaccacagaacctggccaggctaccaggtacccctnatctatggtacgacagtccaacgccggaccactggcactcccagcctaggttccaggtcgactaggtgggtacgtcgggacagacttcactgtcacagtcatcagcctagtacgtctagacgtactacgtgacgtagttacgtactcgtactacgtactacgtaccgagtacggtccgtccgggtacctacgttccggaccgtaggaacctaagtcgtactacgtaccgtaaacgtacgtcggtacggactacgacaacgtactacgtacgttacttacgtactccgttacccgacctac

SEQ ID NO: 110727 - DNA, 500 bp, Homo sapiens
  misc_feature: GYAE6OF02GDS43.8.10.A10.1.454.CMB.1.raw
  modified_base (491)..(491): a, c, t, g, unknown or other
  misc_feature (491)..(491): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttgcctggtaccaacagaaacctggccaggctcccaggctcctcatctctgatacatccaacagggccactggcatcccagccaggttcagtggcagtgggtctgggacaggacttcactctcacatcagcagcctagagcctgaagattttgctactttattactgtcagcagcgttagtactggcctttcactttcggcctgggaccaagtgatatcgaaacactgtggctggcacatctgtcttcatctccnctatctacg

SEQ ID NO: 110728 - DNA, 551 bp, Homo sapiens
  misc_feature: GYAE6OF02GYASZ.8.10.A10.1.454.CMB.1.raw
  modified_base (197)..(197): a, c, t, g, unknown or other
  misc_feature (197)..(197): n is a, c, g, or t
tcagctcgcgtgtccacgaccggtgctcgatttagcgtcgatctcagggggaggaactgctcagttaggacccagagggaaccatggaagccccagctcagcttctcttacctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggcccaggcctcccaggcctcctcgatctcctgatacactccaacgacgggccctagtcggccactccccagccgtaggttcagtcggcaggttgggtctgggacaggacttcgactctcaccatcagcagcctagacgtcctagaacgtattttcgcttactttattactgtcagcagtcgtagtaactggtcctttcactttccggcctggaccaagtgatatacaaacgtactgtgtctgcacctactcgttacgttcttctacgttccttccccgctactctacgg

SEQ ID NO: 110729 - DNA, 534 bp, Homo sapiens
  misc_feature: GYAE6OF02HKDKX.8.10.A10.1.454.CMB.1.raw
  modified_base (478)..(478): a, c, t, g, unknown or other
  misc_feature (478)..(478): n is a, c, g, or t
  modified_base (500)..(500): a, c, t, g, unknown or other
  misc_feature (500)..(500): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggcctcctcatctctgatacatccaacacgggccacgtggcactccccagccaggttcagtggcaggtgggtctgggacagacttcactctcacatcagcagcctagagcctagaagtattttgacttactttattacttgtacagcagtcgttagtaactggtcctttctacgtttcggcccgtagggacctaaggtgacttanacaaacgactgtgtctgcactntctgttcttctacttccgttcccgctactgaacg

SEQ ID NO: 110730 - DNA, 567 bp, Homo sapiens
  misc_feature: GYAE6OF02FXYAR.8.10.A10.1.454.CMB.1.raw
tcagctcgcgtgtccacgaccggtgctcgatttagcgtcgatctcagggtcttcgtggctcacgtccaccaccacgcatgtgacctcaggggtccaggagatcatgagggtgtccttgggttttgggggaagaggaagactgacggtccccccaggagttcaggcccctggacaagggcttgagtggattggatggtatcagcgcttacaatggtaagacatacacaaactatgcacagaagttccagggcagagtctccatgaccatagacacatccgcgaccacagcctatatggagttgacgagcctgagatctgacgacacggccgtgtattactgtgcgagggatgtagtagtgacgtggtacgccggggggaaacttgactacgtggggccagggatccctggtcaccgtctcctcagcctccaccaacgggcccatccggtcttccccctggccaccctcctccaacgcgccacctcgtggggccacgacgccggccctggggcctcggcccgttggtccgaacgggtaccttaaccgttcccggacgtaccggtaccgg

SEQ ID NO: 110731 - DNA, 601 bp, Homo sapiens
  misc_feature: GYAE6OF02IFIV6.8.10.A10.1.454.CMB.1.raw
  modified_base (194)..(194): a, c, t, g, unknown or other
  misc_feature (194)..(194): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtcttgcctccaggggaanagccaccctctcctgcagggccagtcttagtgttagcaacttagcctaggtaccaacagaacctggccaggctcccaggctcctcatctctgactacactccaacgagggccctacgtggaccactccccagcccaggttccaggttcggctaggtcgggtctagggaccaggacttcaccttctcgaccatcacgcaacgcctagacgtccgtagaagtattttcgacttactttattactgtcagctagcgtagtactggtaccttctacgtttccggcccgtacgggaacctaaggtacgtatacgtaacgaaccgtaacttggtacggtcttacggacctaccgtaagttccgttaacgttccttacgacttaccctttccccggaccttcgtaccgttacgg

SEQ ID NO: 110732 - DNA, 512 bp, Homo sapiens
  misc_feature: GYAE6OF02FGV4U.8.10.A10.1.454.CMB.1.raw
  modified_base (196)..(196): a, c, t, g, unknown or other
  misc_feature (196)..(196): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtccttagtgttagcaacttagcctggtaccaacagaaacctggccaggctcccaggctcctcatctctgatacatccaacagggccactggcatccagccaggttcagtgcagtgggtctgggacagacttcactctcaccatcagcagcctagagcctagaagtattttgactactttattactgtcagtcagcgtagtactggtcctttcactttccggccttgggacctaaagtcggatatcaaacgactgtagctgcacatctgtctcatccttccgcctatctacgg

SEQ ID NO: 110733 - DNA, 599 bp, Homo sapiens
  misc_feature: GYAE6OF02GJ1BL.8.10.A10.1.454.CMB.1.raw
  modified_base (196)..(196): a, c, t, g, unknown or other
  misc_feature (196)..(196): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaangccaccctctcctgcagggccagtcttagtgttagctaacttagcctggtaaccaacacgaaacctggccaggcctcccgaggcctcctcactctctgactacatacccaaacgacgggccacgtcggccactccccagccctaggttccaggtcggcgtaggtcgggtcgtgggacacgtacttcactcctacaccatcagtccacgtccctaagcgcctaggaagttattttgacttacttttattactgtctagcgtagtcgttaagtacgtcgtcctttctaccgtttccggaccgttacgggaaccgtaaaggtcgtaacttactaacgaaacgtacgtgtcgctacgcctaacgtcgtcttcgtcttacgtacttcccgttcccacgtactcgtacg

SEQ ID NO: 110734 - DNA, 704 bp, Homo sapiens
  misc_feature: GYAE6OF02F8IPY.8.10.A10.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaaanagccaccctctcctgcagggccagtcagaatgttaggcgacctacgtactcctacggtaccaacagaaaccctggaccaggcctcccacggcccctnactctatggtncactccaacgcgggccagtcggcactcccagccgaggttcaggtcggctagggtcggtagtgggaactaggtaccttcgaaccttctaccgtaacctagttaccaacgttcacggtccgtacgggacgtcccgtaggtaacggtagttacggttcggacttacggttttaacttaaccttacggtactaaaccgttcgttacccggtacgggtaacggttcggtaccccggggttacccggggtacccgtttaccggttttacccggggcccgtttaaacggggtacccgtaaaacgggttcggtaaacttaccgaccgttaaaaccggtaacttcggtaggaccttacggaccaccgttagttccgttcgtaccgtttacctcgtttaccccg

SEQ ID NO: 110735 - DNA, 250 bp, Homo sapiens
  misc_feature: GYAE6OF02HN5ML.8.10.A10.1.454.CMB.1.raw
  modified_base (244)..(250): a, c, t, g, unknown or other
  misc_feature (244)..(250): n is a, c, g, or t
tcagctcgcgtgtccacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccgacacgcgagctgagcgggctggcaaggcgcatagnnnnnnn

SEQ ID NO: 110736 - DNA, 797 bp, Homo sapiens
  misc_feature: GYAE6OF02IXP6F.8.10.A10.1.454.CMB.1.raw
  modified_base (197)..(197): a, c, t, g, unknown or other
  misc_feature (197)..(197): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaagngccaccctctcctgcagggccagttcttagtgttagactaacgttacgccgttacggtaacccaaacgaacgaaaccctcgggacccaacgggccttaccccgaaggtccttacccgtcacttcctcgtagaactacacttacccaacggacggggaccctacgtcgggaccactccccgaacggtccctagggttccaagggttcgggacgtagggttcggggtccgtcggggaactacggtacctttccgtaacctttcccgtacctaaacccgtacttacccgaacggtacccgtaaccggtacccgttaaagggaacccggtacccggttaaggtaaacggtttacgtttttacggtaacctttaccggtttttaaactttaccggttacgtaccgtacggtacgtacggtacggttaacgttaaaccgttcggttaccctttaccgttaccggtttcccggtacccggttacgggtaaccgtaaggtacgtaacttaacgtaaccgtaaacgtacgtaggtacggtcgtacgacctaccgtacttcgttacgttaccttacctacgtttcccgtacccgtacttacgtcgtaacg

SEQ ID NO: 110737 - DNA, 578 bp, Homo sapiens
  misc_feature: GYAE6OF02JL7HM.8.10.A10.1.454.CMB.1.raw
  modified_base (163)..(163): a, c, t, g, unknown or other
  misc_feature (163)..(163): n is a, c, g, or t
  modified_base (198)..(198): a, c, t, g, unknown or other
  misc_feature (198)..(198): n is a, c, g, or t
  modified_base (308)..(308): a, c, t, g, unknown or other
  misc_feature (308)..(308): n is a, c, g, or t
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
tcagctcgcgtgtccacgaccggtgctcgatttagcgtcgatctcagggggaggaacgtgctcagttaggacccagagggaaccatggaagccccagctcagcttctcttcctcctgctactctggctcccagactaccaccggagaaattgtgttagacacngtctccagccacctgtcttgcctcgaggggaaacncgccaccctctcctgcgaggccagttcttagtgttagcaacttcgcctggtaacccaagaacgtaaacctggcccaggccttcccgacggctccctcatctctgactacnctccaagacggccacgtgcatcccagccagtccagtcgcagtcggtcacggganacgctcactcacacntacagcagtcctaggacncagaagtnttcgctactttntcgtagtctacgtancgtacttacgtacttcggtacctttctacgttccggcccttacgggaaccgtaaggtacggtactaacgtaccgtaaacgtaactcgtagtactcgtaccactactcgttacgttattactactcccgttcccgtacctcgtacgtcg

SEQ ID NO: 110738 - DNA, 764 bp, Homo sapiens
  misc_feature: GYAE6OF02F8OLF.8.10.A10.1.454.CMB.1.raw
  modified_base (198)..(198): a, c, t, g, unknown or other
  misc_feature (198)..(198): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaagngccaccctctcctgcagggccagtcttagtgttagctaacttagcctaggtaccaagacgaaaacctggccaaggtcctacccaggctcctcatcctctgatacactaccaaactcgggacctacgtcggaccacgtaccccacgtccgtaacggttcgaacggttggacgtaagggtcgggggtccgttacggggaaaccgtacggttaaccgttccgtaaaccttccttaccgaaaccctacgttcgaacgaccgtaacgacccgtttacggacgtacccgttaacggtaaacggtttaacgtttttcggtaacctttaacgtttttaaaccgttttacgttacgttactacggtaaccgttaggtaccgtttaaacgttaccggtacggtttcccttttaccgttaccggtttacccggcccggttaaccgggaaccgtaaaggttccggtaaagttaccgtaaacgtaaaaccggtacttacggtggaccgtacgtaacccaaccttacgttccgttaggttccttacgtaccttccgttacccgccttacttcgtaaccgg

SEQ ID NO: 110739 - DNA, 916 bp, Homo sapiens
  misc_feature: GYAE6OF02IFJWL.8.10.A10.1.454.CMB.1.raw
  modified_base (138)..(138): a, c, t, g, unknown or other
  misc_feature (138)..(138): n is a, c, g, or t
  modified_base (186)..(186): a, c, t, g, unknown or other
  misc_feature (186)..(186): n is a, c, g, or t
tcagctcgcgtgtccacgaccggtgctcgatttagcgtcgatctcgagggggagaactgctcagttaggaccagagggaaccatggaagccccagctcaacttctcttctcctgctctctgctccagataccacgganaattgtgttgacacagtctccagccacctgtcttgcctcgaggggaancgccacctctctgcgaggcctagttcttagtgttacgactaacttagcttacggaaccaacgacgtaaaccgtcggaccacgggtacctacccgtagggtacccttcctaccaacttccctacgttagaaacttacctaacgttaccccgaaacggtccgggtacccctacggtacggtacctaaccgttccccgacggtacccgttacggggttacctaagggtcgggtaccgtaagggttcggggttacgaccggggaatttacccggaacctttcccgtaaaccgttcccgtaaacgtaacccgtaatccggaaactacccgtaacggtacccgttaagggaacccgttccggtttaaacggttaacgtttaaacggtttttaccggttaacctttaaacgtttttaacgttttaaccggtacgttaccggtaaacggttaccgtaacggtttaaccggttaaaccggtttaaaccgtttacccggttttaacccgttttacccgttaaccggttttacccgggttaccccggttaaccggggtaaaccggtaaacgggttaaccgttaacgttaaccgttaaaccgtaaaacggttaccgttaggtaccgttacggtaaccggtaacctaacggttaaccgttccgtttacccgtttaccgtttaacccgttcccgttaacccgttttaccccggaccgttttaacgttccggtaccggtaaccgg

SEQ ID NO: 110740 - DNA, 625 bp, Homo sapiens
  misc_feature: GYAE6OF02IXZDT.8.10.A10.1.454.CMB.1.raw
  modified_base (235)..(235): a, c, t, g, unknown or other
  misc_feature (235)..(235): n is a, c, g, or t
tcagctcgcgtgtccacgaccggtgctcgatttagcgtcgatctcagggtcttcgtggctcacgtccaccaccacgcatgtgacctcaggggtccgggagatcatgagggtgtccgttggggttttggggggaagaggaagactgacggtccccccaggagttcaggcccctggacaagggcttgagtggattggatggatcagcgcttacaatggtaagacatacacaaactancgcaacagaattccgagggcagacgtctcatcgacatagacacatccgcgaccacacgaccttatacgtaggtagttagacggagtcctagacgatcgtagaccgacgacggcgtagtattacgtgtcgcggaggtactaggtagtaggtgtacggtagggtacggaccgggggtaattcggacgtacgtcggggaccgtagggtacccgtaggtccgtaccgtcctccgtccgacgtccctacccgaccgtaacgggccctaacgtcccggtcccttccccgcggtcccgcccgtcgccgtaccgacggaccaccgaccgtcggacgacgtaccacgacggtcggtccgtggctcgtcgtgtaccgagtacctaccgtcgacgacgtcg

SEQ ID NO: 110741 - DNA, 574 bp, Homo sapiens
  misc_feature: GYAE6OF02FH8BW.8.10.A10.1.454.CMB.1.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (293)..(293): a, c, t, g, unknown or other
  misc_feature (293)..(293): n is a, c, g, or t
  modified_base (316)..(316): a, c, t, g, unknown or other
  misc_feature (316)..(316): n is a, c, g, or t
  modified_base (396)..(396): a, c, t, g, unknown or other
  misc_feature (396)..(396): n is a, c, g, or t
  modified_base (517)..(517): a, c, t, g, unknown or other
  misc_feature (517)..(517): n is a, c, g, or t
  modified_base (532)..(532): a, c, t, g, unknown or other
  misc_feature (532)..(532): n is a, c, g, or t
  modified_base (568)..(568): a, c, t, g, unknown or other
  misc_feature (568)..(568): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagactaccaccggagaaaacttgtgttagacacagtctccagccaccctgtcttagcctccaggggaaancgccaccctcncctgcagggccagtccttagtgttacgcacttagccttggtacccaacacgaaacctggaccaggcctacccagtacctccncactcttggccgacctttaacgnggccagtcggaactccagcctaaggttcagcgcagtggtctgggactcgttcactctcacactcaacaacctgctaatcngaccgactttgcttagtttactctcacacgcagttctagacgcgtcggttcccttgtaccgtttcggacgggtacggaccgaaggtcgtacctacgaaacgacgtagtcgctacggcaccngttctcgtccttacnctccctcccactactcgtcgaacgtccacggtacgngtaccg

SEQ ID NO: 110742 - DNA, 890 bp, Homo sapiens
  misc_feature: GYAE6OF02HJPYT.8.10.A10.1.454.CMB.1.raw
  modified_base (324)..(324): a, c, t, g, unknown or other
  misc_feature (324)..(324): n is a, c, g, or t
tcagctcgcgtgtccacgaccggtgctcgatttagcgtcgatctcagggtcttcgtggctcacgtccaccaccacgcatgtgacctcaggggtccgggagatcatggagggtgtccttggggttttggggggaagaggaagactggaccggtcccccaggagttcacggccctggacaagggcttgagtggattggatggatcagcgcttaacaagtggtaacgacaatacaacaaactagtgcaacgagtaacgttccgaagggcagtacgtctcatacgacatacgaacacgtacgtaccgacgaccacacgtaccttaagngttaagggtaggttacggaacggagccgtaggacgtacgtcggtacgaccgacgtccgggtaccgttagttacttacgtggtacggcggaagggtacttagggtagttacggagggttacgggtcgggtaacccgggggtacggggggtaaacttacggtaaccggttaccgggtacgggggccggtaaacgggttccgttaccccgggttcgggttacccctaacccgggttcccgtaacccggttaccgtaccccggtaaccccgttaccccgggtaaacccgggaaccgggttcccccggtaaacggtttcccccgggtttacccttacccccgggttaccggaccccttaacccccgttacccggttaaccggaacggacccgttacccgtaacccgggttcccggtaccgggggaccctcccggtacgggtacccccggggttcccggggtacgggtccccggtttaccgggacggtttaacccgggttaacgggtaacccggtttaccccggtttaacccggttaaccccggtaccggtaaccccgggttggtaacccgg

SEQ ID NO: 110743 - DNA, 624 bp, Homo sapiens
  misc_feature: GYAE6OF02JJDFJ.8.10.A10.1.454.CMB.1.raw
  modified_base (165)..(165): a, c, t, g, unknown or other
  misc_feature (165)..(165): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
  modified_base (362)..(362): a, c, t, g, unknown or other
  misc_feature (362)..(362): n is a, c, g, or t
  modified_base (408)..(408): a, c, t, g, unknown or other
  misc_feature (408)..(408): n is a, c, g, or t
  modified_base (460)..(460): a, c, t, g, unknown or other
  misc_feature (460)..(460): n is a, c, g, or t
tcagctcgcgtgtccacgaccggtgctcgatttagcgtcgatctcgagggggaggaactgctcagttaggacccagagggaaccatggaacgccccagctcagcttctcttcctcctgctacctctggtcctcccagactaccgaccggagtaattgtgtgacangtctcagccacctgtcttgcctacgagggaancgccnccctctccgngacgacgggcctagtcttacgtgtacgactacgttagccctaggtaccaagacgaacgtcggccacggcctaccgaggcctaccnctntcctacgtgactacnccgtaccacggacgcccgagtacgcaccgtcccgcgtaccgtagtcngtacgcgtaggtggtacggtgactaggtcctagctcgtcaatgacngaccgatctaagcgtacgtacgtaagtctttacgatttacgttatcgttacngtacgacgagttacgtaagtcctagttcccttactacggttccctaccggtcgggtaacctaggtacgaaagttccgaaacgtaagtaccgtgtacgtcggtactccggtacgtacgttcgtacgtaccttcgttcgaccccgtttccacgttctcccggtaac

SEQ ID NO: 110744 - DNA, 977 bp, Homo sapiens
  misc_feature: GYAE6OF02JZPWF.8.10.A10.1.454.CMB.1.raw
tcagctcgcgtgtccacgaccggtgctcgatttagcgtcgatctcagggtcttcgtggctcacgtccaccaccacgcatgtgacctcaggggtcccgggagatcatgagggtgttccttggggttttggggggaagagggaagactgaccggtccccccaggacgttcgacggcccctgggacgaaggggcttggaggtggagttggatggatcgagccgcttacgaataggtaacgacatacaacaaactatgacacaggaacgttcccgaaggggccaaggtcgtacgtaccaagtcgaaccaatacgacacacgtccgaccgaccagacgcctatagtaggagttcgacgtacgtcctggacgtactcggtacgaaccggtaaccgaccgggtaccgttagttaacgtttaccgttcggggtacggtacggtaacggggtatttcggggtaaacggttggtacggtaacgggttcggggtaacccggggttacccgggggggtaaaactttcggaaaccggttacccggggttagggggtacccggtaacggggtacccgtttacccccgggttacggggtacccgttaccccggttaccgttaccccggtacgttacccggtacccccgttacccggtaaacccggtaacccggggtacccccgttaaaccgggtttcccccgggtttcccctttacccccccgggtacgggttaacccccttaacccccccggttacccgttaaccccgggttaaaccggtaccccggtaacccgttaacccccgggttacccggggttaccgggggaaccccgttaaccgggacccgggttacccgggtaccccccgggttcggggttaccccgttcccgggtaaccccgggttttaaccgggtacccggttaacccggggtttaccctttaaacccggttacccccggggaacccgttaccggggtacccggtaacccgg

SEQ ID NO: 110745 - DNA, 869 bp, Homo sapiens
  misc_feature: GYAE6OF02H0A9I.8.10.A10.1.454.CMB.1.raw
  modified_base (287)..(287): a, c, t, g, unknown or other
  misc_feature (287)..(287): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttcgcctccgaaggggaagacgccaccctctcctgcagggccagtcttagtgttagcaactcgacctaggtaccaacagaaacctggaccaggcctccaggctcctanagtatctagactacatacccaacgacgggccctaacgtggactacgtaccccgaacggccgtaaggttaccgagggttacggacgtaagggttcggggttccttacggggacgactacctttacgacctttaccgtcaaacccgatttaccgaacgacccaacgggtaccctaaggtaccggtacccgttaacggtaacggttaacgttttttacgggacctttaaaccggtttttaaactttaacccggttaggttacccgtaaacgggtaaccttaacggggttaacccggtttaaacggtttaaacccgggtttacggtttaccccgtttttaaccgttaacccgttttttaccccggggtaacccccggtttaacggggtaaccccgtaaaagggtttccggtaaacgtttaaccgaaaccgttaaaaaaccggtaccgttaacgggttacgggtacccgttaacggcccgttaaaccgttaacgttaacccggtttacgtttaccccgtttaacccgttaaccggtttcccccgtttaaccccccgggtaacccttaccgtttaccggtaaaccggg

SEQ ID NO: 110746 - DNA, 751 bp, Homo sapiens
  misc_feature: GYAE6OF02ILXOO.8.10.A10.1.454.CMB.1.raw
  modified_base (167)..(167): a, c, t, g, unknown or other
  misc_feature (167)..(167): n is a, c, g, or t
  modified_base (223)..(223): a, c, t, g, unknown or other
  misc_feature (223)..(223): n is a, c, g, or t
  modified_base (707)..(707): a, c, t, g, unknown or other
  misc_feature (707)..(707): n is a, c, g, or t
  modified_base (746)..(746): a, c, t, g, unknown or other
  misc_feature (746)..(746): n is a, c, g, or t
tcagctcgcgtgtccacgaccggtgctcgatttagcgtcgatctcagggtcttcgtggctcacgtccaccaccacgcatgtgacctcagggggtccgggagatcatggagggtgttccgtttgggggttttggggggaagaggaagactggaccggtccccccaggngttcgacggccctggacgaagggcttggagtggattggatggatcgagcgtcttanaatggtaagacatacaacaaactatgcaacgagaacgttccggagggcagacgttctaccatcgaaccataacggaacactactaccgaccgaaccactacgaccttaataggtaggtagttacggacgtacggccgtaggagtacgtcgtaggaccggaccgaccggtccgttacgttattacgtaggtcggacgggtaggggtacttagggttacggttagggtacggtacggggttacgggggtaacccggggtaaccggggggttaaaccttcggggtacggtacgggtcgggggaccgaacggggtacttcccggtcggtccgacccggttcgtacctaccgcgtaccctacccggaacgacccggtccgtaccgttccggttcccgtccccgtcggaccccttacccgtacccgtaccgtaacgaccgtccgtccggtaccgggcgggacctacggccgtccggcccgtcgggtaccncggtcgtcgtaacgacgtaccttaccgaccgacgaccgngtacg

SEQ ID NO: 110747 - DNA, 800 bp, Homo sapiens
  misc_feature: GYAE6OF02GKUYS.8.10.A10.1.454.CMB.1.raw
tcagctcgcgtgtccacgaccggtgctcgatttagcgtcgatctcagggggaggaactgctcagttaggacccagagggaaccatggaagccccagctcagcttctcttcctcctgctactctggctccagataccaccggagaaattgtgttgacacagtctccagccaccctgtcttttgcctccgaggggaaaagagccaccctctcctgcagggccagtcttagtgttagcaacttagcctggtaccaacagaaacctggaccaggcctacccaggcctcctcatcctcttgactacactaccaaacgtacgggaccctaaccgtagggaccaacgttaccccgaagtccccgaaacgggttacgacgggtaggggtacctaagggttcggggtacgttacggggaacctaagtaacccgtttaccaaccgtttaccttacaaacctacgttacgaactcggaacgtacctaacgggtacgtaccgtaaggttaaacggtatttttacggacttaaccgtttttaactttacggtacgttaccgtaggacgttaacggtaccgtttaaggttaaccgttacggttacccttttaaccgttaaccgttttacccggggttacccggttacggggaaacccttaaagggtacggttaaacgttaacttaaccggtaaaaaacgacgttaacggtagggttaccgttacgaacccgttactaaccgtttaccgttacgtttacccgttacctttaacggttaccccgtttaccccgacccgtttacgtcgttaaccggg

SEQ ID NO: 110748 - DNA, 295 bp, Homo sapiens
  misc_feature: GYAE6OF01EZAX9.13.52.E08.1.454.CMB.1.raw
  modified_base (287)..(295): a, c, t, g, unknown or other
  misc_feature (287)..(295): n is a, c, g, or t
tcagtcacgtactacacgaccggtgctcgatttagtcgagctctcagagaggaaagggcgcaccctgtgtccatggtaccaggtgctttgtctactacctctactacctggacgtcctggggcagagggaccacggtcaccgtctcgtcagcctccaccaagggcccatcggtcttcccctggcgccctgctccaggagcacctccgagagcacagcggccctgggctgcctggtcaaaggactacttcctagtacgtgactgagcgggctggcaaaggcgcatagnnnnnnnnn

SEQ ID NO: 110749 - DNA, 317 bp, Homo sapiens
  misc_feature: GYAE6OF01C9FTA.13.52.E08.1.454.CMB.1.raw
  modified_base (281)..(281): a, c, t, g, unknown or other
  misc_feature (281)..(281): n is a, c, g, or t
  modified_base (303)..(317): a, c, t, g, unknown or other
  misc_feature (303)..(317): n is a, c, g, or t
tcagtcacgtactacacgaccggtgctcgatttagtcgagctctcagagagaaagggcgcacccctgtgtccatggtaccaggtgctttgtcctactacctctactacctggacgtctggggcagagggaccacgggtcaccgtctcgtcagcctcccaccaacgggcccgtacttcggtccttccccctcggtaggtccctcgctccaggagcacctccgagagcacagcggcccgtcggctcgccgtggtacaaggactacctcctagtacgtgactgngcggctggacaggacgcatagnnnnnnnnnnnnnnn

SEQ ID NO: 110750 - DNA, 288 bp, Homo sapiens
  misc_feature: GYAE6OF02GVALA.13.52.E08.1.454.CMB.1.raw
  modified_base (284)..(288): a, c, t, g, unknown or other
  misc_feature (284)..(288): n is a, c, g, or t
tcagtcacgtactacacgaccggtgctcgatttagtcgagctctcagagagaaagggcgcacccctgtgtccatggtaccaggtgctttgtctactacctctactacctggacgtctggggcagagggaccacggtcaccgtctcgtcagcctccaccaagggcccatcggtcttcccctggcgccctgctccaggagcacctccgagagcacagcggccctgggctgcctggtcaaggactacttcctagtacgtgactgagcgggctggcaaggcgcatagnnnnn

SEQ ID NO: 110751 - DNA, 290 bp, Homo sapiens
  misc_feature: GYAE6OF02FMMDI.13.52.E08.1.454.CMB.1.raw
  modified_base (284)..(290): a, c, t, g, unknown or other
  misc_feature (284)..(290): n is a, c, g, or t
tcagtcacgtactacacgaccggtgctcgatttagtcgagctctcagagagaaagggcgcacccctgtgtccatggtaccaggtgctttgtctactacctctactacctggacgtctggggcagagggaccacggtcaccgtctcgtcagcctccaccaagggcccatcggtcttccccctggcgccctgctccaggagcacctccgagagcacagcggcctgggctgcctggtcaaggactacttcctagtacgtgactgagcgggctggcaaggcgcatagnnnnnnn

SEQ ID NO: 110752 - DNA, 400 bp, Homo sapiens
  misc_feature: GYAE6OF01C55RV.12.12.B01.1.454.CMB.1.raw
  modified_base (397)..(400): a, c, t, g, unknown or other
  misc_feature (397)..(400): n is a, c, g, or t
tcagatacgacgtacacgaccggtgctcgatttagtagtgtagatttggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactacgtggggcctgggactctggtcaccgtctcctcagcctccaccaagggcccatcggtctcccctggcgccctgcctccaggacgcacctccgagagcacagcggccctgggctgcctggtcaaggactacttcctacgtcgtatctgagcggctggcaaggcgcatagnnnn

SEQ ID NO: 110753 - DNA, 524 bp, Homo sapiens
  misc_feature: GYAE6OF01DY9XW.12.12.B01.1.454.CMB.1.raw
tcagatacgacgtacacgaccggtgctcgatttagtagtgtagattccgcgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagctgcattgccaataaaatctccttattggtaccagcagaagtcaggccaggccctgtattggtcatctatgaggacaacagacgacctttccgggatcccctgagagattctctggctccacctcaggacaatggccacttgactatcagtggcgcccaggtggaggatgaggctgactactatttgttattcaacagacagcaactaacaagtactagttgggtgttcgggcggagggaccaagctgaccgtcctacgtcacgcccaaaggcctcgccccctcggtccacctctcgttcccccg

SEQ ID NO: 110754 - DNA, 401 bp, Homo sapiens
  misc_feature: GYAE6OF01BT9AV.12.12.B01.1.454.CMB.1.raw
  modified_base (311)..(311): a, c, t, g, unknown or other
  misc_feature (311)..(311): n is a, c, g, or t
  modified_base (398)..(401): a, c, t, g, unknown or other
  misc_feature (398)..(401): n is a, c, g, or t
tcagatacgacgtacacgaccggtgctcgatttagtagtgtagatttggatggggtggatcaacgtacagactggtggcacagactatgcacaggggctccagggcagactcaccatgaccacagaaacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaagggcccatcggtcttccccctggcgccctgctccaggngcacctccgagagcacagccggccctggctgcctggtcaaggactacttcctacgtcgtatctgagcgggctggcaaggcgcatagnnnn

SEQ ID NO: 110755 - DNA, 418 bp, Homo sapiens
  misc_feature: GYAE6OF01CAZE0.12.12.B01.1.454.CMB.1.raw
  modified_base (323)..(323): a, c, t, g, unknown or other
  misc_feature (323)..(323): n is a, c, g, or t
  modified_base (409)..(418): a, c, t, g, unknown or other
  misc_feature (409)..(418): n is a, c, g, or t
tcagatacgacgtacacgaccggtgctcgatttagtagtgtagatttggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctggggaactcgtggtccaccgtctcctcagccctccaccgaagggccccatcggtccttcccccgtggccgccctgcctccaggacncacctccgagagcacagcggcctgggctgcctggcaaggctacttcctacgtcgtatctggagcgggtctggcaaggcgcagtagnnnnnnnnnn

SEQ ID NO: 110756 - DNA, 567 bp, Homo sapiens
  misc_feature: GYAE6OF01BCRHP.12.12.B01.1.454.CMB.1.raw
tcagatacgacgtacacgaccggtgctcgatttagtagtgtagattccgcgggggtgggctcaggaggcagagctctgggaatctcaccatggcctggacccctctcctgctcccctcctcactttctgcacagtctctgaggcctcctatgagctgacacagccaccctggtgtcagtcgtccccaggacaaacggccaggatcacctgctctggagctgcattgaccaaataaaactctaccttattggtaccagcagaagtcaggccacggccctgtattggtcatctatgaggacaacagacgaccttccgggactcccgtgagagtattctctcggctccactcgaggacaatcggaccaccgttgactatcgagtcggcgcccgagggtggaggagtggaggctagactatattgttatacgaactagacagcaactactaagtctaggttcgggttggttcgggacgggacgggaaccgaaggtcgtacggtacccgtccgtacgtacgacggcccgaacggcctcccgcccctacggtcctactccgtccgttcccccg

SEQ ID NO: 110757 - DNA, 407 bp, Homo sapiens
  misc_feature: GYAE6OF01A74BJ.12.12.B01.1.454.CMB.1.raw
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
  modified_base (397)..(407): a, c, t, g, unknown or other
  misc_feature (397)..(407): n is a, c, g, or t
tcagatacgacgtacacgaccggtgctcgatttagtagtgtagatttggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaagggcccatcggtcttccccctggcgccctgctccaggancacctccgagngcacagcggccctgggctgcctggtcaaggctacttcctacgtcgtatctgagcggctggcgaaggcgcatagnnnnnnnnnnn

SEQ ID NO: 110758 - DNA, 467 bp, Homo sapiens
  misc_feature: GYAE6OF01A0U6R.12.12.B01.1.454.CMB.1.raw
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
  modified_base (332)..(332): a, c, t, g, unknown or other
  misc_feature (332)..(332): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (431)..(433): a, c, t, g, unknown or other
  misc_feature (431)..(433): n is a, c, g, or t
  modified_base (435)..(467): a, c, t, g, unknown or other
  misc_feature (435)..(467): n is a, c, g, or t
tcagatacgacgtacacgaccggtgctcgatttagtagtgtagatttggatgggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcttgactactggggcctgggactcgtggtcaccgtctcctcagcctccaccaagggccccatccggtcttccccctggccnccctgctccaggcnccacctccgagcgccacncgccggccctggggctgccgtggtccaaggactacttcctacgtcgtactcgtacgaggccgggctagggcgaagggtccgacgtaagtaggnagncgnnngnnnnnnnnnnnnnnnnnnnnnnnnnnnnnnnnn

SEQ ID NO: 110759 - DNA, 806 bp, Homo sapiens
  misc_feature: GYAE6OF01A0FWF.12.12.B01.1.454.CMB.1.raw
tcagatacgacgtacacgaccggtgctcgatttagtagtgtagattccgcgggggtgggctcaggaggcagagctctgggaatctcaccatggcctggacccctctcctgctccccctcctcactttctgcacagtctctgaggcctcctatgagctgacacagcccaccctggtgtcagtcgtccccaggacaaacggccaggatcacctgctctggagctgcattgacctaaataaaactcctacctttattcggtaccagtcagaagtcaggccacggccctgtattggtcatctatgagacaacagaccgtaccgttccgggactcccgtgagtagtactttcgtctcggtcctaccctaccgtacgaagggaacctaaacgtcgggtacccctaaccgttcgaaaccgttacgtaccgtacgggttccgggacccggtaccccggtaggggttacgggagggtacgttagggacggtactacgggtaacctttacgttacgttttaggttttaacttaaccgaaaccgtacgaaaccgtacgacccgtaaaccgttaaaccgtaacgtttaccggttaacggggttttcgggggttacgggtttacccggggggtaaccggggtaaccggggaaacccgtaagggtcccgttaaccggaccccggttttaaccccgttaaccgggttaccccgaacccgggtaccccggaaaccggggttccccggttacccccggtacccccccggtttacgggtaccccttaccccgtttccccgtttccccgtttaacccccccccgg

SEQ ID NO: 110760 - DNA, 661 bp, Homo sapiens
  misc_feature: GYAE6OF02FW3RF.12.12.B01.1.454.CMB.1.raw
  modified_base (560)..(560): a, c, t, g, unknown or other
  misc_feature (560)..(560): n is a, c, g, or t
  modified_base (570)..(570): a, c, t, g, unknown or other
  misc_feature (570)..(570): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (583)..(583): a, c, t, g, unknown or other
  misc_feature (583)..(583): n is a, c, g, or t
  modified_base (589)..(589): a, c, t, g, unknown or other
  misc_feature (589)..(589): n is a, c, g, or t
tcagatacgacgtacacgaccggtgctcgattttagtagtgtagatttggtagttgggggtaaggactcgaacggtaaacaaccgactggtgggacaccagactaatgtcacctaggggctccgaaggggtcaccgaacctcaccgactggaccacagacacctattccaggaccgtaacctacgacgttacaacgattgggaaggtttggcgggagtccctgacgatcgtggaccgaccgcggccgtactatttaccttgtgcgtagaccgtaggtaggcgctcgtcctttgactacgtgggccttgggactcgtggtcgaccgtctcctcacgtccttccaacctaacgggccccacgttccgggttacccgtttccccccgtagggaccccgccccgttcgacctccccgacgggacgccaacccgtcccgacgagtccaacgacgaccggaccctggggcctcgtccgttccggggtccaagggaccttacgtttcccttaccgttcgtagttcctcgacgtccgggtacgtacggacacggtccgccgatacggncgcggcagcncgngntgagtgangtatcnctctcttcgtgtgtggtgtcgtcgtgttggtgtcggcggtacgacgtacgtacgtacgtcgtcgtacgcgcg

SEQ ID NO: 110761 - DNA, 652 bp, Homo sapiens
  misc_feature: GYAE6OF02I89S5.12.12.B01.1.454.CMB.1.raw
  modified_base (634)..(634): a, c, t, g, unknown or other
  misc_feature (634)..(634): n is a, c, g, or t
tcagatacgacgtacacgaccggtgctcgatttagtagtgtagattccgcgggggtgggctcaggaggcagagctctgggaatctcaccatggcctggacccctctcctgctcccctcctcactttctgcacagtctctgaggcctcctatgagctgacacagccaccctcggtgtcagtcgtccccaggacaacggccaggatcactgctctggagctgcattcgccaataaaatctacttattggtacctagcaagagtcaggccacgggcccctggtaatttgggtactactctacgtggaggacaacacggacgtaccgttccgggactaccctgagaggtattcctctacggctccacctcgaacgggacaagtccggtacctaccgttagaaccttactcgtaacgtcgggaccgacccgtagggttgggaaggtaatggggaacggcgtcgtaacgtatacgtttaggttattccgaaatacgactacgaccaacttacgaaacgttccgttagtttacgggttcgggttaccgggtacgggaacggggtaacctaacgggtccgttacggaccgtttacccgtcgttaccgacgtaccgacggtacgtccgcccggttacggtacnccgttcgttccgtacccc

SEQ ID NO: 110762 - DNA, 531 bp, Homo sapiens
  misc_feature: GYAE6OF02JSYA9.12.12.B01.1.454.CMB.1.raw
  modified_base (293)..(293): a, c, t, g, unknown or other
  misc_feature (293)..(293): n is a, c, g, or t
  modified_base (315)..(315): a, c, t, g, unknown or other
  misc_feature (315)..(315): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (465)..(465): a, c, t, g, unknown or other
  misc_feature (465)..(465): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
tcagatacgacgtacacgaccggtgctcgatttagtagtgtagatttggatggggtggatcaacgtacagactggtggcacagactatgcacagggctccagggcagactcaccatgaccacagacacatcagacgaacacagtcaacagtggagttgccggagcctgcgatctgacgacgcggccttatattacgtgacgcgagagtacgtagcggctcgtccttgactcgtgggctggaactctggtcacgtctctcagcctacaccgaggccagtcggtaccttccccgnggccgccctgcctacgaggacncaccgtccgagacgctacgcgtccggcctgggacctgaccgttggacgaacggtctaacgttccgtaacgtccgtatcgtagacggcggtctacggacgaacggtccagtacgtaacgncgtnaagncgacncagactcgtagcttagcngacgnttcgangtagcngcgcgcgtcgcgacgacgtacgacgacgcgtacgtcgcgtcgtacgtcg

SEQ ID NO: 110763 - DNA, 688 bp, Homo sapiens
  misc_feature: GYAE6OF02FR26F.12.12.B01.1.454.CMB.1.raw
  modified_base (130)..(130): a, c, t, g, unknown or other
  misc_feature (130)..(130): n is a, c, g, or t
  modified_base (174)..(174): a, c, t, g, unknown or other
  misc_feature (174)..(174): n is a, c, g, or t
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (254)..(254): a, c, t, g, unknown or other
  misc_feature (254)..(254): n is a, c, g, or t
  modified_base (302)..(302): a, c, t, g, unknown or other
  misc_feature (302)..(302): n is a, c, g, or t
tcagatacgacgtacacgaccggtgctcgatttagtagtgtagattccgcgggggtgggctcaggaggcagagctctgggaatctcaccatgcctggacccctctcctgcctccccctctctacgtttcngcacagtctctgagcctctatgagctgacacagtccacctggtntcagtcgtcccagacaacgcagntcactgctcgnggacnctgctagtcactaaataatccttcgttaagttcgactaganaacgagttcgacggccacggtccctagttacttcggactatcgtaagnggaacgaacctaacgtacgaaccggtaccgttacgggactccgtaggaagtacgtattcacggtcgacctaccacgtcgtaacgggactacgcggtccctaacgttacgacgtactcggacggtccgggaccgaccggtaagggtcggtaaaggttcgtacggtacggtacgttacgttaaacgtttacgttaaggtttacgtttaacgtaaccgtaagtaccgtaaacgactaacggtaactaacggtaacgttcgtaggtttccggtacgggttcgaaccgggtacgtaacgtcgtccgtacggtacccgtcgtaacggacctacggtacccgtaggtaccctcccggtcccttaccggtacctcgttcccgttacgtcccccg

SEQ ID NO: 110764 - DNA, 492 bp, Homo sapiens
  misc_feature: GYAE6OF01EVW5L.26.23.C01.1.454.CMB.1.raw
  modified_base (486)..(486): a, c, t, g, unknown or other
  misc_feature (486)..(486): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtccatcaaggttcagtggcgcggatctgggacagaattcactctcaccatcagcgggctccagtctgaggactctgcaacttattactgaccaacaatatgaattatttattctcagtcgttcggcaggggaccaagggtgaagtcaagcgaactgtggctgcacntctgtc

SEQ ID NO: 110765 - DNA, 492 bp, Homo sapiens
  misc_feature: GYAE6OF01EDH5C.26.23.C01.1.454.CMB.1.raw
  modified_base (477)..(477): a, c, t, g, unknown or other
  misc_feature (477)..(477): n is a, c, g, or t
  modified_base (489)..(489): a, c, t, g, unknown or other
  misc_feature (489)..(489): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtccatcaaggttcagtggcgccggatctgggacagaattcactctcaccatcagcgggctccagtctgaggactctgcaacttattactgccaacaatatgatatttattctccagcgttcggccaggggaccaagggtggaagtcaagcgaactgnggctgcacatcngtc

SEQ ID NO: 110766 - DNA, 214 bp, Homo sapiens
  misc_feature: GYAE6OF01DX1AX.26.23.C01.1.454.CMB.1.raw
  modified_base (214)..(214): a, c, t, g, unknown or other
  misc_feature (214)..(214): n is a, c, g, or t
tcagagactatactcacgaccggtgctcgatttagtacacgtgattagggattggggagtcagacccagtcaggacacagcatggacatgagggtccccgctcagctcctgggctcctgctgctctggctcccaggaactgtggctgcaccatctgtcttcatcttcccgccatctgaagtatagtctctgagcgggctggcaaggcgcatagn

SEQ ID NO: 110767 - DNA, 541 bp, Homo sapiens
  misc_feature: GYAE6OF01DFWEL.26.23.C01.1.454.CMB.1.raw
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaataccctaagactcctaatctctacgaggtcgtcgtggtttaggaagtcggggtaccagtcgaaggttcaggtcggcgcggatcgtagggacagattcgactctacacatcaggcggctccgagtctgagctcngactaacttattacncgacctaacaatatntaattattntttcactaggtccgttacggaccgaggggtacccgaagggtgaaacggtcgaaggcgtaacgtgtacggctacgaccactattcgtcgttaccg

SEQ ID NO: 110768 - DNA, 486 bp, Homo sapiens
  misc_feature: GYAE6OF01CV6V9.26.23.C01.1.454.CMB.1.raw
  modified_base (402)..(402): a, c, t, g, unknown or other
  misc_feature (402)..(402): n is a, c, g, or t
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
tcagagactatactcacgaccggtgctcgatttagtacacgtgattagggattgggggagtcagacccagtcaggacacaacatggacatgagggtccccgctcagctcctggggctcctgctgctctggctcccaggtgtcaaatgtgacatccagatgacccagtctccttccaggctgtctgcatctgtcggagacagagtcaccatcacttgccggccagtcagagtattggtaggtggttggcctggtatcagcagaaaccaggaacaatccctaagatcctaatctctcaggcgtctggtttgaaagtgggtccatcaaggttcagtggcgcggatctgggacagaatcactctcacatcagcggctccagtctgaggactctgcaacttattacngaccaacatatgaatatttacttctcagtcgttcgcgagggacaaggtgagtcgaagngaactggngctgcacatctgtcttac

SEQ ID NO: 110769 - DNA, 558 bp, Homo sapiens
  misc_feature: GYAE6OF01CUEUU.26.23.C01.1.454.CMB.1.raw
  modified_base (229)..(229): a, c, t, g, unknown or other
  misc_feature (229)..(229): n is a, c, g, or t
  modified_base (410)..(410): a, c, t, g, unknown or other
  misc_feature (410)..(410): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccggccagtcagngtatggtaggtggttggcctggtatcagcagaaaccaggaacaatccctaagatcctaatctctcaggcgtctggtttggaagtggggtccatcaaggttcagtggcgcggatcgtgggacagatcactctcacatcagcggctcagtctgagactctgctaacttatactcgaccctaanaattatagaatttattttacttcctccaggtccgtttcgggacccgtaagggggaaccctaaggggtaggaaacggttccgaaaggaccggtaaacgttcgggtacgggtcttacggacctaacccgtaagttcccgttggtttaccc

SEQ ID NO: 110770 - DNA, 494 bp, Homo sapiens
  misc_feature: GYAE6OF01DUO05.26.23.C01.1.454.CMB.1.raw
  modified_base (391)..(391): a, c, t, g, unknown or other
  misc_feature (391)..(391): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtccatcaaggttcagtggcgcggatcgtgggacagattcactctcaccatcagcggctcagtctgagactntgctaacttatactgaccaataatatgattatttattctcagtcgttcggcctaggggaccaagggtggaagtcaaggcgaactggtggctgcacatctgtcc

SEQ ID NO: 110771 - DNA, 583 bp, Homo sapiens
  misc_feature: GYAE6OF01EBSAQ.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggtggcctggtatcagcaagaaaccaggaacaactccctaaagactacctaaatctctcgaggtcgtcgttagggtttagggaaagttcggggtacccagtacgaaaggtttcgaggtcgggacgccggtatcgtagggacaaggtaacttcactctacaccatcaggcggctcgagtctagacggactctgactaactttatactgacctaactaatatagtaattatttacttctaccgtagtccgttcggaccgtaacggggaacctaagggtaggaaacgtcgaaaggaccggtaaacgtgggtagaccgtacgacctaccagttccgtcggttacc

SEQ ID NO: 110772 - DNA, 543 bp, Homo sapiens
  misc_feature: GYAE6OF01B8GLT.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggtcgtctggtttggaaagtgggtcccatcaaggttcagtggcgccgatcgtgggacagacttcactctcacatcagcggctcagtctgacggtactctagctaacttactactcgacccaataactatgtaattatttacttctaccagtcgttacggccgaggggtaccaagggtaggaaacgttcgaaaggccgtaaacgttggtagggaccttacggacctaacctacttcgttcgttaccc

SEQ ID NO: 110773 - DNA, 576 bp, Homo sapiens
  misc_feature: GYAE6OF01DRLO2.26.23.C01.1.454.CMB.1.raw
  modified_base (196)..(196): a, c, t, g, unknown or other
  misc_feature (196)..(196): n is a, c, g, or t
  modified_base (384)..(384): a, c, t, g, unknown or other
  misc_feature (384)..(384): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttcaggctgtctgcatctgtcgganacagagtcaccatcacttgccggccagtcagagtagttggtaggtggttggcctggtatcagcaagaaaccaggaacaactccctaagactacctaatctctcgaggtcgtcgtgggtttaggaaaggtcggggtcccatacgaaggttcaggtcggcgcggatcgtagggacagattcactctcacntcgagcggctcgagtcgtgaggactgtacgactaacttacttactcgaccaaactaatatagtaatttagtttactttcctaccgtacgtccgttcgggaccgaacggggtaccgaagggttaggaacgtacggaaaggtacggtaacgtcggtacggacgttcgaccctaacccgtattcgttggttaccc

SEQ ID NO: 110774 - DNA, 500 bp, Homo sapiens
  misc_feature: GYAE6OF01B940Q.26.23.C01.1.454.CMB.1.raw
  modified_base (418)..(418): a, c, t, g, unknown or other
  misc_feature (418)..(418): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgctaacttattactgaccaanaatatgaattatttattctccagtcgttcggaccaggggaccaagggtggaagtcaagcgaatgtggctgcaccatctgtcc

SEQ ID NO: 110775 - DNA, 612 bp, Homo sapiens
  misc_feature: GYAE6OF01EGM93.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattgggtaggtggttggcctggtatcagcagaaaccaggaacaatccctaagactcctaatctctcaggcgttgttggtttaggaaaggttcggggtcccagtcgaaggttcaggtgggcgccggatcgtagggacagaattcactctacaccatcgaggccggcctccagtcgtggacggtactcgtagtactaaactttattacgtcgacccaaactaacttatgtaactttattttacttacccttaccgaggttccggtttaccgggaaccggtaacgggggtaaccctaaagggggttaacggaaggttacccgaagggtacccgaacgttgggtcggtacgttacggacccgaaccgtactttccgtgtttccc

SEQ ID NO: 110776 - DNA, 601 bp, Homo sapiens
  misc_feature: GYAE6OF01CW580.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggcagtcagagtattggtaggtggttggcctggtatcagcagaaaccaggacaatcctaagatcctaatctctcaggtcgtctggtttggaaagtcggggtcccatcgaacggttcaggtggcgccggatcgtgggacagattcactctcacatcgagcggctcagtctgaggactctcgactaactttattactagacccaaactaatacttagtaatttaactttttacttaccctccgtaacggttcccggtttaccgggacccggtaacgggggtaaccctaaagggggttacgggtaaacggtaccgaaacggaacccggtaaacggttgggtacggtacgttacgggaccctaaccgtacttcgttcgtttacccg

SEQ ID NO: 110777 - DNA, 529 bp, Homo sapiens
  misc_feature: GYAE6OF01CM76O.26.23.C01.1.454.CMB.1.raw
  modified_base (353)..(353): a, c, t, g, unknown or other
  misc_feature (353)..(353): n is a, c, g, or t
  modified_base (374)..(374): a, c, t, g, unknown or other
  misc_feature (374)..(374): n is a, c, g, or t
  modified_base (398)..(398): a, c, t, g, unknown or other
  misc_feature (398)..(398): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtcgccatcctcactgtctgcctctgtaggagacagagtcaccatcacttgtcgggcgagtcagggcattagcgtatttttagccttggtttcagcaagaaaccagggaaacgcccccaagtccctgactctatgctgcgtccactttagaaggtgacgtccatcaaggttcagcggcagtggatcgnggacagagttcactctacacntcagcagtcctgcagccgtgagtntttgactaacttnttacngccagctaagtataatgactttaccctatcctaccgttcgggaccggggtacacgggacgtaacggaaacttaaacggactggtcggactacggacactactcgttcgttccg

SEQ ID NO: 110778 - DNA, 612 bp, Homo sapiens
  misc_feature: GYAE6OF01AXUBS.26.23.C01.1.454.CMB.1.raw
  modified_base (309)..(309): a, c, t, g, unknown or other
  misc_feature (309)..(309): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtagttggtaggtggttggcctggtatcgagcaagaaaccaggaacaactccctaagactacctaatctctcaggcgtntggttggaagtgggtacccagtcaggttcgagtggcgtcggatcgtgggacagtatcgactctacacctatcaggtcgggctccgacggttctaggacggtactcgtagtaccttaaacgtttacttaccgtacgaacccctaagtaaacttagtacgtaatttaacttttacttcttaccctaggtacccgtttacggaccggtaacggggtaacctaaggggttacggaaaggttaccgaaaggtacgtaaaccggttggtacgggtaccttcgaccgtaaccctagttcctaggtttacc

SEQ ID NO: 110779 - DNA, 592 bp, Homo sapiens
  misc_feature: GYAE6OF01APPPA.26.23.C01.1.454.CMB.1.raw
  modified_base (268)..(268): a, c, t, g, unknown or other
  misc_feature (268)..(268): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccnggaacaatccctaagactcctaatctctcaggcgtctggtttaggaagtggggtcccatcgaaggttcagtggcgcggatcgtgggacagtaattcgactctcacatcagcgggctccgagtctggacggactgtcgactaacttattactgacccaataatattgtaatttacttttaacttaccttccgtaggtaccggtttcccgggaccgtaacggggggtaaccctaaagggggttaacggtaacggttacgaaacggtacggtaaacgttcgggtacgggtcttacggactaaccccgtaagttccgttagtttcccg

SEQ ID NO: 110780 - DNA, 583 bp, Homo sapiens
  misc_feature: GYAE6OF01BTXRE.26.23.C01.1.454.CMB.1.raw
  modified_base (371)..(371): a, c, t, g, unknown or other
  misc_feature (371)..(371): n is a, c, g, or t
tcagagactatactcacgaccggtgctcgatttagtacacgtgattagggattgggggagtcagacccagtcaggacacagcatggacatgagggtccccgctcagctcctggggctactgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagactcctaatctctcaggcgtctggtttggaagtgggtcccagtcaaggttcagtggcgccggatcgtgggacagaattcactctcacntcagcggctccagtctgaggactctgactaacttattactcgaccaactaatatgtaactttattttacttaccttccgaagtccggttaccgggaccgtaacgggggaacccgtaagggttacgggtaaacggtccgaaagggacccggtaaacgttcgggtacgggtacccttacgggaccctaacccgtagtttcccgttggtttaccc

SEQ ID NO: 110781 - DNA, 692 bp, Homo sapiens
  misc_feature: GYAE6OF01EX6OG.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaactccctaagactacctaatcctctcaggtcgtcgttgggtttagggaaacggttcggggtacccctaagtcgtaacggttcgaaggtcgggccggccggtattccgtagggactaggtaacttccacttcctaccaccatccgaacggtccgggtcctccgtaggttcgtaggacggtaccttccgtagtacccttaaacgtttacttaccgttacgtaaccctaaacaacgtttaatcgttaatttaacgttttacttacccgttaccgttacggtcccgggtttaccgggacccggtaaacggggtacccgtaaagggggttaccggtaagggttaccgaaacgggtcccggtaaacggtttcggtacgggtacccttagggacccctaaccgttacgttccgtcggtttacccg

SEQ ID NO: 110782 - DNA, 629 bp, Homo sapiens
  misc_feature: GYAE6OF01B9Z3U.26.23.C01.1.454.CMB.1.raw
  modified_base (380)..(380): a, c, t, g, unknown or other
  misc_feature (380)..(380): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcgagcaagaaaccaggaacaatccctaagatacctaatctctcgaggcgtcgtggtttaggaaacggtcggggtacccagtcgaaggttcgaggtggcgccggatcgtgggacagtatcactcncactagtcgacgtccgggctccgtagtctaggacggtaccttccgtgaaccttaactttacgttacctacgaacccaaactaatagttagtaatttacttttacttcccgtacctacggttcccggtttacggacccggtaacggggtaacccgaaaggggttagggaaacggttccgaaagggtacccggtaaacgttcgggttacggtcctacgggtacctaaccctacgtttccgtcggtttaccc

SEQ ID NO: 110783 - DNA, 634 bp, Homo sapiens
  misc_feature: GYAE6OF01BZNJD.26.23.C01.1.454.CMB.1.raw
  modified_base (200)..(200): a, c, t, g, unknown or other
  misc_feature (200)..(200): n is a, c, g, or t
  modified_base (620)..(620): a, c, t, g, unknown or other
  misc_feature (620)..(620): n is a, c, g, or t
tcagagactatactcacgaccggtgctcgatttagtacacgtgattagggattgggggagtcagacccagtcaggacacagcatggacatgagggtccccgctcagctcctggggctcctgctgctctggcctcccaggtgtcaaatgtgacatccagatcgacccagtcctccttccaggctgtctgcatctgtcgganacagacgtcaccatcacttcggccgggacagtcagtagttagttgggtaggttggttcggcctggtatcgagacaaggaaaccaggaactaactaccctaagctacctaatcctctcgaggtcgtcgttagggttaggaacggtcgggtaccagtacgtaaggttcaggtcgggacgaccggtatcggtagggactaaggtacttccacttcacaccgatcgacggtccggctccgtagtcgtaggacggtacctgtacgtaaccttaactttacgttacacgtaaccctaaagtaacttagttaagtaattttacgtttactaccttccgaaggttccggtaccggacggtacgggtaacgtaacgggttaggaaacgtcgaaacggtcgtaaggtcggacggtctacggacctaacgnttccgtcggtaccc

SEQ ID NO: 110784 - DNA, 519 bp, Homo sapiens
  misc_feature: GYAE6OF01DNHPR.26.23.C01.1.454.CMB.1.raw
  modified_base (425)..(425): a, c, t, g, unknown or other
  misc_feature (425)..(425): n is a, c, g, or t
  modified_base (510)..(510): a, c, t, g, unknown or other
  misc_feature (510)..(510): n is a, c, g, or t
tcagagactatactcacgaccggtgctcgatttagtacacgtgattagggattgggggagtcagacccagtcaggacacagcatggacatgagggtccccgctcagctcctgggctcctgctgctctggctcccaggtgtcaaatgtgacatccagatgacccagtctccttcgaggctgtctgcatctgtcggagacagagtcaccatcacttgccggccagtcagagtatggtaggtggttggcctggtatcagcaagaaaccaggaacaatccctaagactacctaatctctcaggtcgtcgtggtttaggaaaggtcgggtaccagtcgaaggttcaggtcggcgccggtatcgtgggactagattcactctcacatcgagcggctcagtctgagtactctgctaacttatactgaccaanaatatagtattatttatcctcgagtccgttcggacgtacgggaccaagggtggaacgtcgaagacgaagtgtgctacgacacctntcgtgttcc

SEQ ID NO: 110785 - DNA, 629 bp, Homo sapiens
  misc_feature: GYAE6OF01C9VEY.26.23.C01.1.454.CMB.1.raw
  modified_base (288)..(288): a, c, t, g, unknown or other
  misc_feature (288)..(288): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatcgacccagtcctccttccaggctgtctgcatctgtcggagacagagtcaccatcacgttcgccgggccaggtcagggcattagcgtattttttacgccttggtttcagacacgaaaaccgagggaaacncccccgaagtccctagactctatgctgcgtcctacgtttagagggtcggtacgtaccccagtacgtaaggttcgaggtccggacgaggttggatcggtagggaccaggtacgttcactctacaacatcgagcacgcctgcacgcgtggagttactttagactaactttatactcggacctagtataacgttaataacgttcgtaactttacccgtacgttccctaaccgggttcccggggaccgggggtaccctacggggtacgtaaacgggaaaaccttaaccggtaaacggtcggttacggaccttcggaaccctaccctagttcccgttcggttaccc

SEQ ID NO: 110786 - DNA, 518 bp, Homo sapiens
  misc_feature: GYAE6OF01CDHZT.26.23.C01.1.454.CMB.1.raw
  modified_base (407)..(407): a, c, t, g, unknown or other
  misc_feature (407)..(407): n is a, c, g, or t
  modified_base (437)..(437): a, c, t, g, unknown or other
  misc_feature (437)..(437): n is a, c, g, or t
  modified_base (511)..(511): a, c, t, g, unknown or other
  misc_feature (511)..(511): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtatggtaggtggttggcctggtatcagcaagaaaccgaggaacaactccctaagactacctaatcctactcaggtcgtcgtgggtttagggaaaggttcggggtacccagtctaaggttcaggtggcgcggatcgtgggacagtatcactctcacatcgagccggctccgagtcgngagactctgactaacttatactgacctaanatatagtattatttacttctctagtcgtcgccgacgggacagggtagacgtcgaagcgtacgtgtgcgtcgcanctctgtc

SEQ ID NO: 110787 - DNA, 580 bp, Homo sapiens
  misc_feature: GYAE6OF01EM6OO.26.23.C01.1.454.CMB.1.raw
  modified_base (321)..(321): a, c, t, g, unknown or other
  misc_feature (321)..(321): n is a, c, g, or t
  modified_base (475)..(475): a, c, t, g, unknown or other
  misc_feature (475)..(475): n is a, c, g, or t
  modified_base (496)..(496): a, c, t, g, unknown or other
  misc_feature (496)..(496): n is a, c, g, or t
  modified_base (513)..(513): a, c, t, g, unknown or other
  misc_feature (513)..(513): n is a, c, g, or t
  modified_base (547)..(547): a, c, t, g, unknown or other
  misc_feature (547)..(547): n is a, c, g, or t
tcagagactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatcctccagagacgttccgagaacacattaaatctaggaaattaaacttcgtgagaagtgacgactcggtccgttttattttgngcgagaggagggtacagtggcgcgagcgtcccggctttgacctacgtggggaccacggggaaccctggtaccaccggtctcctcgacgccctaccaccgaacgggcccctagtccggtcccttcccccgtggcccgcccgtgccctcgacggcnccacccgtcgagacgccacgnggccgccgtgggtcccngtccctggcaacggactactccaagtctcgtccncgtgacggtcggcgtcgggcaaggccagtgtag

SEQ ID NO: 110788 - DNA, 726 bp, Homo sapiens
  misc_feature: GYAE6OF01DQVP5.26.23.C01.1.454.CMB.1.raw
  modified_base (102)..(102): a, c, t, g, unknown or other
  misc_feature (102)..(102): n is a, c, g, or t
tcagagactatactcacgaccggtgctcgatttagtacacgtgattagggattgggggagtcagacccagtcaggacacagcatggacatgagggtccccgntcagctccgtggggctcctgctgctcgtggcctcccaggtgtacaaatgtgacatccagatcgaccctagttcctccttcgaggcttgtctgctatcgtggtcggagacagtacgtcacctatcgtacgtcggccggctagtcgagtagttagtggtaggtggtcgcgtggtactcgagacgaaacgaaccgaaggtaacctaacgttacccgaagtactaccttaatcctacgtcgacggtcgtggttagggttaggaacgggttccgggtacctaagttcggtaacggttcgagggtcggccggacggtagtcggtacggaactaggtaactcctaaccttccgaacctaccgtacgtccggaccggtccgggtacctacggtacgtacgtacgggtaacgtctacgttacgtaacctttaactttactacgtaccgtaaacctaaagttacgttaattacgtttaactttacgttttaacccgtcgttaccggtaacgggttcccggtaacgggtaacccgggtaacgggtaacggtaaacgggtacgtaaacggtacggaaggtacggtaacggtcggtacgtccgtaacgtacccgttaacgtctttcgtcgttacccg

SEQ ID NO: 110789 - DNA, 619 bp, Homo sapiens
  misc_feature: GYAE6OF01CFR6J.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtccaccatcacttgccgggccagtcagagtagttggtaggtggttggcctggtatcgagcaagaaaccaggaacaatcctaagactcctaatctctcaggtcgtcgttgggtttagggaaaggttcggggtacccagtaccgaaggtttcaggtcgggcgccggtatcgtgggacaagtattcatcctacaccatcgaggccggctacgagtctggagactctgactaacttactactcgactaaataatattagtaatttatttacttccgttaccgacggttccggttaccgggacccggtaacggggggtaaccctaaaggggttacgggaaagttaccggaaaggtacgggtaaaccgttcgggtaacgggtccttacggacctaacccgtaatttcccgttcggtttaccc

SEQ ID NO: 110790 - DNA, 502 bp, Homo sapiens
  misc_feature: GYAE6OF01AVUIK.26.23.C01.1.454.CMB.1.raw
  modified_base (197)..(197): a, c, t, g, unknown or other
  misc_feature (197)..(197): n is a, c, g, or t
  modified_base (398)..(398): a, c, t, g, unknown or other
  misc_feature (398)..(398): n is a, c, g, or t
  modified_base (420)..(420): a, c, t, g, unknown or other
  misc_feature (420)..(420): n is a, c, g, or t
  modified_base (485)..(485): a, c, t, g, unknown or other
  misc_feature (485)..(485): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcgganacagagtcaccatcacttgccggcagtcagagtattggtaggtggttggcctggtatcagcagaaaccaggaacaatccctaagactacctaatctctcaggcgtctggttggaaagtggggtcccatcgaaggttcagtcggcgccggatcgtgggacagaattcactctcaccatcgagcggctccagtctgagactcngactaacttattactgaccaanaatatagtattatttactctcagtcgttcggccgtagggactaggtggtagtcgaagcgaactgngctagcactctctgtcc

SEQ ID NO: 110791 - DNA, 620 bp, Homo sapiens
  misc_feature: GYAE6OF01ASIIQ.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagacgtcaccatcacgttcggcccgggtccagtcagtagttagttgggtaggtggttggccgtggtatcagacaacgaaaccaggaactaactaccctaagactacctaatcctacctcgacggtcgttcgttagggtttaggaacggttcgggtacccagtacgtaaggttcgagggtcggcgccggatcggtaggacagtacttcgactctccacactcgaggccggctccgtagtctagggacgtaccttgtaccgtacttaacttacgttacgcgaaccaaacttaattactaagttaacttatttactacctccgttagtccgtaccgggacgaacgggtacgaagggttaggaaaccgtcgaaggacgtaacgttcgggtacgcgtaccggcaaccgttacgtcgttcgttaccc

SEQ ID NO: 110792 - DNA, 753 bp, Homo sapiens
  misc_feature: GYAE6OF01BTBJJ.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatcgtggtcggagacagacgtcaccatccgacgttcggcccgggctagtcaggtagttagttgggtaggttggttcggccgttaggtactcgtaggacgaaggaaaccgagggaaacctaacgttacccgtaaaggtacttaccgttaagtccgttcgtaccgacgggtccgttcggttacgggtttagggaaacggttccggggttacccctaagttaccggtaagggtttcgacggggttcgggaccggtacccgggttaagttccggttacggggtaacgtaaggttaacgtttccgtaccgttaccgtaccgtaaccgtacgttaccgacgggtaccggtaccttacccggtaggttccgtagggtaacggtacctacgtaccggtacttaacgtttacttaccgtcgtaaccctaagtaacgttagtagttaactttagtttacgttacccgtacgtacggttcggttaccggaccggtacgggtacgtaagggtacggtaacgtcgaacgtaccggtacgttacggtcgtacgtacgacctacgtacgttcgtcggttacc

SEQ ID NO: 110793 - DNA, 667 bp, Homo sapiens
  misc_feature: GYAE6OF01EKGDB.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtcctccttccaggctgtctgcatctgtcggagacagagtcaccatcacgttgccgggcagtcagtagtagttgggtaggtggttcggcgttaggtatcgagacaacgaaacgaaggaacaactacccgtaagacttacctaactcctcgtacgaggtcgttcgttagggttacggaaacggttcgggtaccagtacgtaacggttcgaggtcggacgaccgagtacgtacggtagggaactagtaacttccgaactctaccgacctagtaccggacggtccgggtcttacccgagtccgtaaggtacggtacccttacgtagtacccttaacgtttacttaacgtacgaacctaaactaattaatagttaactttatttactcctacgtacggttaccgttacgggaacgggtacgggtaaccgtaagggtacggtaacgtacggaacggtccgtaaacggttggtacggtacgtacgtaccctacgttcgtcccgttacg

SEQ ID NO: 110794 - DNA, 611 bp, Homo sapiens
  misc_feature: GYAE6OF01A0IUN.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttcgccgggccagtcagagtattggtaggtggttggcctggtatcagcagaaacaggaacaatccctaagatcctaatctctcgacggcgttcgtgggtttagggaaaggttcgggggtcccagtacctaagggtttcaggtcgggcgccggagtcgtgggacagtaattcactctcacctagtcgacgcgggctccgagtctagaggtactctgactaactttactactcgaccaactaattagtagtattagttttacttcttaccgtacgtccggttaccgggcccgtaacgggggtaaccgtaaagggtacgggtaacggtaccggaaagggacccggtaacggttggtcgggttacctcgggaccacccggttattcccgtggttttaccccg

SEQ ID NO: 110795 - DNA, 676 bp, Homo sapiens
  misc_feature: GYAE6OF01DXUWI.26.23.C01.1.454.CMB.1.raw
  modified_base (102)..(102): a, c, t, g, unknown or other
  misc_feature (102)..(102): n is a, c, g, or t
  modified_base (390)..(390): a, c, t, g, unknown or other
  misc_feature (390)..(390): n is a, c, g, or t
  modified_base (417)..(417): a, c, t, g, unknown or other
  misc_feature (417)..(417): n is a, c, g, or t
tcagagactatactcacgaccggtgctcgatttagtacacgtgattagggattgggggagtcagacccagtcaggacacagcatggacatgacgggtccccntcagctccgtgggctcctgctgctctggctcccgaggtgtacaaatgtgacatccagatcgacccagtcctccttccaggtcttgtctgcatctggtacggagacagacgtccaccgtatctacgttcggcccggcagtcagagttagtggtaggtggtgtccgtgtatcgagacgaaacgaaaccgaggaaacctaacgtacctaagtacttacctaacgtctacgtcgtacggtcgttcggttagggttagaacggtcggtaccagtcgtagtcgaggcggcgcgntcgacggataagtactcactcgacacngtacgcggtccggtactaccgtaggtccgtaggtacgtaccttacgtacgtaaccgtttaactttacgttacctaaccggaaccttaaacgtatttacgtacgtttaaactttacgtttttaaccgtccgttaccgttacggttacccgggtacccgggaacggtaacggggtaaccggtagggtaaccggaacgttacgaaacggcgttaaggcggttacgtaccgtacgaccctaccgtgttaccgttgttaccccg

SEQ ID NO: 110796 - DNA, 699 bp, Homo sapiens
  misc_feature: GYAE6OF01C3NKU.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctggtcggagacagagtccacctatcacttcggccgggaccagtcagtagttagttgggtaggtgggttggcctaggtactcgagacaagaaaccgaaggaacaactacccgtaaagtacttacctaattcctaccgtacgaggtcgttcggttagggtttagggaaacggttcggggtacccaagttcggaaacggttcgaacgggttggcccggtaccgggtatcggtacggggactaagtacgtttccacttcctacgacctatcgacggcggactcagtctaggacgtactgtacgtactaactttagtacctacgtaaccctaacttaaataagttaccgttaaatttactttttacgtaccgttaccgtacggttaccgggtccggtaaccggtaacggggggaaccgtaaagggggttacggaaacggttaacggaacggaaccgggttaacggtcgggtaccggtacgtacggtaccctacgtaacgtcgtttcggtttaccc

SEQ ID NO: 110797 - DNA, 745 bp, Homo sapiens
  misc_feature: GYAE6OF01E0VSW.26.23.C01.1.454.CMB.1.raw
  modified_base (206)..(206): a, c, t, g, unknown or other
  misc_feature (206)..(206): n is a, c, g, or t
tcagagactatactcacgaccggtgctcgatttagtacacgtgattagggattgggggagtcagacccagtcaggacacagcatggacatgagggtcccccgctcagctccgtggggcctcctgctgctcgtggctcccaggtgtcaatgtgacatccagatcgaccctagtcctccttccaggctgtctgctatcgtggtcgganacagtacgtaccacctattcctacgttccgggccccgggaccaggtcgaaggtagttaggtttgggttagggttggttacggcccgttaggtactcaggacaacgaaaccgaagaacctaacttacccgaagtacctaccgtaatccgtcctacgacggtccgttacggtttagggtttagggtaaacgggttccggggtaacccaggttaccgtaacggggtttcgaggtcgggacccgggtacgtagtccgggtacgggaacgtaagttaaccttcgtaaccctccttaccgaacctacgtccgaccgggtccggcccgtctacgggttcgtaaggaccgtacgttctacgtaccttaaactttacgtaccgtaccactaaacgtattactaagttaatttactttacttcccgtaccgtcggttaccgtaccggggaccggtaacgggtacgtaacggggacgtaaaggtccgaagggttaccgtaacggttggtcggtaccctacggtaccaccgttggtttactcgttaacccg

SEQ ID NO: 110798 - DNA, 716 bp, Homo sapiens
  misc_feature: GYAE6OF01DH7Q2.26.23.C01.1.454.CMB.1.raw
  modified_base (102)..(102): a, c, t, g, unknown or other
  misc_feature (102)..(102): n is a, c, g, or t
  modified_base (705)..(705): a, c, t, g, unknown or other
  misc_feature (705)..(705): n is a, c, g, or t
tcagagactatactcacgaccggtgctcgatttagtacacgtgattagggattgggggagtcagacccagtcaggacacagcatggacatgagggtccccgntcagctccgtggggctcctgctgctctggcctcccaggtgtcaaatgtgacatccagactgacccagttcctccttcaggtcctgtctgcctatctggtacggagacaagacgtaccacctatcgtacttccgggcccggcctaggtacaggtagttagttgggtagggtggttcggccgtgtatcgagcgaacgaacaggaaactactaccctaagtactacctaactcctctcgacggtccgttgttagggtttagggaacggtcggtaccagtacgaaggttcgaggtcgggaccgtccggattcggagggaactaaggtactttacctacgtacctaaccgacctacgtaacccgtacgggtcccgggtcctacgtacggttaccgtacgggaacggttaccgtccgtacgtaccgtttaaacctttacgttaacccgttaccggaaaccttaaacgttaaattaacgtttaacgtttaactttaaacctttttccttaccgtaccgttacgggttacccggtacccgggtaaccgggaaccgggtacggtaaagggtcgaaagttcgaacgacggtagtcgtagctacgactaccgtnttcgtcgttcc

SEQ ID NO: 110799 - DNA, 686 bp, Homo sapiens
  misc_feature: GYAE6OF01BNXER.26.23.C01.1.454.CMB.1.raw
tcagagactatactcacgaccggtgctcgatttagtacacgtgattagggattgggggagtcagacccagtcaggacacagcatggacatgagggtcccccgctcagctccgtgggcctcctgctgctctggcctcccaggtgtcaaatgtgacatccagatcgacccagtcctccttccaggtctgtctgctacgtcgtggtcggagacagtacgtcacctatccgacgttcggcccgggacagtcagtagtagttcgggtaggttggttcggtccgttggtactcgacgtacgaacgaaaccgaggaacctaactacctaagactacctatcctacgtcgacggtcgttcgttaggttaggtaacggtcggtaccctaagttaccggtaaggttacgagggtcggtcccggccggtacgtacggtacgggtaacgtacgtaacgttcctaaccgttcctacccgtactacgtacgacgtaccgaccgtcgtacgacgtacgtccgtaggtacggttatttacgaaccgttaacgtttacttcggactaccgtatacgtaacgttaattacgtaccgttacttacctacgtacccgtaccggtcccgggacgggtaccacggtaacgtaacggtaaactacggtacggtcggtacgacctcgtacctactagttctgtccttacg

SEQ ID NO: 110800 - DNA, 756 bp, Homo sapiens
  misc_feature: GYAE6OF01AL06Y.26.23.C01.1.454.CMB.1.raw
  modified_base (102)..(102): a, c, t, g, unknown or other
  misc_feature (102)..(102): n is a, c, g, or t
  modified_base (197)..(197): a, c, t, g, unknown or other
  misc_feature (197)..(197): n is a, c, g, or t
tcagagactatactcacgaccggtgctcgatttagtacacgtgattagggattgggggagtcagacccagtcaggacacagcatggacatgagggtccccgntcagctcctggggctcctgctgctctggctccaggtgtcaaatgtgacatccagatgacccagtcctccttccaggctgtctgcatctgtcgganacagagtcaccatcacttcggcccgggcctagtcaggtagttacgttgggtagggttcgggttggtcccgttgggtaacttccgacggtaccaacggaaaacccgagggtaaacctaaaccgttaccccgtaaaggtaacttaccttaaattccttaccgtacgtacgggtccggttaccgtttagggttttacgggaaaggttccggggtacccctaagttaccgtaaaggttcaaggttcgggaccggtcccggtagtccggtacgggaactacggtaactttaccgaccgttcctaccgtaccgtacgttcggacggtcccgggtaccttacccgaaggttcccgtaggtaccgggtaacctccggttacgaaccgtttaaaccgtttacgttaccgtacgtaaccctaacgtaactttacgttagtaactttacgttttaacttcccgacgttacggttacccggttccggaccggtacggggtacctaaaggggtcgaacgtacgacgtacgtaacgtcggtagtcgtacgacctacgtcgttcgtcgttaccg

SEQ ID NO: 110801 - DNA, 704 bp, Homo sapiens
  misc_feature: GYAE6OF01DC7NS.26.23.C01.1.454.CMB.1.raw
  modified_base (102)..(102): a, c, t, g, unknown or other
  misc_feature (102)..(102): n is a, c, g, or t
  modified_base (154)..(154): a, c, t, g, unknown or other
  misc_feature (154)..(154): n is a, c, g, or t
tcagagactatactcacgaccggtgctcgatttagtacacgtgattagggattgggggagtcagacccagtcaggacacagcatggacatgagggtccccgntcagctccgtggggctcctgctgctcgtggcctcccgaggtgtacaaatgtnacatccagatcgacccagtcctcctccaggctgtctgcatcgtgtcggagacagagtccactagtctacgtcggccggcagtcaggtagtgttgggtaggtggttggcctaggtatcgagacaagaaaccgaggaacaacgtacctaagtactacctaactctcgtacgaggtcgttcgttagggtttaggaaacggtccgggtacctaagtacgtaaaggtttcgaggtcggaccgaccgtaggtacttcggtaggaactaagtactttccacgtttacctacaaccgtacgtccgacgggtccgggtcctacggtagttccgtaacggaacggtcttaccgtacgtaaccttaaactttcgttaaccgtacgaacctaaacgttaagttaagttacgttaaacttttacttttacttacccgtaccgttaaggggtcccggtttacccggaccgggtaaacggggaaacccggttagggtaacggtaaacgtacgtaacggacggttaacgtcgggtcgtaccgaacgccgtaacctgttcttaccgg

SEQ ID NO: 110802 - DNA, 767 bp, Homo sapiens
  misc_feature: GYAE6OF01BJB67.26.23.C01.1.454.CMB.1.raw
  modified_base (103)..(103): a, c, t, g, unknown or other
  misc_feature (103)..(103): n is a, c, g, or t
  modified_base (127)..(127): a, c, t, g, unknown or other
  misc_feature (127)..(127): n is a, c, g, or t
  modified_base (511)..(511): a, c, t, g, unknown or other
  misc_feature (511)..(511): n is a, c, g, or t
  modified_base (737)..(737): a, c, t, g, unknown or other
  misc_feature (737)..(737): n is a, c, g, or t
tcagagactatactcacgaccggtgctcgatttagtacacgtgattagggagttgggggagtcagacccagtcaggacacagcagtggacatgagggtccccntcagctccgtgggctctgctgctntggcctccgaggtgtacaaagtgtgaacatacccgagtatcggaacccctagttcctccgttccgaaggtcccttggttcctggacctagtccgttaggaccggaaggtaccaaggacgttaccaccgtataccgtacgtccgggccggactaagtcgaacgtagtagttgggtaggttggtcgtaccgttggaacttcggaacgacgtaacgaaaaccgaaggaacctaacgtaccgtaaagtaactacctaatccgttacgtacgtaggtccgttagtagggtttaggaaaacggtcggtactacgtacgtacggtacgtagggtacgccggtaaccgtgtacggtaacggaagacgttaaactcccaaagttcccgtaaanaccgtacgtaccggtacggaccggtacgtacgtaacgtacgtacggtaacgtacgtcgtaacctaacgtaacgttacgtacgtaggaaccctaaagtaacgttagtaacggttaacttaagtttaacccttccgtaacgtacccggttacggaccggttaaccggaacgggtaaacgtacggtaaacggtaacggtacgtaacggacggtaaacgtggttaaaccnggtacacgaacttcggtcgttcgtaacccg

SEQ ID NO: 110803 - DNA, 857 bp, Homo sapiens
  misc_feature: GYAE6OF01BTIRE.26.23.C01.1.454.CMB.1.raw
  modified_base (183)..(183): a, c, t, g, unknown or other
  misc_feature (183)..(183): n is a, c, g, or t
  modified_base (211)..(211): a, c, t, g, unknown or other
  misc_feature (211)..(211): n is a, c, g, or t
  modified_base (563)..(563): a, c, t, g, unknown or other
  misc_feature (563)..(563): n is a, c, g, or t
tcagagactatactcacgaccggtgctcgatttagtacacgtgattagggattgggggagtcagacccagtcaggacacagcatggacatgagggtccccgctcagctccgtggggctcctgctgctcgtggctcccaggtgtacaatgtgacactccagtatcgacccagtcctccttaccnggtccttgtactgctatcgtgtccgganaccgtaggtacgtacacctagtccgaacgttcggaccgggtcctacggtacagggtaggttaggttacggggttacgggttcgggtttcggtaccgttagggtaactacgaacgaccgtaaacggaaaacgtaccgggaaaccttaacgttaccccgtaaaaggtcctaacccgttagttccgtaccggtacgtacgggtaccggttacggtttaggggtttaaacgggtaacgggttccggttaacctaacggttacggttaaaccggttcggaacggtccgggtaccggtaccgtaggtcgaagggttaacaacgtacgttccaccgttccgtaacacgtacgtaccggnggtaccggtcctacgtacggttctagggtaactacccgttacgtactaccgttaacgtttaccgtaacgtacgtaacctaaacggtttaacgttacgtttaacgtaactttttaacgttttaccgttacccgtaacggttacccggtacccggtttacgggaacccggttaaacgggggtacgtaaaccgggttaaagaaccgggttaccggtaaaccgggtcgttaaacggtccggtttaacgggaccctaccgttaccggtaagtttcccgttaacggtttccctaaccggg

SEQ ID NO: 110804 - DNA, 635 bp, Homo sapiens
  misc_feature: GYAE6OF01ELDT6.26.23.C01.1.454.CMB.1.raw
  modified_base (101)..(101): a, c, t, g, unknown or other
  misc_feature (101)..(101): n is a, c, g, or t
  modified_base (404)..(404): a, c, t, g, unknown or other
  misc_feature (404)..(404): n is a, c, g, or t
tcagagactatactcacgaccggtgctcgatttagtacacgtgattagggattgggggagtcagacccagtcaggacacagcatggacatgagggtccccntcagctcctggggctcctgctgctctggctcccaggtgtcaaatgtgacatccagatgacccagtcctccttccgaggctgtctgctatcgtggtcggagacaggactccaaccattccacgttcggaccgggccagtcagtagttagttgggtaggttggttggccttaggtactcgagcctaagaaaccgaggaactaacgtaccctaaagaccttactaatcctctcgaggtcgttcgttgggttacggaacgggttcgggtaccctagtacgtaaggttcaggttcgggccgtacggtntcggtacgggaactagtacttcactcgtacactagtacgacggccggtactccgtagtcgtaggacgtctactacgtacttaacgttactacgtcgaacctaacgtattacagttaacttacgtttactacctcgtacgtcggttaccggacggacgggtacgtagggtacgaacgttcgaaggtccggtaagtcggtgtaccgtacgactaaccgtacttcgtcgttacc

SEQ ID NO: 110805 - DNA, 647 bp, Homo sapiens
  misc_feature: GYAE6OF01DH2MZ.26.23.C01.1.454.CMB.1.raw
  modified_base (102)..(102): a, c, t, g, unknown or other
  misc_feature (102)..(102): n is a, c, g, or t
  modified_base (197)..(197): a, c, t, g, unknown or other
  misc_feature (197)..(197): n is a, c, g, or t
  modified_base (483)..(483): a, c, t, g, unknown or other
  misc_feature (483)..(483): n is a, c, g, or t
  modified_base (507)..(507): a, c, t, g, unknown or other
  misc_feature (507)..(507): n is a, c, g, or t
tcagagactatactcacgaccggtgctcgatttagtacacgtgattagggagttgggggagtcagacccagtcaggacacagcatggacatgagggtccccnttagctcctggggctcctgctgctctggctcccaggtgtcaaatgtgacatccagatcgaccagtctccttccaggctgtctgcatctgtcgganacagacgtcacatcacgttcggccggtccagtcaggtagttagttggtaggttggttcggaccttggtatccgagtacgaacgaaccaaggaacaacgttaccctaagacttaccgtaactctcgtacgaggtcgtacgttggttaaggtaacgtcgggtacccctataccgaacggtttcgaaggttcgggccgacggtagttccgtaagggactacggtaactccgaacttcaacgtacacgttcgaggtccggacttaccgtagtcgtaagtcgtactcgtanacgttacttaatcacgtaaccaanacttagtactagtttactttacgtctcgaacgttccgtaaggcccgtaagggaaccgtaagggtacgaaacgtaccgaaacccgtgtaaccggttcgtcgtacaccggacctaccgtatttcctaaccgtttccgttaac

SEQ ID NO: 110806 - DNA, 771 bp, Homo sapiens
  misc_feature: GYAE6OF01EJYZ8.26.23.C01.1.454.CMB.1.raw
  modified_base (202)..(202): a, c, t, g, unknown or other
  misc_feature (202)..(202): n is a, c, g, or t
tcagagactatactcacgaccggtgctcgatttagtacacgtgattagggattggggggagtcagacccagtcaggacacagcatggacatggagggtccccgctcagctcctggggctcctgctgctctggctcccaggtgtcaaatgtgacatccagatgacccagtcctccttccaggctgtctgcatctggtcggaanactagacgtcaccatccacgttcggcccgggacctagtcaggtagttagttgggttaggtggttcgccgttaggtactcgagacaagaaaccgaaggaactaactacccgtaagtactacctaatcctcgtacgaggtcgttacgttagggtttacgggaacggttcgggtacctaagttaccgtaaggttaccgagggtcgggaccggaccggtagttcggtagggaactaggtaaacttccaacgttcctacaaccgtattacccggagggtacccgggtaccttcggtaacgttcggtacgggtaacggtaccgttaccgtacggttaacccttaaacgtttaccgttaaccgaccggtaaaccctaaacttaaagttacgtttacggttaaactttaacgtttttaccttacccgttaccgtacgggtttccgggttacccgggaacccgtaagggggtaaccgtaaacggggttacggtaaacgggtaccgtaaagggttacccggtaaggttccggggtacgaccgtaccggtaccttaacctcgtttccgttcgttaccccg

SEQ ID NO: 110807 - DNA, 861 bp, Homo sapiens
  misc_feature: GYAE6OF01BZT6X.26.23.C01.1.454.CMB.1.raw
  modified_base (205)..(205): a, c, t, g, unknown or other
  misc_feature (205)..(205): n is a, c, g, or t
tcagagactatactcacgaccggtgctcgatttagtacacgtgattagggattgggggagtcagacccagtcaggacacagcatggacatcggagggtcccccgctcagctccgtggggctccgtgcgtgcctcgtacgtcctacccgaggtcgtacaaattggacgactacgtccgagtacgtcgaccctagtccttcctacgnggtctgtccgtcgactagttcggtaggtacggaacgtacgaggtacctaccgactacgtttaccgaccggtttccgggacccggtactaacggtcgtaacgggttagttaaggggtttacggggtacggggtttcgggtttccggtaacggttacggtaacgttaacgacggtaaacgaaaacggtaaaaccggtacaaaaccccgttaaccgttaacccgtaagtaccttaccctttaagtcccacgttacggtacgggttctaagggtttgggtaaacggaccggttaccggaacgtaacgttaaggttacggtcgacggtccggacggtaccgttggtaccgggtaaagacccgttttaagtaccgtaccttaccgttacccgtaaaccgtacccggtacgtaaccggtcccggtaccgttccgtaaccgttagggttaccggaacggttaaccggtcgtttacgtaacccgtaactttacggttaacctaacccgtaataaacccggtaatacttagttaaacgtacttttactacgtccggttaccggtacgtccgggtaccggaacgggtacggtaacgggtacgtaaggtaccggaacggtagacggtacggcgtaccggaactccggtactgacttgtcttaccccgg

SEQ ID NO: 110808 - DNA, 495 bp, Homo sapiens
  misc_feature: GYAE6OF02G4NN0.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgattatttattctccagtcgttcggccaggggaccaggtggaagtcgaagcgaactgtggctgcaccatctgtc

SEQ ID NO: 110809 - DNA, 498 bp, Homo sapiens
  misc_feature: GYAE6OF02G1IKO.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaaacaatatgatatttattctccagcgttcggcctaggggaccagggtggaagtcgaagcggaactgtggctgcaccatctgtcc

SEQ ID NO: 110810 - DNA, 546 bp, Homo sapiens
  misc_feature: GYAE6OF02IEMVM.26.23.C01.1.454.CMB.1.raw
  modified_base (444)..(444): a, c, t, g, unknown or other
  misc_feature (444)..(444): n is a, c, g, or t
  modified_base (539)..(539): a, c, t, g, unknown or other
  misc_feature (539)..(539): n is a, c, g, or t
tcagagactatactcacgaccggtgctcgatttagtacacgtgattagggagttgggggagtcgagacccagtcaggacacagcatggacatgagggtccccgctccagctcctggggctcctgctgctctggctcccaggtgtcaaatgtgacatccagatgacccagtctccttccaggctgtctgcatctgtcggagacagagtcaccatcacttgccgggccaggtcagagtattggtaggtggttggcctggtatcagcagaaaccaggaacaataccctaagatacctaatctactcagcgtactggttaggaaagtggggtaccatctaaggttcagtggcgccggatcgtggggacaggaactttcacgtctaccacatcgagtcgggctccgacgtcgtgacggactctagactaactttacttactcgaccaanaactattagaatttaattattactacctagtcgttccgccgtagggacccgaaggtaggaagtacgaagacgaactaggtggctgccaactactntcgttcg

SEQ ID NO: 110811 - DNA, 563 bp, Homo sapiens
  misc_feature: GYAE6OF02H5L25.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaaatctctcaggcgtctggtttggaaagtgggtcccagtcaaggttcagtggcgcggatcgtgggacagaattcactctcaccatcaggcgggctccagtctgacggactctgacctaactttattactcgaccaaacaaattatagtaattattttaatttcctacctagtccggtttacggaccgtaagggggaacccaaggggttgggtaaacgtcgaaacggtaccgaaacgttggtacgggcttacggcctaaccctagttcctgttccc

SEQ ID NO: 110812 - DNA, 493 bp, Homo sapiens
  misc_feature: GYAE6OF02JF9BS.26.23.C01.1.454.CMB.1.raw
  modified_base (465)..(465): a, c, t, g, unknown or other
  misc_feature (465)..(465): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaagtgggtcccatcaaggttcagtgcgcgatctgggacagaattcactctcaccatcagcgggctccagtctgaggactctgcaactttattactgaccaacaatatgtattatttatctacagtcgttcggccaggggaccagggtggaagtnaagcgaactggtgctgcacatctgttcc

SEQ ID NO: 110813 - DNA, 660 bp, Homo sapiens
  misc_feature: GYAE6OF02I0992.26.23.C01.1.454.CMB.1.raw
  modified_base (256)..(256): a, c, t, g, unknown or other
  misc_feature (256)..(256): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccggcagtcagagtagttggtaggtggttggcctggtatnagcagaaaccaggaacaatccctaagatcctaatctctcagcgtcttggtttaggaaagttggggtacccagtaccgtaaaggttccaggttcgggcggtccgggaattccggacggggtacaagggtaactttccgacgttacccttcaaccctagttccgaacggtccgggtacctacccaaggtccgttaggaacgggtactcgtcgacctaactttataccgtacgaccaaactaataattaggtaactttagtttttacttaccttaccgtacgttaccggtttccggaaccgggtacgggggtaaccctaagggttcgggaaaacgttccggaaacggtccgtaaaagttccgggttaggaccgttcgacccgacccgttaagttccgtagtttcccg

SEQ ID NO: 110814 - DNA, 548 bp, Homo sapiens
  misc_feature: GYAE6OF02I75MK.26.23.C01.1.454.CMB.1.raw
  modified_base (416)..(416): a, c, t, g, unknown or other
  misc_feature (416)..(416): n is a, c, g, or t
  modified_base (544)..(544): a, c, t, g, unknown or other
  misc_feature (544)..(544): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagggcattagcgtattttttagcctggtttcagcagaaaccagggaaacgccccaagtccctgatctatgctgcgtccactttagaaggtggatcccatcaaggttcagcggcagtggatcgtgggacagtagttcactctcaacatcagcagcctgcacgcctagaggtatttgactaacttattacnctaccagctaagttaataacgttgtaacttacccctaatccgaaccgtttcggggacccgggggtacacggtacgtaaggaaaaccgtaaaccggagtacggtcggactggacctaaccgtatcgttnttcc

SEQ ID NO: 110815 - DNA, 511 bp, Homo sapiens
  misc_feature: GYAE6OF02HC5XC.26.23.C01.1.454.CMB.1.raw
  modified_base (428)..(428): a, c, t, g, unknown or other
  misc_feature (428)..(428): n is a, c, g, or t
  modified_base (508)..(508): a, c, t, g, unknown or other
  misc_feature (508)..(508): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaagttggggtcccagtcgaaggttcagtggcgccggatcgtgggacagaattcactctcaccatcagcgggctccgagtcgtgaggactctcgactaactttatactcgacctaaanaatatgtaattatttatctaccagtcgtcggccaggggaccagggtgaagtcaagccgaagtgtaggctgaccacatctnttc

SEQ ID NO: 110816 - DNA, 553 bp, Homo sapiens
  misc_feature: GYAE6OF02HZJO5.26.23.C01.1.454.CMB.1.raw
  modified_base (432)..(432): a, c, t, g, unknown or other
  misc_feature (432)..(432): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggcagtcagagtattggtaggtggttggcctggtatcagcagaaaccaggaacaatccctaagactcctaatctctcaggcgtcgttggtttaggaaagttcgggtcccagtcgaaggttcaggtggcgcggatcgtagggacagtaattcacgtctacaccatcagcggctccagtctgacggactcgtgactaacgtttatactgaccaanattatgtaattatttatcctaccgagtccgttacggaccgtaacggggacctagggtggaacgttaccgaacgggtcgtaacgtggtgccgttacggacctaaccgtacgttctgtttacc

SEQ ID NO: 110817 - DNA, 527 bp, Homo sapiens
  misc_feature: GYAE6OF02FTSGY.26.23.C01.1.454.CMB.1.raw
  modified_base (419)..(419): a, c, t, g, unknown or other
  misc_feature (419)..(419): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaagtggggtccatcaaggttcagtggcgccggatcgtgggacagaattcactctcacatcagcgggctccagtctgacggactcgtgctaacttattactgacctaanaatatgattatttattactccagtccgttcggccgtaggggacccagggtacggaaggtcaaaggtccgaacgttggtcgggcttggacctacccagttcctgttccc

SEQ ID NO: 110818 - DNA, 560 bp, Homo sapiens
  misc_feature: GYAE6OF02GVZ0M.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagtagaaaccaggaacaatccctaagactcctaatctctcaggcgtcgtggtttaggaaaggttggggtcccagtcaaggttcagtggcgcggatcgtagggacaggaattcactctcaccatcagcggctccagtctgacgactcgtgactaacttattactcgaccaaactatatgtattaactttattcctaccgtagtccgttacggaccgtaaggggaccctaagggtcggaacgtcgaaacggtacggaaacgttggtacggacttcggacctaccctagtccttcgtaccttaccg

SEQ ID NO: 110819 - DNA, 756 bp, Homo sapiens
  misc_feature: GYAE6OF02I2EAP.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctcgtggcctccgaggtgtactaagtgtacgaactactaccgaagtataccgaccctagttcccttcccttaccgacggtcttgtctcgctattcgtcggtacggacgacgagtacgtaccaacctactacctaccgttccgggccccgggacctacggtacgaaggtagttaggttaggggtagggttggggttcggtccgttaggttactacgagacgaaaccgtaaaccgaagtaaacctaaccgttacccgtaaagtaccttaaccgtaattcctacgtacggacggtccgtttacggttaggggttaacgggaacgggttccgggtaacctagttacggtaacggttcgaggggtcggtaccggtaccggtagttcggtacgggaactaagtacttccgacttccgtaccacgtactcggacgggtccgtacctacgtacgttcgtaggacgtcctacgtacgtaacttaactttacgtacgacgtaacctaaatacgttatagttaacttttactttactcctaacggtcgttccggtaccggacgggaacgggtacgtagggtagtaacgtacggtaacgtaccggtaagtcgggtgaccgtgaccctacgtattcggtcttacc

SEQ ID NO: 110820 - DNA, 528 bp, Homo sapiens
  misc_feature: GYAE6OF02IJ8MM.26.23.C01.1.454.CMB.1.raw
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
  modified_base (396)..(396): a, c, t, g, unknown or other
  misc_feature (396)..(396): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccggccagtcagagtatggtagtggttggcctgggtatcagcagaaccaggaacaatccctaagatacctaatctctcaggctntggtttggaagtgggtccatcaggttcagtggcgcgatgnggacagatcactctcacatcagcggctccagtctgagactctgctaattacttacngacctaaacaatatgtattattttattctccgagtcgttcggaccgtacggggacctagggtcggaagttcgaaacggtccggaaacgttggtacggtaccgtagccgaaccgaactttccgagtttacccg

SEQ ID NO: 110821 - DNA, 597 bp, Homo sapiens
  misc_feature: GYAE6OF02IAGKF.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaactacctaagatcctaatctctcaggcgttcgttggtttaggaaaggtcggggtacccagtacgtaaggttcaggtggcgccggatcgtaggacagtaattcactctacacctatcgaggccgggctccgagtctgacgactctgactaactttatactcgaccaacaatatagtaattattttacttcctacgtaaggttccggttaccggaccgtaacgggggaacctaaggggtcggtaaacgtcggaaacggtaccggtaaacgtttcggtacgggtccgtacgggaccctaaccgtacgttacccgttgtttaacccg

SEQ ID NO: 110822 - DNA, 571 bp, Homo sapiens
  misc_feature: GYAE6OF02HIG8O.26.23.C01.1.454.CMB.1.raw
  modified_base (229)..(229): a, c, t, g, unknown or other
  misc_feature (229)..(229): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccggccagtcagngtattggtaggtggttggcctggtatcagcagaaacaggaacaatccctaagactacctaatctctcaggcgtcgtggtttggaaagtggggtcccatcgaaggttcaggtggcgcggatcgtgggacagaattcactctcacatcagcgggctccgagtcgtgagggaccttcgtcgtactaactttactactcgacctaaactaattatgtaattacgtttattacctaccgtagtccggtttcggaccgtaagggggacccgtaggggtacggtaacggtcgaaacgtacggtaacgttggtacgggtctacggacctaacccgtattccgtagttacc

SEQ ID NO: 110823 - DNA, 554 bp, Homo sapiens
  misc_feature: GYAE6OF02G90RM.26.23.C01.1.454.CMB.1.raw
  modified_base (411)..(411): a, c, t, g, unknown or other
  misc_feature (411)..(411): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaataccctaaagactacctaatcctctacgaggcgtcttgggtttaggaaaggtcggggtacccagtcgaaggttcaggtcggcgccggatcgtgggacagattcatctcacatcagcgggctccagtctgacgctcngactaactttacttactagaccaaactaatatagtaattatttacttctaccagtcggttacggaccgaggggacctagggtacggaaagttcaaaggtaccgaagttcggtcggactcggaccaaccgtattccgtgttacc

SEQ ID NO: 110824 - DNA, 571 bp, Homo sapiens
  misc_feature: GYAE6OF02F6GFO.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtccatcaaggttcagtggcgccggatcgtgggacagaattcactctcaccatcagcgggctccgagtctgaggactcgtgctaactttattactcgaccaacaaattatagtattaattttacttctacctacgtccgtttccggaccgtacgggggtaaccctaaggggttacggtaaacggttcgaaaggtacccggaaacgttggtacgggccgttcggaccaacccgtacttaccgttcgttacccg

SEQ ID NO: 110825 - DNA, 532 bp, Homo sapiens
  misc_feature: GYAE6OF02IKT4K.26.23.C01.1.454.CMB.1.raw
  modified_base (230)..(230): a, c, t, g, unknown or other
  misc_feature (230)..(230): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagngtattggtaggtggttggcctggtatcagcagaaccaggaacaatccctaagatacctaatctctcgaggctcgtggtttaggaaagtggggtcccagtcaaggttcagtggcgccggatcgtaggacagaattcactcacacatcagcggctccagtctgacgactctgactaactttatactgaccaaacaatatagattattttatctacgagtcgtcggaccgacgggaaccgtaggtaggaacgtcgaaaggcgtaacgttggtacggctaggaccaccgtacttccgtagttaccg

SEQ ID NO: 110826 - DNA, 592 bp, Homo sapiens
  misc_feature: GYAE6OF02JCSAV.26.23.C01.1.454.CMB.1.raw
  modified_base (427)..(427): a, c, t, g, unknown or other
  misc_feature (427)..(427): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttcgccgggcagtcagagtagttggtaggtggttggccgtggtatcagcagaaccaggaacaacgtacctaagactacctaatcctactcaagcgtctagggtttagaaacggttgggtaccctagtactaaggtcaggtggacgccggtagtcgtagggactagtacttcactctcaccatcgaggcggctaccgatcgtgacgtactcgtanctaactttacttactacgaccaaataacgttatgttaaactttacgtttattcccgaccttagtcccggttacggaccgaacggggtaaccgtagggttaggaacggtcgaaggtaccgaacggttgttacggcgttaacgccgtaacctattcgtacgtttacc

SEQ ID NO: 110827 - DNA, 617 bp, Homo sapiens
  misc_feature: GYAE6OF02GRNN4.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttcggccgggcagtcagagtagttggtaggtggttggcctggtatcagcagaaaccaggaacaatccctaaagactacctaatctctcgaggcgttcgtgggtttaggaaaggttcggggtacccagttcgaaggttcaggtcggcgccggtagttcgaggggacaggtaattcactctaccactagtcgacggccgggtactcgtagtcgtaggacggtactcgtacgtaccttaactttagttactacgaccaaactaattagtagttaatttacttttacttcgtacctacggttccgtttccggaccggtaacgggggaacgtaacgggttaggtaaacgtcgtaaaggtaccgtaacggtggttacgggactacgacctaccgtacttccgtgttaccc

SEQ ID NO: 110828 - DNA, 623 bp, Homo sapiens
  misc_feature: GYAE6OF02GI42W.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtcctccttccaggctgtctgcatctgtcggagacagagtcaccatcacttcgccggccagtcagtagtagttgggtaggtggttcggcgtggtatcagcaagaaacaggaacaatccctaaagactacctaatctactcgaggtcgttcgttaggtttagggaaaggtcggggtacccagtacgtaaggttcgaggtggccgacggtatcgtacgggacagtaactcactactcaccatcgaggtccgggctccgtacgtcgtacgacgtacctcgtacgacttaaactttacttacgtacaacctaaacaattatagtaattactttacttccgtacgtacgttccggttacggaccggaggggtaaaaaaccgtgggttaacggtaaggtaacgtaacgtaccggtaacgttacggtaggtaccgtcggtaccctaacgtactacgttagttccc

SEQ ID NO: 110829 - DNA, 490 bp, Homo sapiens
  misc_feature: GYAE6OF02JVXF5.26.23.C01.1.454.CMB.1.raw
  modified_base (393)..(393): a, c, t, g, unknown or other
  misc_feature (393)..(393): n is a, c, g, or t
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
tcagagactatactcacgaccggtgctcgatttagtacacgtgattagggattgggggagtcagacccagtcaggacacagcatggacatgagggtcccgctcagctcctggggctcctgctgctctggctcccaggtgtcaaatgtgacatccagatgacccagtctccttccaggctgtctgcatctgtcggagacagagtcaccatcacttgccgggccaagtcagagtattggtaggtggttggcctggtatcagcagaaaccaggaacaatccctaagatacctaatctctcaggcgtctggttagaagtgggtccatcgaagttcagtggcgccggatcgtgggacagaattcaacttcacacatcagcggctcgagtctgagactntcgataacttatactgaccaaacaatactgaatatttatctcagtcgtcgcgaggaccaggtgaacgtcaagcgtaactgtgctgctacgntcgntc

SEQ ID NO: 110830 - DNA, 667 bp, Homo sapiens
  misc_feature: GYAE6OF02ICI5B.26.23.C01.1.454.CMB.1.raw
  modified_base (127)..(127): a, c, t, g, unknown or other
  misc_feature (127)..(127): n is a, c, g, or t
  modified_base (189)..(189): a, c, t, g, unknown or other
  misc_feature (189)..(189): n is a, c, g, or t
tcagagactatactcacgaccggtgctcgatttagtacacgtgattagggagttgggggagtcgagacccagtcaggacacagcatggacatgaggtccccgctcagctcctgggctcctgctgctntggctcccaggtgtcaaatgtgacatccagatgacccagtctccttcaggctgtctgcatcngtcggagacagagtcaccatcacttggccggcagtcagagtattggtaggtggttgctggtatcagcagaaaccaggaacaactacccaagtactactaactactctacgtacgcgttacgttggtttaggaaagggtttcggggtacccctagttacgtaagggttaccgtaaggttcggccggtccggaatttcccggtagggtaaccgtaaggtaactttacgaaaccgttccactaacctacgtacgtacgcgggtaaccttccgactcgtaggacgtactctgaccgttaactttagtaacctcgaacctaacgaattaactgtaagtttactttacttccgtactaggtcccgttacggtacccggtaaagggtacccgaagggttcggtaaagtacccggtaaaggtaacccgtaaaggttcgtttacgggaccgtggtaaccgtaccccggtaattccgttaccggttcc

SEQ ID NO: 110831 - DNA, 674 bp, Homo sapiens
  misc_feature: GYAE6OF02F0ILE.26.23.C01.1.454.CMB.1.raw
  modified_base (249)..(249): a, c, t, g, unknown or other
  misc_feature (249)..(249): n is a, c, g, or t
  modified_base (293)..(293): a, c, t, g, unknown or other
  misc_feature (293)..(293): n is a, c, g, or t
  modified_base (362)..(362): a, c, t, g, unknown or other
  misc_feature (362)..(362): n is a, c, g, or t
  modified_base (387)..(387): a, c, t, g, unknown or other
  misc_feature (387)..(387): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctccaggtgtcaaatgtgacatccagatgacccagtctcctccaggctgtctgcatctgtcggagacagagtcaccatcacttgccggcagtcagagtatggtaggtggtggctggtancagcaagaacagaacaatcctaagacctactactcctactacgnggtcgtgttaggtaaggtacggtccggtacagtacgtagtcgtaggcggacggaccgtgtaggacgganaagtactactacctacaccactacncggacggtccgtactactgtacgtagggaccttacgtaccgacttaaccttaacgtttacgtaacgacccgtaaaccttaagttaacttaagttactttaaactttttaaccgtttactttaccctaacggttaccggttcccgggtaaaccggaccggggtaaaccggggtaagttaccgggtaacggaaccggttaaccgaaccgggttaacttaccgggtacggggtactacccggttcggaaaccccgttacggtttaaccttaccggtttacccgtttaccc

SEQ ID NO: 110832 - DNA, 654 bp, Homo sapiens
  misc_feature: GYAE6OF02HYFHF.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtcctccttccaggctgtctgcatctgtcggagacagagtcaccatcacgttcgcccgggcagtcagagtattgggtaggttggttggccgtggtatcgagcaagaaaccaggaaccaactaccctaaagattacctaatctcgtacgacggcgttcgtgggtttacggaaaggttcgggtacccagtaccgtaaggttacgaggtcggccggcggacttcggtacggaacgaacgtaacgttccaactccgtaccaacctacgtcgacggccgggtactaccgagtcgtaggacggacttccgtagaccttaaacgtttacttaccgtacgtaacccaaactaaactataagttaactttattttaccttacctaccgtacgttaccggttaccgggacccggtaaggggtaaccaaggggttacgaaggttaacgaacggacgtaacgttggacgtcgtacgaccaccgtacttacgttgttacccg

SEQ ID NO: 110833 - DNA, 609 bp, Homo sapiens
  misc_feature: GYAE6OF02GM5FF.26.23.C01.1.454.CMB.1.raw
  modified_base (428)..(428): a, c, t, g, unknown or other
  misc_feature (428)..(428): n is a, c, g, or t
tcagagactatactcacgaccggtgctcgatttagtacacgtgattagggattgggggagtcagacccagtcaggacacagcatggacatgagggtccccgctcagctcctgggctcctgctgctctggctcccaggtgtcaaatgtgacatccagactgacccagtcctccttccaggctgtctgcatctgtcggagacagagtccaccatcacttcggccggccagtcagtagtagttggtagtggttggcctggtatcagcagaaaccaggaactaatcccgtaaagactacctaatcctctacgaggtcgtcgtgggtttaggaaaggttcggggtacccagtctaaaggtttcaggtggccgccggtatcgtaggactagtaactttcacgtctccaaccgtatcgacggtcgggccttccgngttacgtggacggtactccgtcgacttaaactttcttacgacgacctaaactaattatagttaatttaattttcttccctacgtacgttcgttaccggtaaccgagggtaccagggttacgaacgtacgaacgtacggtaagttcggtacggacgttcgacctacctgttacttgttaccg

SEQ ID NO: 110834 - DNA, 870 bp, Homo sapiens
  misc_feature: GYAE6OF02JLIVG.26.23.C01.1.454.CMB.1.raw
  modified_base (198)..(198): a, c, t, g, unknown or other
  misc_feature (198)..(198): n is a, c, g, or t
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtccgccatcctcactgtctgcctctgtagganacagagtccaccatcacttggtcgggcgagtcgagggctaagttacgcgttattttttacgccgttggtttccgaagtcaacgaaaccgaagggaaccgaccccctaagtcccgtagactactatcgactcgtccgtaccttagtttaacggagggttaggaccgtacccgtagttacgtaacggtttccaaggccggtacgtaggtaggtacgttaccggtagggaacgtaaggtacgtttaccaacctttaccgtaacctaaccgtaacgttacccgaacggtaccgtaacccggtccttacggaccgtaaccggttccgttaacgggtaacggtttaccgttttcggtaaacccgttaaaccgttttaacgtttaacccggtacgtaaccccgttaagggtaaccgttaaacgtttaaacgttaaacgtttaacccggtttaacccttttaaaacccccgttaagtttacccccggttaaaccccggggttttacccggggggaaccccgggggttaacccgttaaccggggtacccgggtttaaaaccgggtaaaaaacccggtttaaaacccggttaaccgggttaccggtttaccgggaacccgtttaccggtaacccccggtaaaaccgttaccggttttaccccgttacggttttaacccccgg

SEQ ID NO: 110835 - DNA, 671 bp, Homo sapiens
  misc_feature: GYAE6OF02H30YA.26.23.C01.1.454.CMB.1.raw
  modified_base (126)..(126): a, c, t, g, unknown or other
  misc_feature (126)..(126): n is a, c, g, or t
  modified_base (535)..(535): a, c, t, g, unknown or other
  misc_feature (535)..(535): n is a, c, g, or t
  modified_base (638)..(638): a, c, t, g, unknown or other
  misc_feature (638)..(638): n is a, c, g, or t
tcagagactatactcacgaccggtgctcgatttagtacacgtgattagggagttgggggagtcagacccagtcaggacacagcatggacatgagggtccccgctcagctctgggctctgctgctcnggctcccaggtgtacaaatgtgaccatccagatcgaccctagtctccttacccgaggtctcgtctgctatctgtcggacgacaggatcaccatcacgttcggcggccagtcagagtagttggtaggtcggtgcgtgtatcgagcaagaaacgagtaaacaacttacgaacgaactacctaaactctactacgacgcgttacttgggttacggtaaaggtccgggtactacgacgttaacgtacgacggttcggcggtacggtacgttacggcgggtaaacaaggtttaaactccgtacttacccgtactaaccgtaacgttacggacccgtccggggtaccctacggtaacgttacacgggtaccgtactccgtaacgttacgaacttttaacctagtaccaactaaanaactagttagtaactttattacgttcctacgtagtccgtcggtaaccgtagggaccggagtaacggtagtaaaccggtaaggacctacggttaggtaccggtnaccgttacgaacgttctaccggttagttaaccc

SEQ ID NO: 110836 - DNA, 778 bp, Homo sapiens
  misc_feature: GYAE6OF02JK7SG.26.23.C01.1.454.CMB.1.raw
tcagagactatactcacgaccggtgctcgatttagtacacgtgattagggattgggggagtcagacccagtcaggacacagcatggacatgagggtcccgctcagctccgtgggctcctgctgctcgtggctccaggtcgtcaaatgtgacatccagtactcgaccctagtcctcctaccgaggtctgtctagctatcgtagtcggagtacagtacgtccaactatacctccgtacggaccggtctacggtacaagttgttacggttagggttagggttcggtccggtcgttacggttacgtcggtaacgtacgaaacggtaaacccgaggtaaacctaacgtacccgtaagtaccttaaccttacgtaccgtacgtacggtacggttccgtttacggtttagggttaacgggtaacgggttccggtaacgttaccgttaacgggttaacggttacgtacggggtaaccggtccgggttaccgtaaccggtttacgaaacgggtacgttaacggttaacgttaccgtcttaccgtaaccgactacggtacgtacggtacggtaccgtcggtacgtacggtacggtacggtaccgtacgtacgtaaccgttacttacgtacgtacgtaacgtaactacgttaagttacgttacgttacttacgttacgtacgttacgtaccggtacggtacggtacgggtaacggtacggtacgtaacggtcggtaacgtacggtacgtacgtacgtacgtcgtaccgtacggtctacggttcttaccg

SEQ ID NO: 110837 - DNA, 870 bp, Homo sapiens
  misc_feature: GYAE6OF02HLP2W.26.23.C01.1.454.CMB.1.raw
  modified_base (143)..(143): a, c, t, g, unknown or other
  misc_feature (143)..(143): n is a, c, g, or t
  modified_base (187)..(187): a, c, t, g, unknown or other
  misc_feature (187)..(187): n is a, c, g, or t
tcagagactatactcacgaccggtgctcgatttagtacacgtgattagggattgggaggcgtggtccagcctgggggctccctgagactctcctgtacaacgtctggattcaacttcaattattatgttctacactgggtccncgaggctccaggcaaggggctggagtgggtggcaggtatgtcanatgatcggattcagtagatacctacgagttacgaccgttccggtagaaacggggccctaattcccggaacctacgtccgttaaccaggtaacgtaccgttttaccggaagaaacctaaccttaactttaaaagtaccgttaggtaaaaacttaaacgttcgtagtaacgtaaagtccggacgtaaccgtccggggttaccgtttttaattttcggtcggtacggaggtaacgggtacggggtaactagggtacgaccgggtacgacgggttccctaccgggttacctttacggtaccctaacgggtcgggggaaccctacggggtaaccccttcggggtaccttaaccccggtcgttaccctacgtaccgtacccgtttacccgaaaccggtaccgggtacccgtcgttacccggttaccctttcccccggtcgggtaccgtccccgtaggtcccgttaccgacggtaaccgtcctaaccggtcccggtaacgaccgtaccgaacggtaccggaccgggtccgtcgggttaccgcggttaacccggttgggtaacccgtaaacgggttaccgtttaccgtaaccggttacgtttaacggttacgttaccgttaccggtaaccgggtccgggtaacggttccggtaacgggtaccgttacgggggtaccctaggtaccgtaggg

SEQ ID NO: 110838 - DNA, 691 bp, Homo sapiens
  misc_feature: GYAE6OF02FW1FT.26.23.C01.1.454.CMB.1.raw
  modified_base (197)..(197): a, c, t, g, unknown or other
  misc_feature (197)..(197): n is a, c, g, or t
  modified_base (684)..(684): a, c, t, g, unknown or other
  misc_feature (684)..(684): n is a, c, g, or t
tcagagactatactcacgaccggtgctcgatttagtacacgtgattagggattgggggagtcagacccagtcaggacacagcatggacatgagggtccccgctcagctcctgggctcctgctgctctggctcccaggtgtacaaatgtgacatccagatgacccagtctccttccaggctgtctgcatctgtcgganacgagacgtcaccatcacgttcgccgggcagtcaagagtagttggtaggtggttggcttggtatcgagcaacggaaaccaaggaaacctaactaccctaaagtactaccttaacttcctacctacgacggtcgttcggttagggtttaaggaacgggttccggggtaccctagtacctaacgggttcaggtcgggcgtaccggtattcggtacggaactaacgtaactttccgaactcccgtacaaccctacgtaccgacgggaccggtcctaccgtacgtcgtacgtacgggtacctcgtacgtaccttaaacgttacttaccgtacgtaaccctaaacgtaacttacgttacgtaatttacgttttacttccgtacgtacgtccggttaccggaccggaacgggtaccgtaggggtacggaaccgtacggtaacggtaaccgtacgttaccggtacgtccgacgtacccgaccttacgtccgttnttacccg

SEQ ID NO: 110839 - DNA, 722 bp, Homo sapiens
  misc_feature: GYAE6OF02IH58E.26.23.C01.1.454.CMB.1.raw
tcagagactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtcctccttccgaggctgtctgcattctgtcggagacagagtcaccatcacgttggcccgggccagtcagtagtagttgggtaggttggttcggtccgtggtatcgagcgaagaaaccgaaggaacaactaccctaagtactacctaacttctctcgaggtcgttgttagggttaggaacggttcgggtacctagttacgtaaggtttcgaggtcgggcggaccggtagttccggtaggggtacaacggtaactttccgtaccttaccgtaccaacccgtagttaccgacgggtaccgggtcccttacggaccggttcgttagggaaccgtaccgttccgttacgtaacccgttaaactttttacgtaccgtaaccgtaaacctaaaagtaactttaacgttaggttaactttttaaactttacctttccgaccgttaacggttcccgggttaaccgggacccggtacggggaaccgtaagggtaccggtaaggtacgtaaccggtacgtaaccgttgggacgtccgtacgacccgtcgtagttccgttagtttccc

SEQ ID NO: 110840 - DNA, 160 bp, Homo sapiens
  misc_feature: GYAE6OF01A70K9.51.47.E03.1.454.CMB.1.raw
  modified_base (160)..(160): a, c, t, g, unknown or other
  misc_feature (160)..(160): n is a, c, g, or t
tcagcgatcgtatacacgaccggtgctcgatttagactcgcgcacagagagaagggcacgaccggtgctcgatttagagtgctacgaagggaaagggcagcgtcactctgttcccgccctcctctcgtagcactctgagcgggctggcaaggcgcatagn

SEQ ID NO: 110841 - DNA, 158 bp, Homo sapiens
  misc_feature: GYAE6OF01CT8F7.51.47.E03.1.454.CMB.1.raw
  modified_base (158)..(158): a, c, t, g, unknown or other
  misc_feature (158)..(158): n is a, c, g, or t
tcagcgatcgtatacacgaccggtgctcgatttagactcgcgcacagagagaagggcacgaccggtgctcgatttatccacgcccagagctcgaaaacacctttcatcttcccgccatctgatcgtagcactctgagcgggctggcaaggcgcatagn

SEQ ID NO: 110842 - DNA, 174 bp, Homo sapiens
  misc_feature: GYAE6OF01ELTSE.51.47.E03.1.454.CMB.1.raw
  modified_base (158)..(174): a, c, t, g, unknown or other
  misc_feature (158)..(174): n is a, c, g, or t
tcagcgatcgtatacacgaccggtgctcgatttagactcgcgcacagagagaagggcacgaccggtgctcgatttatccacgcccagagctcgaaaacaccgttcatcttcccgccatctgatcgtagcactctgagcgggctggcaaggcgcatagnnnnnnnnnnnnnnnnn

SEQ ID NO: 110843 - DNA, 158 bp, Homo sapiens
  misc_feature: GYAE6OF01DL9TI.51.47.E03.1.454.CMB.1.raw
  modified_base (158)..(158): a, c, t, g, unknown or other
  misc_feature (158)..(158): n is a, c, g, or t
tcagcgatcgtatacacgaccggtgctcgatttagactcgcgcacagagagaagggcacgaccggtgctcgatttatccacgcccagagctcgaaaacaccgttcatcttcccgccatctgatcgtagcactctgagcgggctggcaaggcgcatagn

SEQ ID NO: 110844 - DNA, 159 bp, Homo sapiens
  misc_feature: GYAE6OF01C1YVJ.51.47.E03.1.454.CMB.1.raw
  modified_base (158)..(159): a, c, t, g, unknown or other
  misc_feature (158)..(159): n is a, c, g, or t
tcagcgatcgtatacacgaccggtgctcgatttagactcgcgcacagagagaagggcacgaccggtgctctatttatccacgcccagagctcgaaaacaccgttcatcttcccgccatctgatcgtagcactctgagcgggctggcaaggcgcatagnn

SEQ ID NO: 110845 - DNA, 168 bp, Homo sapiens
  misc_feature: GYAE6OF01DG56B.51.47.E03.1.454.CMB.1.raw
  modified_base (159)..(168): a, c, t, g, unknown or other
  misc_feature (159)..(168): n is a, c, g, or t
tcagcgatcgtatacacgaccggtgctcgatttagactcgcgcacaggagagaagggcacgaccggtgctcgatttatccacgcccagagctcgaaaacaccgttcatcttcccgccatctgatcgtagcactctgagcgggctggcaaggcgcatagnnnnnnnnnn

SEQ ID NO: 110846 - DNA, 161 bp, Homo sapiens
  misc_feature: GYAE6OF01EM29J.51.47.E03.1.454.CMB.1.raw
  modified_base (160)..(161): a, c, t, g, unknown or other
  misc_feature (160)..(161): n is a, c, g, or t
tcagcgatcgtatacacgaccggtgctcgatttagactcgcgcacagagagaagggcacgaccggtgctcgatttagagtgctacgaagggaaagggcagcgtcactctgttcccgccctcctctcgtagcactctgagcgggctggcaaggcgcatagnn

SEQ ID NO: 110847 - DNA, 159 bp, Homo sapiens
  misc_feature: GYAE6OF01C8A3Q.51.47.E03.1.454.CMB.1.raw
  modified_base (158)..(159): a, c, t, g, unknown or other
  misc_feature (158)..(159): n is a, c, g, or t
tcagcgatcgtatacacgaccggtgctcgatttagactcgcgcacagagagaagggcacgaccggtgctcgatttatccacgcccagagctcgaaaacaccgctcatcttcccgccatctgatcgtagcactctgagcgggctggcaaggcgcatagnn

SEQ ID NO: 110848 - DNA, 160 bp, Homo sapiens
  misc_feature: GYAE6OF01AFRWK.51.47.E03.1.454.CMB.1.raw
  modified_base (158)..(160): a, c, t, g, unknown or other
  misc_feature (158)..(160): n is a, c, g, or t
tcagcgatcgtatacacgaccggtgctcgatttagactcgcgcacagagagaagggcacgaccggtgctcgatttatccacgcccagagctcgaaaacaccgttcatcttcccgccatctgatcgtagcactctgagcgggctggcaaggcgcatagnnn

SEQ ID NO: 110849 - DNA, 183 bp, Homo sapiens
  misc_feature: GYAE6OF01BOSCJ.51.47.E03.1.454.CMB.1.raw
  modified_base (78)..(78): a, c, t, g, unknown or other
  misc_feature (78)..(78): n is a, c, g, or t
  modified_base (101)..(101): a, c, t, g, unknown or other
  misc_feature (101)..(101): n is a, c, g, or t
  modified_base (131)..(131): a, c, t, g, unknown or other
  misc_feature (131)..(131): n is a, c, g, or t
  modified_base (162)..(183): a, c, t, g, unknown or other
  misc_feature (162)..(183): n is a, c, g, or t
tcagcgatcgtatacacgaccggtgctcgatttagactcgcgcacagaggagaagggcacgaccggtgctcgatttanccacgcccagacgctcgaaaacnccgttcatccttcccgccatctgatcgtancactctgagcgggctggacaaggcgcatagnnnnnnnnnnnnnnnnnnnnnn

SEQ ID NO: 110850 - DNA, 157 bp, Homo sapiens
  misc_feature: GYAE6OF02IJITW.51.47.E03.1.454.CMB.1.raw
  modified_base (157)..(157): a, c, t, g, unknown or other
  misc_feature (157)..(157): n is a, c, g, or t
tcagcgatcgtatacacgaccggtgctcgatttagactcgcgcacagagagaagggcacgaccggtgctcgatttatccacgcccagagctcgaaacaccgttcatcttcccgccatctgatcgtagcactctgagcgggctggcaaggcgcatagn

SEQ ID NO: 110851 - DNA, 166 bp, Homo sapiens
  misc_feature: GYAE6OF02J1WAO.51.47.E03.1.454.CMB.1.raw
  modified_base (159)..(166): a, c, t, g, unknown or other
  misc_feature (159)..(166): n is a, c, g, or t
tcagcgatcgtatacacgaccggtgctcgatttagactcgcgcacagagagaagggcacgaccggtgctcgatttagctgtgcgtcgaaggaagggcagcgtcactctgttcccgccctcctctcgtagcactctgagcgggctggcaaggcgcatagnnnnnnnn

SEQ ID NO: 110852 - DNA, 157 bp, Homo sapiens
  misc_feature: GYAE6OF02F2UDG.51.47.E03.1.454.CMB.1.raw
  modified_base (156)..(157): a, c, t, g, unknown or other
  misc_feature (156)..(157): n is a, c, g, or t
tcagcgatcgtatacacgaccggtgctcgatttagactcgcgcacagagagaaggcacgaccggtgctcgatttatccacgcccagagctcgaaacaccgttcatcttcccgccatctgatcgtagcactctgagcgggctggcaaggcgcatagnn

SEQ ID NO: 110853 - DNA, 157 bp, Homo sapiens
  misc_feature: GYAE6OF02G7ZMG.51.47.E03.1.454.CMB.1.raw
tcagcgatcgtatacacgaccggtgctcgatttagactcgcgcacagagagaagggcacgaccggtgctcgatttatccacgcccagagctcgaaaacaccgttcatcttcccgccatctgatcgtagcactctgagcgggctggcaaggcgcatag

SEQ ID NO: 110854 - DNA, 157 bp, Homo sapiens; identical to SEQ ID NO: 110853
  misc_feature: GYAE6OF02GAT4G.51.47.E03.1.454.CMB.1.raw

SEQ ID NO: 110855 - DNA, 160 bp, Homo sapiens; identical to SEQ ID NO: 110848
  misc_feature: GYAE6OF02JB7V1.51.47.E03.1.454.CMB.1.raw
  modified_base (158)..(160): a, c, t, g, unknown or other
  misc_feature (158)..(160): n is a, c, g, or t

SEQ ID NO: 110856 - DNA, 159 bp, Homo sapiens
  misc_feature: GYAE6OF02HJYPD.51.47.E03.1.454.CMB.1.raw
  modified_base (158)..(159): a, c, t, g, unknown or other
  misc_feature (158)..(159): n is a, c, g, or t
tcagcgatcgtatacacgaccggtgctcgatttagactcgcgcacagagagaagggcacgaccggtgctcgatttatccacgcccagagctcgaaaacaccgttcatcttcccgccatctgatcgtagcactctgagcgggctggcaaggcgcatagnn

SEQ ID NO: 110857 - DNA, 157 bp, Homo sapiens; identical to SEQ ID NO: 110853
  misc_feature: GYAE6OF02FJV0D.51.47.E03.1.454.CMB.1.raw

SEQ ID NO: 110858 - DNA, 177 bp, Homo sapiens
  misc_feature: GYAE6OF02IB0D6.51.47.E03.1.454.CMB.1.raw
  modified_base (77)..(77): a, c, t, g, unknown or other
  misc_feature (77)..(77): n is a, c, g, or t
  modified_base (157)..(177): a, c, t, g, unknown or other
  misc_feature (157)..(177): n is a, c, g, or t
tcagcgatcgtatacacgaccggtgctcgatttagactcgcgcacagagagaagggcacgaccggtgctcgatttanccacgcccagagctcgaaacaccgttcatcttccgccatctgatcgtagcactctgagcgggctggcaaggcgtcatagnnnnnnnnnnnnnnnnnnnnn

SEQ ID NO: 110859 - DNA, 269 bp, Homo sapiens
  misc_feature: GYAE6OF01CKRA4.13.1.A01.1.454.CMB.1.raw
  modified_base (267)..(269): a, c, t, g, unknown or other
  misc_feature (267)..(269): n is a, c, g, or t
tcagtcacgtactacacgaccggtgctcgatttagacgtctcatcagggttcagtggaagtggatctgggacagattttactttcaccatcagcagcctgcagcctgaagatattgcaacatattactgtcagcagtatgataatctcccgatcaccttcggccaagggacacgactggagattaaacgaactgtggctgcaccatctgtcttcatcttcccgccatctgatagtacgtgactgagcgggctggcaaggcgcatagnnn

SEQ ID NO: 110860 - DNA, 527 bp, Homo sapiens
  misc_feature: GYAE6OF01CN7US.13.1.A01.1.454.CMB.1.raw
  modified_base (489)..(489): a, c, t, g, unknown or other
  misc_feature (489)..(489): n is a, c, g, or t
tcagtcacgtactacacgaccggtgctcgatttagacgtctcatcaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaacttttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctagacatctgacgacacggccatatattactgtgcgagaaggacggttttgggcgcggactcctcttgagntgtggggccaggggacagtggtcaccgtctcttcgacg

SEQ ID NO: 110861 - DNA, 220 bp, Homo sapiens
  misc_feature: GYAE6OF01CBCTW.13.1.A01.1.454.CMB.1.raw
  modified_base (217)..(220): a, c, t, g, unknown or other
  misc_feature (217)..(220): n is a, c, g, or t
tcagtcacgtactacacgaccggtgctcgatttagacgtctcatcagggtggaggctgaggatgttgggatttattactgcatgcaagctacattctggcctttcactttcggccctgggaccaaagtggataccaatcgaactgtggctgcaccatctgtcttcatcttcccgcatctgatagtacgtgactgagcgggctggcaaggcgcatagnnnn

SEQ ID NO: 110862 - DNA, 221 bp, Homo sapiens
  misc_feature: GYAE6OF01B90XR.13.1.A01.1.454.CMB.1.raw
  modified_base (218)..(221): a, c, t, g, unknown or other
  misc_feature (218)..(221): n is a, c, g, or t
tcagtcacgtactacacgaccggtgctcgatttagacgtctcatcagggtggaggctgaggatgttgggatttattactgcatgcaagctacattctggcctttcactttcggccctgggaccaaagtggataccaatcgaactgtggctgcaccatctgtcttcatcttcccgccatctgatagtacgtgactgagcgggctggcaaggcgcatagnnnn

SEQ ID NO: 110863 - DNA, 501 bp, Homo sapiens
  misc_feature: GYAE6OF01DZIWX.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaacacagactatggacagaacctcagggcagattcacatgacgacagacacatacacgaacacagcctacatggaggtgaggagcctgagatatgacgacgacggccgtgttattagttgtgcgagtagtgggtagtggcaggtggatagtcgaactaaattactatataacg

SEQ ID NO: 110864 - DNA, 219 bp, Homo sapiens
  misc_feature: GYAE6OF01ES0BM.13.1.A01.1.454.CMB.1.raw
  modified_base (218)..(219): a, c, t, g, unknown or other
  misc_feature (218)..(219): n is a, c, g, or t
tcagtcacgtactacacgaccggtgctcgatttagacgtctcatcagggtggaggctgaggatgttgggatttattactgcatgcaagctacattctggcctttcactttcggccctgggaccaaagtggataccaatcgaactgtggctgcaccatctgtcttcatcttcccgccatctgatagtacgtgactgagcgggctggcaaggcgcatagnn

SEQ ID NO: 110865 - DNA, 556 bp, Homo sapiens
  misc_feature: GYAE6OF01ELZ8V.13.1.A01.1.454.CMB.1.raw
  modified_base (443)..(443): a, c, t, g, unknown or other
  misc_feature (443)..(443): n is a, c, g, or t
  modified_base (479)..(479): a, c, t, g, unknown or other
  misc_feature (479)..(479): n is a, c, g, or t
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagtctatcttatcagcgtggtgcgacacggcccctggacgaggactcgagtggagtgggatggatcgacgtacccttaacgaaacggaaacacgagtactagtcggaacaacgaacctccgagggcagtactcacagtcgacgacagacacatacacgaacacagacctacagtggagtgaggacgcgaganatagtagacgacgacggtaccgtagtagttagttgngtacggagtacggtagggtacgttgggacgtaggtgggtaatacgtacgaaacttaaatttactacgttagttaacg

SEQ ID NO: 110866 - DNA, 539 bp, Homo sapiens
  misc_feature: GYAE6OF01BE6HX.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggcttctggttacacctttagcagctatcttatcagctgggtgcgacacggcccctggacgaggactcgagtggagtgggatggatcagacccttacgaacggaacacagactagtagacacgacctcgagggcagactcacatgacgacagacacatacacgaacacacgacctacagtggaggtggaggacgccgtagagtatagagaacgacgtacggtccgttagtagtttagtgtagacgtagaggtgggagtggacgtggtaggattacgacggtaataaacgtttactaacgttagttaacg

SEQ ID NO: 110867 - DNA, 574 bp, Homo sapiens
  misc_feature: GYAE6OF01CT5U9.13.1.A01.1.454.CMB.1.raw
  modified_base (273)..(273): a, c, t, g, unknown or other
  misc_feature (273)..(273): n is a, c, g, or t
  modified_base (351)..(351): a, c, t, g, unknown or other
  misc_feature (351)..(351): n is a, c, g, or t
tcagtcacgtactacacgaccggtgctcgatttagacgtctcatcaggggacccaaaaaccacaccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgagatctcctgcaaggcttctggttacacctttagcagcttatcttatcagcgtgggtcncgacacggcccctgggacgaggacctcggagtggagtggggatgggatcacgtccctacgaaacgaacacagactagnggaacacgaaccctcgagggacagacttcaacctatacggacgacaacgacaccaactaacaaccgaacaacagcctaagagtaggaggtgaaggacgctaggacgtatacgtaggaacgacgcggtcgttagttagttgttacggtgacggtggacggttgggtacggtgggcgaaggttggtagtacgtacgtaaacttacgttaaacgactttagtaacg

SEQ ID NO: 110868 - DNA, 631 bp, Homo sapiens
  misc_feature: GYAE6OF01BBEPU.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcgagtgaagtatctcctgcaaggcttctggttacacctttagcagctatcttatcagtcgtgggtcgcgacacggcccctggacgaggactcgaggtggagtgggatggactcgacgtacccttaacgaaacggaaacacgagactagtacggaaccagaaccctccgaacgggtcaagtacttaccaactagtacggacgaacacgaacacaactaaccgaacgaaacaaccagacctaacgagttagggaggtaggaacggagaccgtaggaagtagtacgtaacgaccgaacggaccgggtacggttagttaacgttagttggtaggtaccggaggtacgggtagggagggtggacggtaggtagggaattacggtacgtaaacgtaaacgtttaaccgttaaagttacgttaaacg

SEQ ID NO: 110869 - DNA, 652 bp, Homo sapiens
  misc_feature: GYAE6OF01DT1TK.13.1.A01.1.454.CMB.1.raw
  modified_base (276)..(276): a, c, t, g, unknown or other
  misc_feature (276)..(276): n is a, c, g, or t
  modified_base (396)..(396): a, c, t, g, unknown or other
  misc_feature (396)..(396): n is a, c, g, or t
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggcttcgtggttacacctttagcagctatcttatcagtctgggtcncgacgcggcccctggacgaggactcggagtggatggggatggatcgacgtaccccttaagaaaccggaaacacgaagactagtaggaacaacgtaacctcgaggcagtacttcgaacctntacgacgacaacgacaacaactaacaaccgaacaacacgacctaacgagtacgggtaacgtagaagggtacgtccgtagggaagtaagttaacgtacgggaaccgtaccggtaaccgggtacgttagtttaagttaacggttggttacgacgggtaacggtagggttaggggtacggtaggggaacgtacgggttaggtaaacgtaacgttaacggtaaacttaaaatttaccgtttaaacgttacgttaaacggg

SEQ ID NO: 110870 - DNA, 654 bp, Homo sapiens
  misc_feature: GYAE6OF01D6AFD.13.1.A01.1.454.CMB.1.raw
  modified_base (280)..(280): a, c, t, g, unknown or other
  misc_feature (280)..(280): n is a, c, g, or t
tcagtcacgtactacacgaccggtgctcgatttagacgtctcatcaggggacccaaaaaaccacacccctccttgggagaatcccctagatcacagctcctcaccatggactggacctggagcattcctttttcttggtggcagcagcaacaggtgcccactcccaggttcagctggtgcagtctgcagctgaggtgaagaagcctggggcctcagtgaagatctcctgcaaggtcttctggttacacctttagcagtctatcttatcagtcgtgggtcncgacgacggccccgtggacgaggtactcggagtcggagtgggatgggatcgacgtacccttaacgaaacggaacacgaacgtactagtcggaacacgaacctcgaacgggcaacgtctaccaactagtacgaaccgacaacgaaccaactaataaccaacgaaacacacgaacctagacgtgggaaggtggaaggccgtacgtaggaactagtaacgtacggaaccggaaccggtaccgggtacgtttacgttaaggtttaccgttaggtcggaacggtagggtagggttacgggaaggttcgggtacgtagggttaacggtattaaacgtaccgttaaaacttaaaagtttaccgttaacgttaagttaacgg

SEQ ID NO: 110871 - DNA, 802 bp, Homo sapiens
  misc_feature: GYAE6OF01CZORP.13.1.A01.1.454.CMB.1.raw
  modified_base (657)..(657): a, c, t, g, unknown or other
  misc_feature (657)..(657): n is a, c, g, or t
  modified_base (729)..(729): a, c, t, g, unknown or other
  misc_feature (729)..(729): n is a, c, g, or t
tcagtcacgtactacacgaccggtgctcgatttagacgtctcatcaggggacccaaaaaccacacccctccttgggagaatcccctagatcacagctcctcaccatggactggacctggagcattccttttctggtggcagcagcaacaggtgcccactcccaggttcagctggtgcagtctgcagctgaggtgaagaagccgtggggcctcgagtaggaagattcctcccgtagaccgtaaagggtcctttccgttagggtttaacctaacccgttttaggcctaaaggtcctttaacgttcctttaacgtccgtaaaggtccggttagggggttcgaccggaaccgtaaccggggtccccccgttagggggaacccgaaggggtaaccccttacgggaaggttaggggtagttacggggggtaaactttgggggaactttacccgaaccggttaacccccgtttaaaacggaaaaccggggtaaaaaccacggtaaacgtaacgttaacggtacgggtaaaccgaaccggtaaccccgttaccggaaggggacctaacggtaacttaccgaaccgtagtacgaacggaccaaggaaccacgtaactaaccgaacgaacacgacgtacctaacgagtacgggaaggtacgacgganacccgtaggaactaagttagacgaaccgtacgccggtccgtttagtattagtgagggacgaggtggtagggngttacgggacttagggtacggtaattacgtaaacccggtaaattaaagttttacctaagttaagttaaaccgg

SEQ ID NO: 110872 - DNA, 716 bp, Homo sapiens
  misc_feature: GYAE6OF01BWTVK.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcattccttttcttggtggcagcagcaacaggtgcccactccccaggttcagctggtgcagtctgcagctgaggtgaagaacgccgtgggcctcagtgaagatcctcctgcgaaggtcttcgtcggttactaccgtttagctagtcttattcctttaatcgacggtcgttgggtcgacgtaccgaccgggcccccgtagggaaccggacggtaccgtacggtaggtggacggttggggagtcggatccgaacgtccccttaaacgaaaccggtaaacacgagtaactagtacggaaccacgaacccgtcggaaggcaagtactaccactagtacgacgtaacaacgactaaccaactaaccgaacccgaaacaacctaaccggtaaccctaacgtacgggtagggtacgggttacgggaacggtaccggtaccgtaaggacgtaactaggtacggaaccgtaacggtaccggtacgtttaggttaactttacggtaggtacggtacggtaggtaccggggttaggtacgggtggtacggtacggtagtaacttaaggtacccgtaataaacctttacgttaacttaagttaaccgg

SEQ ID NO: 110873 - DNA, 838 bp, Homo sapiens
  misc_feature: GYAE6OF01DF218.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctgggagctattcctttttcttggtggcagcagcaacgaggtcgcccactccaggttcagctggtgcagtctgcagtcgtggaggtgaagaggccgtggggcctcgagtagaagtactcctcctgacgacggtcttcgtaggttaacctaccgtttagcgtagtcttacttcttacgtcgacgttcggttcggggtcgaccggtaaccggtacccgggtcccccggtaggggaaccggacggtaccgtacgggtaggttcgggaggttaggggacttggaaccttaccgaccgttaacccgtaaccgaaacggaactacggacgtaacgtacgtaacgggaccaaccggtaccgtacggaaccgggagtaaaccgttacgttacccgaactaacgggtacgaacgaacaaacggtaccctaacgtaaacgtaaccaaacccggaaaccctaacgaaccggttaccgtaaggtaacggggtacggggtaacgggtacgggtaacgggtaccggtacggttaaggaaccggttaacgtaacggtacccggtaaccggaacggggtttacccggtacggtttaagtttaacggtttacggtcggggttaaaccggtagggtaagggttaccgggttagggtcgggtagggtaacggtgggttaaccggttaaagttacgtaaaccgttaaacttaacttttaaccttaaggttaccggttaaacgg

SEQ ID NO: 110874 - DNA, 780 bp, Homo sapiens
  misc_feature: GYAE6OF01ETPVM.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcattcctttttcttggtggcagcagcaacaggtgcccactcccaggttcagctggtgcagtctgcagctgaggtgaagaagccgtggggcctcagtgaagatctcctgcaaggtcttcgttaggttactaccttttacgcagtctattcttatcgagtcgtgggtgcgacgacgccccgtaggacgaggacgtcggaggtcggagtgggagtggatccgacgtacccgttaaacgaaaccggaaactaacgaacgtaacgttaagtacggaaacgtaaccggaaacccgtaccggaagggacctaagtaacctttccaaccgagtacggaacgaactaacggaactaacgtaactaaccgaaacgaaacccaaccgttaacgaccctaaaccgaaggttacgggtaacgggtcgggaacgggacggtacccgtagggtaagtaacgtttaacggaacgggaaccggtaaccgggaaccggggtttacccggtttaaggttttaaccgtttaggttttacggtagggtaccggggtaaagggtaccgggtttagggggtaagggtttagggacggtagggttacgggtaaaaggtttaacggtaaccggttaaaactttaaaacggtttaaccttaaaacgtttaaggtttaaaacccgg

SEQ ID NO: 110875 - DNA, 754 bp, Homo sapiens
  misc_feature: GYAE6OF01DTI9F.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcattccttttcttggtggcagcagcaacaggtgcccactcccaggttcagctggtgcagtctgcagctgaggtgaagagccgtggggcctcgagtgaagtatcctcctgcaaggtccttcgttacggttacctaccgtttagcaggtcttattacttatcgagtcgttgggtcgccgaccgaccggtccccggtaggacggacggtacgtcggtaggtggaggtgggtagtggtactaccgtacgtaccccgttaaacgaaccgggaaacacggtaagtactaacggtacggaaccgtaaccgaaccgtaccgggtaaggacgtaagtacctaccgactaggaccgaacgtacgacacctaaccaacgtaaccgaaccgtaaccgtacgaaccgttaccgaacggtaggtacgggtaaggtacgggacggtacgtaccgggtaaggaacgttagtaacgtaaccgggaaccggtaaccggtccgggtttaaccggtttaagtttacgttaggtttacgggacgtaagggttacggtgggttaagggtcggttagggaacggtaggtaacggttacgtaacggttaaccgttaaacgttaaaccgttttacgttaaacgttaagttaacccggg

SEQ ID NO: 110876 - DNA, 710 bp, Homo sapiens
  misc_feature: GYAE6OF01A7MEJ.13.1.A01.1.454.CMB.1.raw
  modified_base (491)..(491): a, c, t, g, unknown or other
  misc_feature (491)..(491): n is a, c, g, or t
  modified_base (625)..(625): a, c, t, g, unknown or other
  misc_feature (625)..(625): n is a, c, g, or t
tcagtcacgtactacacgaccggtgctcgatttagacgtctcatcaggggacccaaaaaccacacccctccttgggagaatcccctagatcacagctcctcaccatggactggacctggagcattccttttcttggtggcagcagcaacaggtgcccactcccaggttcagctggtgcagtctgcagctgaggtagaagacgccgtggggcctcgagtgaacgatcctcctgacgaaggtcctttacgtcggtttaaccaccgttttagcgtaagtccttagttaccttatacgagtcgttgggacgacgtacgaccggtaccccgtaggaccggtaggaccgtacgtagggtaggaggtagggattacgggaatcgaaccggtaccctaaacggaaaccgtaacgaactacggaacgtagtaccggaacgtaacgaacccgtacggacgggtaactaacgttactacccaacgtaatacggaacccgaanacggaaacacaacgtaaccaaaccgtaacgacacgtaacctaagacgggtagggaacggagtacgggacgacctaggaacgacgttagaccgaacggtaccgtaaccggtgtttaacgtaacgtttagttaggnggaccgtaaggtaggttcgggagttagggacgtaggtagttaacacgttaacggaaactttaaagtaccttaagttacgtaacgg

SEQ ID NO: 110877 - DNA, 780 bp, Homo sapiens
  misc_feature: GYAE6OF01AUD98.13.1.A01.1.454.CMB.1.raw
  modified_base (356)..(356): a, c, t, g, unknown or other
  misc_feature (356)..(356): n is a, c, g, or t
  modified_base (683)..(683): a, c, t, g, unknown or other
  misc_feature (683)..(683): n is a, c, g, or t
  modified_base (715)..(715): a, c, t, g, unknown or other
  misc_feature (715)..(715): n is a, c, g, or t
tcagtcacgtactacacgaccggtgctcgatttagacgtctcatcagggacccaaaaccacacccctccttgggagaactccctagatcacagctcctcaccatggactcggacctggagctattccctttttcgttggtggcaggcagactaacgaggttcgcccaccgttccctaggtttccagcgtggtcgacagttctgcagtccgttggaagggtgaaaacgacggtccccggtgggggtaccctacgtaggtacggaaagctttcccgtccgttaaggaccgttaacgggtcccttttcgtttaaccgggttaccttaaccttttggaccagttaccttacttacgtttntacgtgtccggttggggtccgacggaccgaccggtccccggtagggacggtacggtacggtcgtaaggtcgggtagtgggaagtttcgggactaccgaccggtaccccgttaaacggaaacggaactaccgagtaacgtaagggtacgaacggaccgtaacccggtacgacgggtactaccggttaacttaccaacggtgtaccggtaagaccgaacgaaccgtaacgaactacggaactaacacgactacgaggtacgagaggtacggcgagtcgaagacgtacaagtccggaaccgtgtaacggtcgtaagttcgttcgggtacncgggttaggacgttagggtagagggtaccggngttacggtaggaaccgttaagtaaccggtaaactttacccttaaagttaccgtaagttaaccggg

SEQ ID NO: 110878 - DNA, 738 bp, Homo sapiens
  misc_feature: GYAE6OF01BFAMQ.13.1.A01.1.454.CMB.1.raw
  modified_base (154)..(154): a, c, t, g, unknown or other
  misc_feature (154)..(154): n is a, c, g, or t
  modified_base (369)..(369): a, c, t, g, unknown or other
  misc_feature (369)..(369): n is a, c, g, or t
  modified_base (428)..(428): a, c, t, g, unknown or other
  misc_feature (428)..(428): n is a, c, g, or t
  modified_base (504)..(504): a, c, t, g, unknown or other
  misc_feature (504)..(504): n is a, c, g, or t
  modified_base (670)..(670): a, c, t, g, unknown or other
  misc_feature (670)..(670): n is a, c, g, or t
tcagtcacgtactacacgaccggtgctcgatttagacgtctcatcaggggacccaaaaaccacacccctccttgggagaatcccctagatcacagctcctcaccatggactggacctggagcatcctttttctggtggcaggcagcaacaggtncccactcccaggttcagctggtgcagtctgcagctaggaggtagaagaacggccgtggggccctagaggtacgaatactccgtacctagactaaggtctttacgtacggttacctaacgtttaggacctaggactttaactacgttaagtcgtaacggtcgttagggtacgccggtaacgaccgggtacccccgtaagggacggaacggtaccgnggtaacggtggagtgggacgtaggaagtacaccggttaaccgttaacgaaaaccgtaanacgtaaccgaagttacgaacggaacctaacgtaccgcgaacggggtacaacgtactacgaacgtgtacgaaccganaacgaacaacaacgaacctaacgaacaacgtacaacccgtagagtacgggtaacgtaggtaaccggagacgttaacggagtaacgtacgaacggacggaaccgtaccgggtaacgttaacgtagtttaacggtaggaaccggtggtaacggtagggttaaccgggnggttacggcggtaaacgttggtaacaacgttacgtaaactaaaacgtttctaaacgttaagtaaacgg

SEQ ID NO: 110879 - DNA, 924 bp, Homo sapiens
  misc_feature: GYAE6OF01ARSQU.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcattccttttcttggtgcagcagcaacaggtcgcccactcccaggttcacgccggtgcagtctgcagtctggtaggtagaagacggccggtcggggtcctacgagtaggaacgtacttccgtccgtcggtacgtaacgggttcctttaccgtttacggtttaaccttaccgttttaacggacctaacgttacttaacgtttacctttaacgtccgtacggtcggttagggggtacctacccggtaaccggtaccccgggtacccccggtaggggtaaccggtaaccggggtacgtaacggggttaacgggttacggggtacgggttaggggtaaccggttacgggtaaccgtaccccggttaaccggttaacccccgttaaaaacgggaaaaccccggtaaaacgaaccggttaaaccggtaacgttaaccggtaccgggaaaacccgtaacccggtaaacccggccgggtaaacgggtacccttaaggtaacccttaccgaacccgtaagtaacccggaaccgaacgtaaccgaaaccaacgtaaccgtaaccgaaccgaaccgtaacccgtaacgaccctaaggacgggttaacggacgggtacgaaggtccgtaacgtagaacgtagtaaccgtaacggacggaaccggtccggttaagtagttttaacgtacggttacggtaacggacgggttaaggtaccgggttagggacggttacgggagtaacggttaggacttaaacggttaacgttaaacgtttaacgttaacctttaacggttaaagtaggttaacccgggg

SEQ ID NO: 110880 - DNA, 763 bp, Homo sapiens
  misc_feature: GYAE6OF01DINSK.13.1.A01.1.454.CMB.1.raw
  modified_base (225)..(225): a, c, t, g, unknown or other
  misc_feature (225)..(225): n is a, c, g, or t
  modified_base (588)..(588): a, c, t, g, unknown or other
  misc_feature (588)..(588): n is a, c, g, or t
  modified_base (603)..(603): a, c, t, g, unknown or other
  misc_feature (603)..(603): n is a, c, g, or t
tcagtcacgtactacacgaccggtgctcgatttagacgtctcatcaggggacccaaaaaccacacccctccttgggagaatcccctagatcacagctcctcaccatggactggacctggagcattcctttttcttggtggcagcagcaacaggtcgcccactcccaggttcagctggtgcagtctgcagctgaggtgaagaagccgtggggcctcgagtaggaanacttcctccgtagacctaaggtcctttacgttacggtttacctaccgttttagccgtaagttcttacgttactttaacgtcgtaggtcggttggggtcgacggacgtaccggccccgtagggacggacggtaccgtacgggaggttcggtaggtagggtacgtcggtaccgtaccgtaaccgtaaccccggtttaaaccgaaaaccgggaacctaacgaaacggtacctaaggtacggaaaccgtaaaccggaaccccggtaacgacgggtactaagtcttaacccgaacgtagtacgaaacgagaaccgtaaccaactaaccaacgaaccgtaaacacgaactactacgagtgggtaacggnggacggtccacggtnaacgtattaacggcgtaaacccggcggtaccggtacgtttattaacgtttaggttacggagggtaacgagggttacgtacggggtaggtacgggtacgtagggttaacgtagtaaccggtaactaaaacttaacgtttaacttacgtttaagttaaccgg

SEQ ID NO: 110881 - DNA, 221 bp, Homo sapiens
  misc_feature: GYAE6OF02GOQJK.13.1.A01.1.454.CMB.1.raw
  modified_base (218)..(221): a, c, t, g, unknown or other
  misc_feature (218)..(221): n is a, c, g, or t
tcagtcacgtactacacgaccggtgctcgatttagacgtctcatcagggtggaggctgaggatgttgggatttattactgcatgcaagatacattctggcctttcactttcggccctgggaccaaagtggataccaatcgaactgtggctgcaccatctgtcttcatcttcccgccatctgatagtacgtgactgagcgggctggcaaggcgcatagnnnn

SEQ ID NO: 110882 - DNA, 495 bp, Homo sapiens
  misc_feature: GYAE6OF02GGQL3.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctcagggcagattcaccatgacgacagacacatacacgaacacagcctacatggagtgaggagcctgagatatgacgacacggccgtgtattattgtgcgagagtggaagtggcagtggatatcggacaaattctactattaacg

SEQ ID NO: 110883 - DNA, 569 bp, Homo sapiens
  misc_feature: GYAE6OF02JKCKC.13.1.A01.1.454.CMB.1.raw
  modified_base (384)..(384): a, c, t, g, unknown or other
  misc_feature (384)..(384): n is a, c, g, or t
tcagtcacgtactacacgaccggtgctcgatttagacgtctcatcagggacccaaaaccacacccctccttggagaatccctagatcacagctcctcaccatggactggacctggagcatccttttcttggtggcagcagcaacaggtgcccactcccaggttcagctggtgcagtctgcagctgaggtgaagaagcctggggcctcgagtgaagatctcctgcaaggcttctggttacacctttagcagctatcttatcagctggtgcgacaggcccctggacgaggactcgagtcggatgggatggatcagcccttaacgaacggaacacagactatggacacgaacctcgagggacagattcgaacagtgacgacagacanataacacaacacaagcctaacagtaggaggtacggaggacgactaggacgagtagtacggacgtaacgacggtaccggtagttaacgttagttggtcgacgtacggtaggttagggacgggttaggacgtaggtacgggtattaacggtacggaaccttaaagtttacctaggttaacttaacgg

SEQ ID NO: 110884 - DNA, 381 bp, Homo sapiens
  misc_feature: GYAE6OF02FXZRX.13.1.A01.1.454.CMB.1.raw
  modified_base (207)..(207): a, c, t, g, unknown or other
  misc_feature (207)..(207): n is a, c, g, or t
  modified_base (339)..(339): a, c, t, g, unknown or other
  misc_feature (339)..(339): n is a, c, g, or t
  modified_base (341)..(381): a, c, t, g, unknown or other
  misc_feature (341)..(381): n is a, c, g, or t
tcagtcacgtactacacgaccggtgctcgatttagacgtctcatcaagggaaggaagggcagtctccacaactcctgatctattggggttctaatcgggcctcccgggtccctgacaggttcaggtggcagtgggtctgggacaggacttcactctcaccatcagcagactggaacctcgaagactttgcactttattctgtcaccngtatggtaggtcacgtacacttttggccaggggacctaagctggagatcaagcgaactgtggctgcacatctgtcttcatacttccccgcatctgatagtacgtgactgagcgggctggcaaggcgcatcgntnnnnnnnnnnnnnnnnnnnnnnnnnnnnnnnnnnnnnnnnn

SEQ ID NO: 110885 - DNA, 576 bp, Homo sapiens
  misc_feature: GYAE6OF02GB46H.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcggagtggagtgggatggatcgagcccttaacgaacggaacacagactatggacacgaacctcgaggcagattacacatcgacgacagacacactacacgaacacacgacctaacgagtaggaggtacggaacggacgaccgtaggaagattaagacggaccgacgaccgggtcgttagttaatttagttggtagaccggaggtaggttagggaaggttacgggacgtagggtacggtaattaagtccggtaaactaaatttaccgttaacttagttaacg

SEQ ID NO: 110886 - DNA, 586 bp, Homo sapiens
  misc_feature: GYAE6OF02G8LWQ.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttaccacctttagcagctatcttatcagctgggtgcgacaggcccctggacgaggactcgagtggagtgggatggatcgacgcccttaacgaacggaaacacgaagactatacggacacgaacctaccgagggacagacttcgaaccagtacgaacgacacgacaacaagtacacgaacacacgacctacagtaggagtaggacggagcctagagatagtacgacgacgaccggtccgtagttacgttagttacgtggtacgtaggaggtagggaacggtaggggacgtaagggtaggagttaaggtaccgtaaagtaaacgtttaaccttaccgttaagttaaccgg

SEQ ID NO: 110887 - DNA, 223 bp, Homo sapiens
  misc_feature: GYAE6OF02GH64L.13.1.A01.1.454.CMB.1.raw
  modified_base (218)..(223): a, c, t, g, unknown or other
  misc_feature (218)..(223): n is a, c, g, or t
tcagtcacgtactacacgaccggtgctcgatttagacgtctcatcagggtggaggctgaggatgttgggatttattactgcatgcaagctacattctggcctttcactttcggccctgggaccaaagtggataccaatcgaactgtggctgcaccatctgtcttcatcttcccgccatctgatagtacgtgactgagcgggctggcaaggcgcatagnnnnnn

SEQ ID NO: 110888 - DNA, 716 bp, Homo sapiens
  misc_feature: GYAE6OF02I31IG.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctggaggtgaagaagccgtggggcctcgaggtgaagatcctccgtgcgaaggtccttcgtaggttacctaccgtttagcagtcttatcttatcgagcgtgggtcgcgacgacggcccctagggacgagggacctacggaggttagggacgttggggactggactacgacgtacccgtttaacgaaacgggaaaccacgaacgtaacgtaagttacgggaaacctaacggtaaacccgttccggaaggggtaccaaaggtacctttaccgaacccgtagtacgaacccgtacgaacggaacaacgaactaaccgaaaccgaaaccaacgacgtaccctaactaacggtaggaacgggtaggtaacggacgtaccgtagaacgtaagtacgtacgaacgaccgtaaccggacccgttagttaacgttagttcgtacggtacggaggtaaggttgggaaggttcggacggtaggtacggtaagttaacgttaccggaaacgttaaacgtttaacgttacgttaagttaaccgg

SEQ ID NO: 110889 - DNA, 568 bp, Homo sapiens
  misc_feature: GYAE6OF02G6JCL.13.1.A01.1.454.CMB.1.raw
  modified_base (271)..(271): a, c, t, g, unknown or other
  misc_feature (271)..(271): n is a, c, g, or t
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctggtncgacgcggcccctggaccgaggactcgagtggagtgggatggatcgacgcccgttaacgaaccggtaacacgagactagtcggacagaacctcgaggcagactcacagtcgacgacagacacagtacacgaacacacgacctacagtaggagtgacggacgccgtagacgatagacggacgacgacggtcgttagtaacgttagttaggcgtacggtaggtacggttagggtaagtcgggtagtaggtacggtaattacgtaccgaaacttaaacggttacctaacgttagttaacg

SEQ ID NO: 110890 - DNA, 519 bp, Homo sapiens
  misc_feature: GYAE6OF02G0HUR.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcacgtcccttaacaacggaacacagactatggacagacctcgaggcagatcaccatcgacgacagacacatacacgaacacagacctacatggagtgaggacgccgtagagatagtagacgacgacgggcgttagtattagttgtcgcgagtaggtgggaggttggcgtaggtggatagtacggaactaatttactactattaacg

SEQ ID NO: 110891 - DNA, 535 bp, Homo sapiens
  misc_feature: GYAE6OF02F3AQS.13.1.A01.1.454.CMB.1.raw
  modified_base (419)..(419): a, c, t, g, unknown or other
  misc_feature (419)..(419): n is a, c, g, or t
tcagtcacgtactacacgaccggtgctcgatttagacgtctcatcaggggacccaaaaaccacacccctccttgggagaatcccctagatcacagctcctcaccatggactggacctggagcatcctttttcttggtggcagcagcaacaggtgcccactcccaggttcagctggtgcagtctgcagctgaggtgaagaagcctggggcctcagtgaagatctcctgcaaggcttcgtggttacaccttttagcagctatcttatcagctggtgcgacaggcccctggacgaggactcgagtggatgggatggatcagtccccttaacaacggaacacgagactatggacagaacctcgagggacagattcaccatcgacgacagacacatacacgaacacacgacctacagtaggagnggaggacgcctagagagtagtagacgacgacggtccgttagtattattgtcgacgagacggtggaggtggcgtaggtggtagttacgtacgtaacctaattactaacttattaacg

SEQ ID NO: 110892 - DNA, 708 bp, Homo sapiens
  misc_feature: GYAE6OF02G7Z9E.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcaggtgaagatctcctgcaaggtcttcgtggttacaccgtttagcagtctattcttatcagtcgtgggtcgcgacgtacggccccgtggacgacggactcggaggtggagtgggatggatcgacgtccttaacgaaacggaaacacgagtactagtacgaacaacgaaccgtaccgaggactaagtacttacaaccgtagtacggaaccgaacgaagaacccaactaacgtaaaccgtaaaccggaaaaccaaccgtaaccgtaaccctaaccgaacggttagggaacgggttacggaagggtaccgaccggttagaacggtaactaggtacggaaccgaacgggtaccggtaccgttagttaacgtttagttaggtacgacgggtagggtaggtacgggtacgggttacgggtaccggtaagggttacggtaaggtttaacgtaaccgttaaaaccggttaaactttaaacccgtttaacgtaactttaaaccggg

SEQ ID NO: 110893 - DNA, 645 bp, Homo sapiens
  misc_feature: GYAE6OF02HE7PN.13.1.A01.1.454.CMB.1.raw
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggtcttcgtggttacctacctttagcagctatcttancagcgtgggtncgacacggcccctggacgaggactcggagtggagtgggatggactcgacgtacccgttaacgaaaccggaaaccacacgtactagtacggaacaacgaaccctcggaagggcaagtacttaccaaccagtaccggaacgaacgaacgaaccaacaacgtaaccaaccgaaaccacgaacgaccctaacgagtagggaaggtcggaaggtacgccgtaggaacgtaagtagtacggaaccgaacgaccgggtacgttaagttaagtttagttgtaggtacggtagggtaggttagggaaggtcgggacgtagggttaggaagttacggtacggtaaaccttaaacgtttacgttaacttagttaacgg

SEQ ID NO: 110894 - DNA, 541 bp, Homo sapiens
  misc_feature: GYAE6OF02GFXSS.13.1.A01.1.454.CMB.1.raw
  modified_base (378)..(378): a, c, t, g, unknown or other
  misc_feature (378)..(378): n is a, c, g, or t
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctggtgcgacaggcccctggacgaggactcggagtggatgggatggatcacgcccttaacgaacggaaacacagactagtggacagacctcgagggcagattcacatgacganagacacatacacaacacacgcctaacagtgggaggtagagggactcgtagagagtagacgacgacgacggtccgttagttattagttagtgacgtagaggtaggaggtggactagggtaggtagtacgtacggtaaactaaagtttaccttacttaattaacg

SEQ ID NO: 110895 - DNA, 688 bp, Homo sapiens
  misc_feature: GYAE6OF02JYKGE.13.1.A01.1.454.CMB.1.raw
  modified_base (137)..(137): a, c, t, g, unknown or other
  misc_feature (137)..(137): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
  modified_base (641)..(641): a, c, t, g, unknown or other
  misc_feature (641)..(641): n is a, c, g, or t
tcagtcacgtactacacgaccggtgctcgatttagacgtctcatcagggacccaaaaccacaccctccttgggagaatccctagatcacagctccctcaccatggactggacctggagcatccttttcttggtggcngcagcaacaggtgcccactcccaggttcagctggtgcagtctgcagctgaggtgaagaagccgtggggcctcaggtgaagatcttcccgagcgaggcttcgtcggttacacctttagcagtctatccttatcagtccgtgggtcgcgacgaccgggccccgttaggacggacggtaccgtaccggtaggttagggacggtaggggtagtacgggactaccggtaccggaccccgtttaaaccggaaaccggtaaaacgaaccggtacgaacttacggttacgggaacctaaacggaaccctaccggagggtacaacgtacttaccaacggactacggagtacgacgacgaacacgtaacgacgaaacnccgaanacctagagtacggtaggacggtgacgcgtaagagtagtacgacgtacgaacgtaccggtcgtttagttacttaggtacgagtcgtaaggtcggtaggtacggtacgttaggaacggttacgtaggttaanaccggggtaaaactttaaccgttaaccgttagtttaaccgttaacgg

SEQ ID NO: 110896 - DNA, 552 bp, Homo sapiens
  misc_feature: GYAE6OF02GVEMU.13.1.A01.1.454.CMB.1.raw
  modified_base (501)..(501): a, c, t, g, unknown or other
  misc_feature (501)..(501): n is a, c, g, or t
  modified_base (511)..(511): a, c, t, g, unknown or other
  misc_feature (511)..(511): n is a, c, g, or t
tcagtcacgtactacacgaccggtgctcgatttagacgtctcatcaggggacccaaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggcttcgtggttacacctttagcagctatcttatcagtcgtgggtgcgacgacggccccgtggacgaggactcgagtggagtgggatggatcgacgtcccttaacgaacggaacacgagactagtacggacacgaaccctcgagggcaagtacttaccaaccgtagtacgaaccgaacgacgacaacaactaacgaacgaacacacgtacctacgagtaggaggtagaggacgcgtagagatatgacgacgacggcgtagtatagtgtgngagaggtggngtggtcgagtagatacgtacgaactaatactactagtaacg

SEQ ID NO: 110897 - DNA, 606 bp, Homo sapiens
  misc_feature: GYAE6OF02GYOMN.13.1.A01.1.454.CMB.1.raw
  modified_base (361)..(361): a, c, t, g, unknown or other
  misc_feature (361)..(361): n is a, c, g, or t
tcagtcacgtactacacgaccggtgctcgatttagacgtctcatcaggggacccaaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagccgtggggcctcgagtgaagatctcctgcaaggtcttcgtggttacacctttagcagcttatcttatcagtcgtgggtgcgacgcggcccctaggacgaggactcggaggtggagtgggatggatcgacgtcccttaacgaaaccggaacacacgactagnggaacacgtaacctcgaggcagtactacacatacgacgacacgaacacaactacaacgaacacacgacctacagaggaggtaggacggagaccgtagagtagtacgacggtacgaccgacggtaccgttagttaacgtttagtggttacggaaggtagggtagggtagggtaacggttggacggtaaggttacggagttaacgtacggtaaacgtttaaacgtttaacttaacgttaattaacgg

SEQ ID NO: 110898 - DNA, 568 bp, Homo sapiens
  misc_feature: GYAE6OF02FPNJM.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagccagtctatcttatcagctgggtgcgacaggcccctggacgaggactcggagtggagtgggatggatcgagccttacaacggaacacagactatgacagaacctcgaggacagacttcacatcgacgacagacacatacacgaacacacgacctacagtggaaggtgaggagccgtagacgatataggacgacgacgggtccgttagtacgttacgtggtgtacggagtcggtagggtacggtacgggaccgtagggttacggtaacgttacgttaacggaaaccttaaagttttaccgtaaccgttaagttaaccgg

SEQ ID NO: 110899 - DNA, 791 bp, Homo sapiens
  misc_feature: GYAE6OF02ID7KC.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcgagtgaagatctcctgcaaggcttctggttacactttagcagctatcttatcagctggtgcgacgacggcccctggacgaggacgtcgaggttcggagtgggatgggatcgacgacccgtttaacgaaaccggtaaacacgacgaactaagtagggaaccaacggtaacccgttccgaaacgggggacctaacgggtaactttaccgaaacccgtaagttaaccgggaaccgaaccgaaacggaccaaacctaacgttaaacccgaaaccggaaacctaaaccgaacggtaacccgtaaacgtaacggtaacgggtaacgggttaagaacgggaacggtacccgtaaggaaccggtaaagttaacgttaacggaacccgaaacccggtaaccggggtaccccggtttaaggtttaaccgtttaaagttttacgggtaacggtaccggggaagggttaaggggttacgggtaaacgggttacggggtacgtaacggggtttacgggtaaaccgtttacggttaaccggtaaaccgtttaaaacgttttaacccgtttaaggttaacccttttaaacccggg

SEQ ID NO: 110900 - DNA, 583 bp, Homo sapiens
  misc_feature: GYAE6OF02FMNFD.13.1.A01.1.454.CMB.1.raw
  modified_base (273)..(273): a, c, t, g, unknown or other
  misc_feature (273)..(273): n is a, c, g, or t
  modified_base (403)..(403): a, c, t, g, unknown or other
  misc_feature (403)..(403): n is a, c, g, or t
tcagtcacgtactacacgaccggtgctcgatttagacgtctcatcaggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggcttctggttacacctttagcagctatcttatcagctgggtncgacacggcccctgggacgaggactcggagtggagtcgggatggatcgacgcccgttaacaacggtaacacgagactagtcggaacacgaacctcgagggcagtactacaccatacgacgacagacacanacacgaacacacgtaccacagtggagtagacggacgtctaggagtagtacgtacgacgtacgaccgggtcgttagttaattacgttagtgaccggtaggtaggtagggaagggttcggacgtagggtaggtaagttacggaaccgtaaacgtaaagtttaccttaacgttatttaaccgg

SEQ ID NO: 110901 - DNA, 679 bp, Homo sapiens
  misc_feature: GYAE6OF02HD09A.13.1.A01.1.454.CMB.1.raw
tcagtcacgtactacacgaccggtgctcgatttagacgtctcatcagggacccaaaaaaccacacccctccttgggagaatcccctagatcacagctcctcaccatggactggacctggagcattccttttcttggtggcagcggcaacaggtgtccaccctgaggttcagttggttcagtctggaggagggtgaagaagccgtggggcctcgagtgcaggtcgcctgcagggcctcgtggttacattttcgacaactttggcatctacgtggtgcgacacggcccctggccacggccttggacgtcggcgtggggtgatcgtaggtttgtaacgtaaccggtgaacactagtactttgcaacagtaagtttggagggcagagcaccgtagaccacagtaaccacacgtaccgacgaaacacgacgtacctaacagtacggaagtcggaagtaaacgtctacgaacgtattcgtacggaaccgacgaaccggtacctaataacgttaactttaccgtaggtacgaccggtaagggttaaacgggttaccggggtttttacgggggacgtccgggtaccgttccgttacgtttacggacgtacgtacggttccggggtaccggaaggggtaacgaacggttcggtacccgttacccggttaccgttcgttaccgtacccg

SEQ ID NO: 110902 - DNA, 231 bp, Homo sapiens
  misc_feature: GYAE6OF02IE4L7.13.1.A01.1.454.CMB.1.raw
  modified_base (214)..(214): a, c, t, g, unknown or other
  misc_feature (214)..(214): n is a, c, g, or t
  modified_base (220)..(231): a, c, t, g, unknown or other
  misc_feature (220)..(231): n is a, c, g, or t
tcagtcacgtactacacgaccggtgctcgatttagacgtctcatcagggtggaggctgaggatgttgggatttattactgcatgcaagctacattctggcctttcactttcggccctggaccaaagtggataccaatcgaactgtggctgcaccatctgtcttcattccttcccgccatctgatagtacgtgactgagcgggctggacaaggcncatagnnnnnnnnnnnn

SEQ ID NO: 110903 - DNA, 838 bp, Homo sapiens
  misc_feature: GYAE6OF02IWFDB.13.1.A01.1.454.CMB.1.raw
tcagtcacgtactacacgaccggtgctcgatttagacgtctcatcaggggacccaaaaaccacacccctccttgggagaatcccctagatcacagctcctcaccatggactggacctggagcatcctttttcttggtggcagcagcaacaggtgcccactcccaggttcagctggtgcagtctgcagctgaggtgaagagccgtggggcctcagtgaagacttctccgtgactaacgggtcctttcgttcgggtttaacctaccgtttaagctacgtcttaagttcctttaatcgtaacgtcggttggggtcgtcccggtaacgtaaccggggtcccccccgttaggggaacccggtaaggggtacccgttaccgggtaagggttggggaacggttggggggaattcggggtaacttccgtaaccgggttacccctttaacggaaaaaccggggtaaaccacgtaacggactttaaggaacggactaaccggaaccgttaccggagggtacaacgtattacccacgtaactacggaaccgagtaacgaaccgaacacgtaaccgaacgaaaccaaacgacctaccgtaaaccgtaaggtagggaacggttcgggaaacgggcggtacccgttaaggaacgggtaagttaacgttaggaaaccggtaaccttacccggggtacgttaaggttttaacctttaaggtttcgtaacggggtaccgtaagggtaacgggtttaacgggtaggggttaccggtagggttaacgttaggggtaaacgttaacgtaccggttaaaccgttaaaaacgtttaccgtttaaacgttacgttaaacgg

SEQ ID NO: 110904 - DNA, 225 bp, Homo sapiens
  misc_feature: GYAE6OF02FJ3NI.13.1.A01.1.454.CMB.1.raw
  modified_base (214)..(225): a, c, t, g, unknown or other
  misc_feature (214)..(225): n is a, c, g, or t
tcagtcacgtactacacgaccggtgctcgatttagacgtctcatcagggtggaggctgaggatgttgggatttattactgcatgcaagctacattctggcctttcactttcggccctggaccaaagtggataccaatcgaactgtggctgcaccatctgtcttcatcttcccgcatctgatagtacgtgactgaggcggctggacagcgcatgnnnnnnnnnnnn

SEQ ID NO: 110905 - DNA, 724 bp, Homo sapiens
  misc_feature: GYAE6OF02GEKWM.13.1.A01.1.454.CMB.1.raw
tcagtcacgtactacacgaccggtgctcgatttagacgtctcatcagggacccaaaaaccacgacccctccttgggagaatcccctagatcacagctcctcaccatggactggacctggagccattccttttcttggtggcagcagcaaacgaggtgcccactcccaggttccagctggtcgcagtctgcagctgaggtagaagacgccgtcgggcctcgagtagaacgactctccgtgtacgaaggtcctttcgtcggttaacctaccgttttacgcctacgacgttacttacttagtacgtacggtcggttagggtccgccgtaaccggtccggtcccccgttagggaccggtaacgggaccgtcgggtacggtcgggaggttcgggagtcggactcgaaccgtcccgttaacggaaacgtaacagtacgacttagaggtacacgtaacctcggacggtacgagtacttaccacgacgtacgaacgtacgaacaccgtaatacgtaacgaaaccgaaactaaccgaacgtaccgtaaccgaggttagggaacggttacgggacggtaacgtcgggtaacgagggtaactaggtaaccgacgaaccgtcggtacggtacgttaagttcggtagacggttacgaggttaggacggttaggacgacggttacgggattaacgttacgggtaccttaaaagtacctttaacttacgttataaacgg

SEQ ID NO: 110906 - DNA, 714 bp, Homo sapiens
  misc_feature: GYAE6OF02JFB4Y.13.1.A01.1.454.CMB.1.raw
  modified_base (201)..(201): a, c, t, g, unknown or other
  misc_feature (201)..(201): n is a, c, g, or t
  modified_base (267)..(267): a, c, t, g, unknown or other
  misc_feature (267)..(267): n is a, c, g, or t
  modified_base (334)..(334): a, c, t, g, unknown or other
  misc_feature (334)..(334): n is a, c, g, or t
  modified_base (488)..(488): a, c, t, g, unknown or other
  misc_feature (488)..(488): n is a, c, g, or t
  modified_base (572)..(572): a, c, t, g, unknown or other
  misc_feature (572)..(572): n is a, c, g, or t
  modified_base (664)..(664): a, c, t, g, unknown or other
  misc_feature (664)..(664): n is a, c, g, or t
tcagtcacgtactacacgaccggtgctcgatttagacgtctcatcgaggggaacccaaaaaccaccacccctccgttgggagaactcccctagatcacagctcctcaccatggactcggacctggagcatttccgtttttcttcgggtggcaggcacgcaacgtggtcgccctacctcctagggttcaggtccgtagggtnaccaggttcacggctaggctaggtaggtcggaagtacggccgtcggggtcctacgagtgaaacgtntccgtacgtcggacgtacggttctttcgttacggttaacctcgttagcgtactcgttattcgttaanccgtaggtcgttaggccgaccggacgtacccgggtccgagggacgtaacgggtcgtacggttagacgggtaacggtgggtatacgggtactaccggtaaccgaaccgttaaaccggaaacgttaacgacggaactacggtaacgacggtaaccncggtaacctcggacgagttacacgttcgaaacgtataccgaatacgacgacacaacgaacgaaccgtaacagtacgacgaacgnggtaagaacggttcgacgactcgtagagtaagcgtacgacgcgtaccggattagtacgtgtacgtacgtacgtaggtacggagtaggtacgnggttaagacgttagacgtacggtaacttacgtaacgtagttacgtaacgg

SEQ ID NO: 110907 - DNA, 771 bp, Homo sapiens
  misc_feature: GYAE6OF02G64HG.13.1.A01.1.454.CMB.1.raw
  modified_base (173)..(173): a, c, t, g, unknown or other
  misc_feature (173)..(173): n is a, c, g, or t
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
  modified_base (584)..(584): a, c, t, g, unknown or other
  misc_feature (584)..(584): n is a, c, g, or t
tcagtcacgtactacacgaccggtgctcgatttagacgtctcatcagggacccaaaaaccacacccctccttgggagaatcccctagatcacagctcctcaccatggactggacctggagcatccttttctggtgcagcagcaacaggtgcccactcccaggttcagctggtncagtctgcagctgagtgaagaagccgngggcctcagtgaanctcctacctgcgaagtccttcgttagttacctaccgtttagacncgtcttaattcttacgntacgtcgtagggtcgacaccgccgggtcccccgtaggacggtaccgacgtaccggtggtacggaggttcgggagtacggacttccggaaccgtacccgttaaacgaaccggaaaacctagtacgtaacgttagtaacgggaacaaacccggtaacccgtaccgaacggggactacgtaaccgttacctaacccaggttacccgaaccgaacgaaccgtaaccgaaaccgttaaacaacccgtaaacgaaacccgtaaaccgaccgtaacccgtacgaacggttcggggtaacggtacggaacgggtacnccggtaagacgtaagttaaccgtaacggtaaccggtaccgaaccggttacggttacgtttaacgtttaacgttgtaccggtacggtaggtacgggtaggtaggtacgggttaccgggtaggttaacggtaagttacggttaacgtaaaccggtttaaacttaaccgtttaacgtaactttaaccggg

SEQ ID NO: 110908 - DNA, 651 bp, Homo sapiens
  misc_feature: GYAE6OF02JKGMN.13.1.A01.1.454.CMB.1.raw
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (375)..(375): a, c, t, g, unknown or other
  misc_feature (375)..(375): n is a, c, g, or t
  modified_base (501)..(501): a, c, t, g, unknown or other
  misc_feature (501)..(501): n is a, c, g, or t
  modified_base (556)..(556): a, c, t, g, unknown or other
  misc_feature (556)..(556): n is a, c, g, or t
tcagtcacgtactacacgaccggtgctcgatttagacgtctcatcagggacccaaaaaccacacccctccttgggagaatcccctagatcacagcctcctcaccatggactggacctggagcatccttttcttggtggcagcagcaacaggtgcccactcccgaggttcagctggtgcgagtctgcagctgnggtnaagaacgccgtgggcctacngtagaagcttccncctgcgaagtcttntagtcctacgttagcagctatcttatcagtcgtggtcgacgctacggccccgtggacggaggcctacggtaggtgacggtgggtagtcgggtactaccggacgtaacccgttacgaacgggaaacaccgtanaccggttagaaccggaacacgttaacccgcggagggaacgtacgtactaccgaactactcgggactacgagaccagaataccaagaccacgtacacccgaacgtaggtacggaagtggaaaccggnggtaccaggtacagttaacgacgaccgacgtccggttaaccgttgttaaagtttntaagggactacggaggtcggtagggtaacgttaccggtgggaattggttaaacggtcgaaacggttacttaacggttacctatttaactaacggg

SEQ ID NO: 110909 - DNA, 202 bp, Homo sapiens
  misc_feature: GYAE6OF01EJM8O.35.6.A06.1.454.CMB.1.raw
  modified_base (201)..(202): a, c, t, g, unknown or other
  misc_feature (201)..(202): n is a, c, g, or t
tcagtacagatcgtcacgaccggtgctcgatttagatctactgacagggtccgggagatcatgagggtgtccttgggttttgggggaagaggaagactgacggtcccccaggagttcaggtgctgggcacagcggccctgggctgcctggtcaaggactacttccacgatctgtactgagcgggctggcaaggcgcatagnn

SEQ ID NO: 110910 - DNA, 501 bp, Homo sapiens
  misc_feature: GYAE6OF01ED2M7.35.6.A06.1.454.CMB.1.raw
  modified_base (498)..(498): a, c, t, g, unknown or other
  misc_feature (498)..(498): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttctttaaattggtatcaacggaaacagggaaagcccctaaactcctgatctatgctgcatccattttgcaaagtggggtcccggcaaggttcagtggcagtggatcgtgggacagaattcactctcaccatcagcagtctgcaacctgaagtattttagactaaacctactattgtacaacagaagttacagtaccgcccgacgatcagcttacggcctaaagggacacgactaggagtattaaaagactagtggactagcacntcg

SEQ ID NO: 110911 - DNA, 486 bp, Homo sapiens
  misc_feature: GYAE6OF01AFYPO.35.6.A06.1.454.CMB.1.raw
  modified_base (483)..(483): a, c, t, g, unknown or other
  misc_feature (483)..(483): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttctttaaattggtatcaacggaaaccagggaaagtccctaaactcctgatctatgctgcatccattttgcaaagtggggtcccggcaaggttcagtggcagtggatctggacagaattcactctcaccatcagcagtctgcaacctgaagattttgctaacctactattgtcaactagattacagtacgcccgcgatcagcttcggccaagggacacgactggagtaattaaagactgtggctgccacntcg

SEQ ID NO: 110912 - DNA, 529 bp, Homo sapiens
  misc_feature: GYAE6OF01BYN39.35.6.A06.1.454.CMB.1.raw
  modified_base (418)..(418): a, c, t, g, unknown or other
  misc_feature (418)..(418): n is a, c, g, or t
  modified_base (522)..(529): a, c, t, g, unknown or other
  misc_feature (522)..(529): n is a, c, g, or t
tcagtacagatcgtcacgaccggtgctcgatttagatctactgacgtaggggaggataggtagactgggacactccagatgacccacgtctccatcctccctagtctgtcatacttgttaggagacaagtcgtcaccatccacgttgccgggtcaacgtcgacgagcgattggcaagttactttaaattggtatcaacgaaccaggaacgcccctaaacttcctgacttccgtactgtctgacatcctattttgcgtaaaggtcggggtcccggcgaaggttacgaggtcggactaaggtggatcgtgggacagaattcactctcaccatcagcagtctgcaacctgaagtattttgcaacctactattgtacaacagattacagtacgcccgcgatcagtcgttcggacaagggacncgactggagattaaagactgtgctgcacctatctgtcttcattccttcccgctactcgtgaagtatcgtgtactgtacggcggtctggacaaggcgtcagtagnnnnnnnn

SEQ ID NO: 110913 - DNA, 488 bp, Homo sapiens
  misc_feature: GYAE6OF01DX6MD.35.6.A06.1.454.CMB.1.raw
  modified_base (241)..(241): a, c, t, g, unknown or other
  misc_feature (241)..(241): n is a, c, g, or t
  modified_base (359)..(359): a, c, t, g, unknown or other
  misc_feature (359)..(359): n is a, c, g, or t
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
  modified_base (485)..(488): a, c, t, g, unknown or other
  misc_feature (485)..(488): n is a, c, g, or t
tcagtacagatcgtcacgaccggtgctcgatttagatctactgacagggagggatggagactgggacatccagatgacccagtctccatcctccctgtctgcatcgtgtaggagacagcgtcaccatcacttgccgggcaagtcagagcattggcagttctttaaattggtatcaacggaaaccagggaaagcccctaaactcctgatctatgctgcatccattttgcaaagtgggtccgnaaggttcagtgcagtggatctgggacagaattcactctcaccatcagcagtctgcaacctgaagtattttcgactaaacctacttaattggtacaaacagagttaacagtacgcccgngatcagcttcggccaagggacacgactaggaagtaattaaaagactgtaggctagcacatctgtcttcatcctccgcatctgaacatctgtactgacgcgggctggcgaaggcgcatagnctngannnn

SEQ ID NO: 110914 - DNA, 588 bp, Homo sapiens
  misc_feature: GYAE6OF01DNQZF.35.6.A06.1.454.CMB.1.raw
  modified_base (584)..(588): a, c, t, g, unknown or other
  misc_feature (584)..(588): n is a, c, g, or t
tcagtacagatcgtcacgaccggtgctcgatttagatctactgacagggagggatggagactgggacatccagatgacccagtctccatcctccctgtctgcatctgtaggagacagcgtcaccatcacttgccgggcaagtcagagcattggctagtttactttaaattggtatcgaaacggaaaccagggaacgccctaaactcctgatctatgctagcatcctattttgctaaaggtcggggttcccgacgtaaggttccagtggcagtggatcgtgggacagtaatcactctacacatcagcagtctgacaacctgaagtattttacgacctaaccttactattgtacaacagtaagttacgacgtacgcccgacgtactcacgtccgttacggactaacgggacacgtacgtagggaactaaagtaaaaggtaacgtggtaggtactacggacctaacctattcctacgttactttacacttccctttaccgacctattccgtacgtaacgtacttcgttagtactacgggacgtcggggcttacgggacgtaacggacgtacgtagtaggcagctagnnnnn

SEQ ID NO: 110915 - DNA, 446 bp, Homo sapiens
  misc_feature: GYAE6OF01EN32Q.35.6.A06.1.454.CMB.1.raw
  modified_base (422)..(446): a, c, t, g, unknown or other
  misc_feature (422)..(446): n is a, c, g, or t
tcagtacagatcgtcacgaccggtgctcgatttagatctactgacaggggtccgggagatcatgagggtgtccttgggttttgggggaagaggaagactgacggtcccccaggagttcaggtgctgggcacggtgtacctgcaaatgaacagcctgggagacgaggacacggccgtatattactgtgcgacatctgcgagggtgccttactatgacaatagtggttttggccacatctactactttgaggactggggccagggaacccctggtcgccgtctcctcagcctccaccaagggcccatcggtctccccctggcaccctcctccaagagcacctcctggggcacagcggccctgggctgcctggtcaaggctacttccacgatctgtactgagcgggctgggcaaggcgcatagcnnnnnnnnnnnnnnnnnnnnnnnnn

SEQ ID NO: 110916 - DNA, 609 bp, Homo sapiens
  misc_feature: GYAE6OF01DMJ6O.35.6.A06.1.454.CMB.1.raw
  modified_base (190)..(190): a, c, t, g, unknown or other
  misc_feature (190)..(190): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtagganaaagcgtcaccatcacttgccggacagtcagagtattagtaattgtggcctggtatcagcagaaaccagggaagcccctaaaatcctagatctttaaggcgtctactttagagagtgggtcccatcaaggttcagcggcagtggatcgtgggacagacttcactctcaccatcaccagcctgcagcctgatgtattttgactaacctatttactgacccaaactagtatgggttgacttttacccggtctaaccgtttttccgggacccccgtttaggggaaccccgttaaaaaggtcggggtaaacttaaacgtaccgtaaaaaaccggtaaaccttgggtacgggtcctttacgggacccttaaaccctaacgtttcccttaacgggtttcccttttaccggaaaccttttcccccg

SEQ ID NO: 110917 - DNA, 541 bp, Homo sapiens
  misc_feature: GYAE6OF01EUDFY.35.6.A06.1.454.CMB.1.raw
  modified_base (320)..(320): a, c, t, g, unknown or other
  misc_feature (320)..(320): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagcgtcaccatcacttgccgggcaagtcagagcattggcagttcttaaattggtatcaacggaaaccagggaaacgccctaaactcctgatctatgctgcatcctattttgctaaaggtgggtcccggnaaggttcaagtggcagtggatcgtggacagaattcactctacaccatcagcagtctgcaactgaagtattttgactaacctactattcgtacaacagtagttaacagtacgacccgtacgatcagtccttacggaccaaagggaccaacggtacgtagggaagtaaacgttaaaaacggaacgttacggttacgggacttaggacctaaccgtagttaccg

SEQ ID NO: 110918 - DNA, 548 bp, Homo sapiens
  misc_feature: GYAE6OF01ER08P.35.6.A06.1.454.CMB.1.raw
  modified_base (384)..(384): a, c, t, g, unknown or other
  misc_feature (384)..(384): n is a, c, g, or t
  modified_base (433)..(433): a, c, t, g, unknown or other
  misc_feature (433)..(433): n is a, c, g, or t
  modified_base (470)..(470): a, c, t, g, unknown or other
  misc_feature (470)..(470): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
  modified_base (487)..(492): a, c, t, g, unknown or other
  misc_feature (487)..(492): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (510)..(510): a, c, t, g, unknown or other
  misc_feature (510)..(510): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
tcagtacagatcgtcacgaccggtgctcgattttagatctactgacagggggtaccgggggagaggtcatggaggggtgtccttgggttttggggggaagaggggaaggacctcgaccggtccccccagggacgttcgaggtgctgggctaccggtgtaccctcgcaaattgaacgagcctggggacgacggacggacacggccgtactagttactgtgccgacatcctgcgaggggtcgccttacgtatggacaatacgtggttttgcctacatctactacgtttagaggactaggggccaggggtaacctggtcgaccgttctcctcacgccgtaccaaccaaggccccatacggtcccttacccctgcacctctcctaagngcacctcgtggggcacgagcggtcctggctgcctgtcagcctatcacgntctgactcgacgtcggctgctaacggcgcagtaggcngagcngctgnttactgnnnnnnanacananatgtgtgcgngcgcagngcgcncgcgcgcgacgacgcncnccgcgcgc

SEQ ID NO: 110919 - DNA, 514 bp, Homo sapiens
  misc_feature: GYAE6OF01DPK2L.35.6.A06.1.454.CMB.1.raw
  modified_base (508)..(508): a, c, t, g, unknown or other
  misc_feature (508)..(508): n is a, c, g, or t
tcagtacagatcgtcacgaccggtgctcgatttagatctactgacagggggagtcagtctcagtcaggacacagcatggacatgagggtccccgctcagctcctgggctcctgctactctggctccgaggtgccagatgtgacatccagatgacccagtctccatcctccctgtctgcatctgtaggagacagcgtcaccatcacttgccgggcaagtcagaccattcgcgtctatttaaatggtatcgccagaggccaggagaagcccctaactactgatgtatactgtatctactttgcatattgcgtccatcaaggttcagtgcagtggatctgggacagtatttcactctcaccatcaacaatataacaacctgaagtactttgactaacttactactgtaccaacagacttacacgggtcccctattcctaacgtttccgccctgggacccacgtacgtccaattactacccaaacgaacttgtacggccttacgccaacctnttctcg

SEQ ID NO: 110920 - DNA, 434 bp, Homo sapiens
  misc_feature: GYAE6OF01E173Y.35.6.A06.1.454.CMB.1.raw
  modified_base (431)..(434): a, c, t, g, unknown or other
  misc_feature (431)..(434): n is a, c, g, or t
tcagtacagatcgtcacgaccggtgctcgatttagatctactgacaggggtccgggagatcatgagggtgtccttgggttttggggggaagaggaagactgacggtccccccaggagttcaggtgctgggcacggtgtacctgcaaatgaacagcctgggagacgaggacacggccgtatattactgtgcgacatctgcgagggtgccttactatgacaatagtggttttggccacatctactactttgaggactggggccagggaaccctggtcgccgtctcctcagcctccaccaaggcccatccggtcttcccccctggccaccctccctccaacgacgccacctcgtgggggcacgagcggccctgggctgcctggtcaaggactacttccacgatctgtactgagcgggctgggcaggcgcatagnnnn

SEQ ID NO: 110921 - DNA, 546 bp, Homo sapiens
  misc_feature: GYAE6OF01EQ8SH.35.6.A06.1.454.CMB.1.raw
tcagtacagatcgtcacgaccggtgctcgatttagatctactgacaggggtctgagagaggagcccagccctgggattttcaggtgtttcatttggtgatcaggactgaacagagagaactcaccatggagtttgggctgaggtggctttttcttgtggctattttaaaaggtgtcaatgtgaagtgcactgttggagtctgggggaggcttggtacaggcgggggggtccctgagactctcctgtgcagcctctggattcacctttagcaactatgccatgagctgggtccgccaggctccgagggggaggggctgggcgtgggtctcaactattagtgctaggcggtaggtaaatagagactacgcagactctctggaacgggtccggttcatcatctccagggacaattccaagagcacggtgtacctgacaaatgaacagccgtgggacgaacggaggacgacggaccgttaatattacgtgtcgcgacatcgtggcggtagggtcgtccttactatgactaagtagttggtttgccgtaac

SEQ ID NO: 110922 - DNA, 522 bp, Homo sapiens
  misc_feature: GYAE6OF01CD3TA.35.6.A06.1.454.CMB.1.raw
  modified_base (222)..(222): a, c, t, g, unknown or other
  misc_feature (222)..(222): n is a, c, g, or t
  modified_base (266)..(266): a, c, t, g, unknown or other
  misc_feature (266)..(266): n is a, c, g, or t
  modified_base (318)..(318): a, c, t, g, unknown or other
  misc_feature (318)..(318): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccggcaagtcagngcattggcagttctttaaattggtatcaacggaaacagggaaancccctaaactcctgatctatgctgcatcctattttgcaaaggtcgggtccgntaaggttcagtgcagtgatcgtggacagaattcactctacacatcagcagtctgaccaacctagaagtattttacgactaaccttattattcgtacaaactagtaagtttaacacgttaccgcccgtacgaactcacgtccgttaccggaccgaacggacacgacgtaggaagtaattaaacgatggtcgacagaccactgttc

SEQ ID NO: 110923 - DNA, 493 bp, Homo sapiens
  misc_feature: GYAE6OF01AISA6.35.6.A06.1.454.CMB.1.raw
  modified_base (434)..(434): a, c, t, g, unknown or other
  misc_feature (434)..(434): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttctttaaattggtatcaacggaaaccagggaaagcccctaaactccctgatctatgctgcatccattttgcaaagtggggtcccggcaaggttcagtggcagtggatcgtggacagaattcactctcaccatcagcagtctgcaacctgaagtattttgctaacctactagtttcgcaacagacgttacagtacgcccgngatcagtccttcggccaagggacacgacgtggagattaaagactggtgctgccncntcg

SEQ ID NO: 110924 - DNA, 426 bp, Homo sapiens
  misc_feature: GYAE6OF01BOI7J.35.6.A06.1.454.CMB.1.raw
  modified_base (422)..(426): a, c, t, g, unknown or other
  misc_feature (422)..(426): n is a, c, g, or t
tcagtacagatcgtcacgaccggtgctcgatttagatctactgacaggggtccgggagatcatgagggtgtccttgggttttgggggaagaggaagactgacggtccccccaggagttcaggtgctgggcacggtgtacctgcaaatgaacagcctgggagacgaggacacggccgtatattactgtgcgacatctgcgagggtgccttactatgacaatagtggttttggccacatctactactttgaggactggggccagggaaccctggtcgccgtctcctcagcctccaccaagggcccatcggtcttccccctggccgccctgctccaggagcacctccgagagcacagcggccctgggctgcctggtcaaggctacttccacgatctgtactgagcgggctggcaaggcgcatagnnnnn

SEQ ID NO: 110925 - DNA, 871 bp, Homo sapiens
  misc_feature: GYAE6OF01AHD27.35.6.A06.1.454.CMB.1.raw
  modified_base (96)..(96): a, c, t, g, unknown or other
  misc_feature (96)..(96): n is a, c, g, or t
tcagtacagatcgtcacgaccggtgctcgatttagatctactgacgagggggagtcagtctcagtcaggacacagcatggacatgagggtccccgntcagctccgtggggctcctgctactctggctccggaggtgccagatgtgacatccagatcgacccagtcctccactccctccctgtctgctatcgtggtaggacgacacgccgtaccacctagtccgtacgttcgggacccgggactaaacggtccgaaggacgtaccgttaagtttacggggtaaccttaaggtttttaaaccgtttaaaaggttaccgggtaaactaaacccggaaaaacccggggaaaacccggtaacggggtaaaacccctacccccttaaaactcccgtaaggtaacttcgtaagtcgaccttacggtaccttaaccgttaccgttaagttttcgggaaccgggttaaacggggttccgggggtaacccgaaggttaacgggtccgaaggggttcgggtacgtaacgggttagggtaacttaccgggagggtaaactaacgttaaccttccctaaccgttacctaaccgaacctacgttaccggaacgtaccgtaacgttaccgtaacgtaaccttaaacggttacgttaaacgtttactttaaccggaaccttaaaccttacgttacccgtaacgtaaccgtaaaggttacgttcggttaacgggttacgttacccggtttacccgttaccggttacccggttacccgggtacccggttaacgggtaaaccgtaaggtaacgtaacgttaaaccgtaccgtaaacggtcgtcggtaccgtcctacggtaccctacgttacttccttcgttccttacccg

SEQ ID NO: 110926 - DNA, 578 bp, Homo sapiens
  misc_feature: GYAE6OF01B8ANF.35.6.A06.1.454.CMB.1.raw
  modified_base (224)..(224): a, c, t, g, unknown or other
  misc_feature (224)..(224): n is a, c, g, or t
  modified_base (573)..(573): a, c, t, g, unknown or other
  misc_feature (573)..(573): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttcgccgggcaagtcagngcattggcagttctttaaattggtaatcgaaacggaaaccgagggaaacgacccctaaactcctgatctatgactgacattcctattttcgacgtaaaggtcggggtcccgacgaacggtttcaaggtgggcaggtggagtcgtgggacagtaacttacactctacaccatcgagcagtctagacctaacgtagtaagttatttacgaacctaaaccttacttatttacgtaccaaactagtaacgttaacgtacgtaccgacccgtagtacgtacacgtccttcggaaccgaagggaccaaggtcctagggaagttaagtaaacgtacgtagtacggctagacacgtnttacg

SEQ ID NO: 110927 - DNA, 478 bp, Homo sapiens
  misc_feature: GYAE6OF01BUN6X.35.6.A06.1.454.CMB.1.raw
  modified_base (467)..(478): a, c, t, g, unknown or other
  misc_feature (467)..(478): n is a, c, g, or t
tcagtacagatcgtcacgaccggtgctcgatttagatctactgacaggggtccgggagatcatgagggtgtccttgggttttgggggaagaggaagactgacggtccccccaggagttcaggtgctgggcacggtgtacctgcaaatgaacagcctgggagacgaggacacggccgtatattactgtgcgacatctgcgagggtgccttactatgacaatagtggttttggccacatctactactttgaggactggggccagggaaccctggtcgccgtctcctcagcctccaccaagggcccatcggtcttccccctggcaccctcctccaagagcacctctgggggcacagcggccccgtgggctcgccgtggtacgaaacgggtaccttaccgttacccgaacgtacttccgtacggttacctaggacgggccgggcgtcggacgaacgggccgacgaagtagnnnnnnnnnnnn

SEQ ID NO: 110928 - DNA, 430 bp, Homo sapiens
  misc_feature: GYAE6OF01DRJDK.35.6.A06.1.454.CMB.1.raw
  modified_base (426)..(430): a, c, t, g, unknown or other
  misc_feature (426)..(430): n is a, c, g, or t
tcagtacagatcgtcacgaccggtgctcgatttagatctactgacaggggtccgggagatcatgagggtgtccttgggttttggggggaagaggaagactgacggtccccccaggagttcaggtgctgggcacggtgtacctgcaaatgaacagcctgggagacgaggacacggccgtatattactgtgcgacatctgcgagggtgccttactatgacaatagtggttttggccacatctactactttgaggactggggccagggaaccctggtcgccgtctcctcagcctccaccaagggcccatcggtcttccccctggccaccctcctccaagacgcacctctggggcacagcggccctgggctgcctggtcaaggactacttccacgatctgtactgagcgggctgggcaaggcgacatagnnnnn

SEQ ID NO: 110929 - DNA, 687 bp, Homo sapiens
  misc_feature: GYAE6OF01CTLPP.35.6.A06.1.454.CMB.1.raw
  modified_base (95)..(95): a, c, t, g, unknown or other
  misc_feature (95)..(95): n is a, c, g, or t
  modified_base (189)..(189): a, c, t, g, unknown or other
  misc_feature (189)..(189): n is a, c, g, or t
tcagtacagatcgtcacgaccggtgctcgatttagatctactgacagggggagtcagtctcagtcaggacacagcatggacatgagggtccccgntcagctctggggctcctgctactctggctcgaggtgccagatgtgacatccagatcgacccagtctccatcctcctgtctgctatctgtagganacagcgtcaccatcacgttcgccgggacaagtcaagacgactagttcggctaggtttactttaaagttggttaactacgaaaccggaaaccgaagggaaaccgtacccctaaatcctagactactatcgactcgactatccttagttttcgacgtaaacggttcggggtacccgtacgtaacggttcgaggttcgggactacggttggtaacgtcggtaggaactaagtaacttcactacgttccaacctagtacaaggtcctaagtcccgagtaccgtaaacgtagtaacgttactttcgaaccctaaacttacgttacttaacggtactaaaccgtacgttaacgttaccgaacgtttaccccggaccgtcgttaactaccgtacgttacccggttacgtaacccggaaccggtacgaaacggtccggtaagggtaacgttaaagtaaaacggtcgttacggtacggacttacggaccctaacggttaacttccgg

SEQ ID NO: 110930 - DNA, 549 bp, Homo sapiens
  misc_feature: GYAE6OF01CUFCG.35.6.A06.1.454.CMB.1.raw
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
tcagtacagatcgtcacgaccggtgctcgatttagatctactgacagggggagtcagtctcagtcaggacacagcatggacatgagggtccccgctcagctcctgggctcctgctactctggctccgaggtgccagatgtgacatccagatgacccagtctccatcctccctgtctgcatctgtaggagacagcgtcaccatcacttgccgggcaagtcagagcattggcagttcttaaattggtatacaacggaacagggaacgacccctaaactctgatctatgctgcatcctattttgactaaaggtcggggtcccggactaacggttcaaggtggctaggtggatcgtggggacaggtaaacttcgtactctacacctatcagacagtctagctaactgaagttatttagacctaaactntacttntacaacagtaattacgagttaccgaccgtcgactcgagtccgttacggaccgaagggaccacggtaacgtggaaagtaacttaaaacgaacgttggtacggactagacaactgttaccg

SEQ ID NO: 110931 - DNA, 603 bp, Homo sapiens
  misc_feature: GYAE6OF01CUIS1.35.6.A06.1.454.CMB.1.raw
  modified_base (193)..(193): a, c, t, g, unknown or other
  misc_feature (193)..(193): n is a, c, g, or t
tcagtacagatcgtcacgaccggtgctcgatttagatctactgacagggggagtcagtctcagtcaggacacagcatggacatgagggtccccgctcagctccgtggggctcctgctactctggctccggaggtgccagatgtgacatccagatgacccagtctccatccctccctgtctgcatctgtagganacagcgtcaccatcacttggccggcaagtcagagcattggctagttctttaaattggtatacgaaacggaaaccagggaaacgcccctaaactcctagactctatgctgctatcctattttgactaaggtcggggtcccgagtaaggttcagtggcagtggatcgagggacagtaattcactcacacatcagctagtctgaccaacgtagaacgttattttacgacctaaaccttacttaatttacgtactaaacaggtaacgttaaccaacggtaacccgcccgacgtaactccgacggtccgttaccgggaacccgaaacggggtaccaaccggtaacgtagggtaaaggtaaacgttaaaaacggtaccgttcggtacggaccttaggaccctaaccgtagttaccg

SEQ ID NO: 110932 - DNA, 487 bp, Homo sapiens
  misc_feature: GYAE6OF01B49XM.35.6.A06.1.454.CMB.1.raw
  modified_base (243)..(243): a, c, t, g, unknown or other
  misc_feature (243)..(243): n is a, c, g, or t
  modified_base (309)..(309): a, c, t, g, unknown or other
  misc_feature (309)..(309): n is a, c, g, or t
  modified_base (352)..(352): a, c, t, g, unknown or other
  misc_feature (352)..(352): n is a, c, g, or t
  modified_base (481)..(487): a, c, t, g, unknown or other
  misc_feature (481)..(487): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggcaagtcagagcattggcagttctttaaattggtatcaacggaaaccagggaaagcccctaaaactcctgatctatgctgcatccattttgcaaagtggggtcccggnaaggttcagtggcagtggatctgggacagaattcactctcaccatcagcagtctgcaaacctgaanattttgcaacctatattgtcaaacagagttacagtacgcccgngaatcagcttcggccaagggacacgactggagaattaaaagaactgtggactgacaccatctgtctttcatcttcccgccaattctgaacgattctgtactgagcgggctggccaaggcgtcagtagannnnnnn

SEQ ID NO: 110933 - DNA, 475 bp, Homo sapiens
  misc_feature: GYAE6OF01C98Z8.35.6.A06.1.454.CMB.1.raw
  modified_base (330)..(330): a, c, t, g, unknown or other
  misc_feature (330)..(330): n is a, c, g, or t
  modified_base (470)..(470): a, c, t, g, unknown or other
  misc_feature (470)..(470): n is a, c, g, or t
  modified_base (473)..(473): a, c, t, g, unknown or other
  misc_feature (473)..(473): n is a, c, g, or t
tcagtacagatcgtcacgaccggtgctcgatttagatctactgacagggggagtcagtctcagtcaggacacagcatggacatgagggtccccgctcagctcctgggctcctgctactctggctccgaggtgccagatgtgacatccagatgacccagtctccatcctccctgtctgcatctgtaggagacagcgtcaccatcacttgccggcaagtcagagcattggcagttcttaaattggtatcaacgaacaggaaagcccctaactctgatctatgctgcatccattttgcaaagtgggtcccgcaaggttcagtggcagtggatntggacagaatcatctcaccatcagcagtctagcaacctgaagtattttgactaactactatttgtacaacgagaagttacagtacgccgcgatcagcttcggacaaggacacgactggagattaaaagacagtgactgcncgntc

SEQ ID NO: 110934 - DNA, 634 bp, Homo sapiens
  misc_feature: GYAE6OF01B8CVP.35.6.A06.1.454.CMB.1.raw
  modified_base (205)..(205): a, c, t, g, unknown or other
  misc_feature (205)..(205): n is a, c, g, or t
tcagtacagatcgtcacgaccggtgctcgatttagatctactgacaggggagtcagtcgtcagtcaggacacagcatggacatgaggtccccgctcaggctcctgggctcctgctactctggctccgaggtgccagatgtgacatccagatcgacccagtctccactccgtccctgtctgcatcgtgtaggagacagcgtcactntcactgccggacaagtcagagactagttggtctagttctttaagttgtatacgaaccggaaaccgaaggaaccgacccctaaacgtacctagtactcctatcgtctcgactaactctagttttcgacgtaaggtcggggtacccgataacggttcgaggtaggctaggtacggacgtacggtacggtacgtaagtacttacgaccgttacctaccaacctaacgtccgaagtccgtaacgttctacgtacttaacgtacgtaagttacgtttacgtaaccttaacctacgtttaacgtacgtaactaaccgtagtaacgttaacaccggttaaccgtccgtacgtactacgcgacgttacggccgaacggacgacgtacgtaggaactaacgtaaagtaacgtgtcgacgacgtacctacgtcttaccg

SEQ ID NO: 110935 - DNA, 896 bp, Homo sapiens
  misc_feature: GYAE6OF01D40X0.35.6.A06.1.454.CMB.1.raw
  modified_base (264)..(264): a, c, t, g, unknown or other
  misc_feature (264)..(264): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccggcaagtcagagcattggctagttctttaaatggtatcaacggaacaggaacncccctaaatcctagatctatgctgctatcctattttcgacgtaaaggttcgggggtaccccggacgtaaacggggtttccgaagggttcggggaccgtaagggttacggggtaacttaccggttagggggaaacctaagggtaaacttttccgaacctttaccgtaccaacccgtagttaccgaaggtacccgtaacggttcccttacggaacccctaaaacccgtttagggtaaaacggtttaacgtttttttaccggaaccccttaaaaccccgttttaaaccgtttaacgtttttaccgggtttaaaccctaaaaaccggttaacgggtttaaaccggtttttaaacccggtaaaccggggtttaaacccccgggtaccccccgggttaaccgggttaaaccgtttaccccggtaaacgggttccccgtttttaaccccgggggaaacccccggtaaaaacggggggtaaaccccgtaaacccggggttaaacccgtttaaggggggtaaaacggttaaaaaccggtttttaaaaaaaacgggtaaaccccggttttacggggttaaccgggggttacccgttaacccgggaaaccccgttaaaccccggtaacgtttttaaccccggg

SEQ ID NO: 110936 - DNA, 810 bp, Homo sapiens
  misc_feature: GYAE6OF01BQ448.35.6.A06.1.454.CMB.1.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatccctccctgtctgctatctgtagganacagcgtacaccatcacttcggccgganaagtcagagctagttggactaagtttactttaaagttggtaactacgaaaccggaaaccgaaggggaaaaccgacccccttaaaacgtccctaaggtacttacctagtcgcctacgacctaacttcccgtaagttttacggaaccgttaaacgggttccgggggttaccccgtaggtaaacgggtttcgaaggttacgggacgtaggtagggtacttggtacgggaactaagtaactttcgaacctcgtacaaccgtatacgagactacgtactacggacctaaccgttaggtaaacgtttagtttaccgaaccttaaacccgtttacgttaacgtttacggtaacctaaaccgtaacgttaacccgtttaaccggacccgggtaaccccccttacgtttaccccgttaacccggtttaccccgggaccccggttaaccggggtaacccctaaccggtaaccggttaaacccggtaaaacccgtcccggtaaacgggtaaccggttaaacccgggttaagggtcccgggttacccgttaaccggtaaccccgttaaccgttaaccgtttccgttttaccgggtttacccc

SEQ ID NO: 110937 - DNA, 629 bp, Homo sapiens
  misc_feature: GYAE6OF01B5INO.35.6.A06.1.454.CMB.1.raw
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagtcttaacttaagtgtatacgaacgaacgaggaaccacctactcagatntancgcncgctactacttagttacgaacgtagggtcgggtccgagtacgtacgtagtgacgtaggtgacgtggacggacagtactacgtactcacactactacgacgactacgtctacgaacctaacgtaacggtaagtttacgtttacgaacccttaaaccttatttacgttacgtaacctaaggtaacgttaacgttaacgtaacgggtaccccggacccgtaagtacctacgtacgtacccggttaccggaaccggtaaacggaaccgtaacgtaacgggtaagggtaaacgttaaaacgttaaaacgtacggtacggtacggtagtaccgaccctacgttaccg

SEQ ID NO: 110938 - DNA, 777 bp, Homo sapiens
  misc_feature: GYAE6OF01AQ3JC.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtcctcatcctccctgtctgcatctgtaggagacagcgtcaccatccacgttgccgggacaagtcagagcattggctagttctttaaatggtatcagcagaaaccgtggaaactcccgtaggctcctcactctatcgcttgtcctttcctactttcgaccgtaagtacggttccgggggtaccctaagttaccgtaaagggtttccaaggacgggtacctaacgtcgggtaacgtccggtacggggaacctaacggtaaccgtttccgggtcctttaccctacccgaacccgtaacgttaccgaacggtaccgttaacggttaccttaccggtaccctaaaaccccgtttagggtaaaaccgtttacggttttttaaccggaaccctttaaaaccgttttaacccgtttaaccgttacgttaaacccgtaaaaccgttaacgggttaaaccgttttaaccgaagggttttaccggtaccttttacccggttaccgggttttacccggggacgggtaaaccggggtaaccggtaaacggggttagggaaaccttaacggttaaacccgtaaaaccggttaaccggttggtaccggtactacggaaccctaccgttaaccg

SEQ ID NO: 110939 - DNA, 497 bp, Homo sapiens
  misc_feature: GYAE6OF01ESLL1.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagagcattaacaagaatttaaattggtatcagcagaaacctggaaagtcctaggctctcatcatgctgccttcactttgcaagatggggtcccatcaaggttcagtaggcactggatctgggacagaattcgctctcaccatcagcagtctgcaacctagaagtattttgactaacttactactgtacaacgagtagttacagtgcttacacgtttcggcggtaggaccgaaggtggaacagtacaaacgaactgtcggtctcgacacctatctacg

SEQ ID NO: 110940 - DNA, 491 bp, Homo sapiens
  misc_feature: GYAE6OF01AUJ08.35.6.A06.1.454.CMB.1.raw
  modified_base (482)..(483): a, c, t, g, unknown or other
  misc_feature (482)..(483): n is a, c, g, or t
  modified_base (486)..(491): a, c, t, g, unknown or other
  misc_feature (486)..(491): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggcaagtcagagcattggcagttctttaaattggtatcaacggaaaccagggaaagcccctaaaactcctgatctatgctgcatccatttgcaaagtggggtcccgcaaggttcagtggcagtggatctgggacagaattcactctcaccatcagcagtctgcaacctgaagtatttgctaacctactattgtacaacagtagttacagtacgccgcgatcagcttcggcaagggacacgactggagactaaagactgtggctgcactatctgtcttcatccttcccgcatcgtagaacgtattcgtagtactgagcgggtcgtcggacgaacgggcgacgagtacgnngcnnnnnn

SEQ ID NO: 110941 - DNA, 506 bp, Homo sapiens
  misc_feature: GYAE6OF01EH79O.35.6.A06.1.454.CMB.1.raw
  modified_base (502)..(502): a, c, t, g, unknown or other
  misc_feature (502)..(502): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttctttaaattggtatcaacggaaaccagggaaagcccctaaactcctgatctatgctgcatccattttgcaaagtggggtcccgcaaggttcagtggcagtgatctgggacagaattcactctcaccatcagcagtctgcaacctgaagtattttgacctaacctacttatttgtaccaactagtagttacagtaccgcccgcgatcagccttcggaccaaagggacacggactggaagtaattaaaagactaggtggactagcaccntccg

SEQ ID NO: 110942 - DNA, 611 bp, Homo sapiens
  misc_feature: GYAE6OF01D2NL1.35.6.A06.1.454.CMB.1.raw
  modified_base (217)..(217): a, c, t, g, unknown or other
  misc_feature (217)..(217): n is a, c, g, or t
tcagtacagatcgtcacgaccggtgctcgatttagatctactgacagggggagtcagtctcagtcaggacacagcatggacatgagggtccccgctcagctccgtggggctcctgctactctggctccgaggtgccagatgtgacatccagatgacccagtctccatcctccctgtctgcatctggtaggagacagcgtcaccatcacttgccgggnaagtcagagctagttggctagttactttaaattggtatacgaaacggaaaccgaagggaaacgaccccctaaactcctagtatctatgctgactatccttagttttcgacgtaaagggtcgggtacccggtagtaacggttcgaggtggtcaggtagagtcgtaggacaagtacttcacttcgcaacctatcgacgtcagtctcgaacaaccgtagtaagttatttacgacctaaccttacttacttacgacaactacggtaagttaccacggtacccgtacccgtagtacgtcggaccgtaccggtaccggaacggacggaaccgtacgtaggtaacgtaaagtaaacgtaaacgtaggttacggtacgtacgacgtaaccctacgtgttccg

SEQ ID NO: 110943 - DNA, 533 bp, Homo sapiens
  misc_feature: GYAE6OF01A5X1U.35.6.A06.1.454.CMB.1.raw
  modified_base (316)..(316): a, c, t, g, unknown or other
  misc_feature (316)..(316): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttctttaaatggtatcaacggaaacagggaaacgcccctaaactcctgatctatgctgcatccattttgcaaagtgggtccgnaaggttcagtgcagtgatcgtggacagattcactctcacatcagcagtctgacaactgaagtattttgacaacttactattgtacaaacagaacgttaacagtacgcccgtacgactcagtcgttaccggaccaaaggggaccaacggtaccgtagggaaagtaaacgttaaaaaggaacgttaggtacggacgttagaacctacccgtaagttccg

SEQ ID NO: 110944 - DNA, 563 bp, Homo sapiens
  misc_feature: GYAE6OF01AQ0E8.35.6.A06.1.454.CMB.1.raw
  modified_base (225)..(225): a, c, t, g, unknown or other
  misc_feature (225)..(225): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagcgtcaccatcacttgccgggcaagtcagancattggctagtttctttaaattggtatacgaacggaaaccagggaaacgcccctaaactcctagactctatgctgcatcctattttgacgtaaaggtcggggtacccggacgtaaggttcagtggcaggtggatcgtggacagtattcactctacacatcagctagtctgactaactagtaagtactttacgacctaacctacttattcgtacaactagtacgttaacacgtaccgacccgagtactacgacgtccgttcggaccgaacgggaccacggtactaggaacgtaagttaaaacgacgttaggtacggtactaggaccaacgtcgttaccg

SEQ ID NO: 110945 - DNA, 596 bp, Homo sapiens
  misc_feature: GYAE6OF01EISB4.35.6.A06.1.454.CMB.1.raw
  modified_base (567)..(596): a, c, t, g, unknown or other
  misc_feature (567)..(596): n is a, c, g, or t
tcagtacagatcgtcacgaccggtgctcgatttagatctactgacaggggtccgggagatcatgagggtgtccgtttgggttttggggggaagaggaagactgaccggtccccccaggagttcaggtgcgtgggcacggtgtacctgacaaatgaacagcctgggagacgaggacacggccgtatattactgtgcgacatctgcgaggtgccttatatgaacaagttaggttggttttcggacctaatattccttaacttacgtttggaacgggacgtggggaccaacggggtaaccccgtggtccgtccgtcctccctcgacgccctaccgaaccgaacggggcccctacgttccggtcccttccccccgtcgggccctaccccgtaccctaccaaacgacgccctaaccgtccggttcgggggaccacgacgcccggccccgtcgggccgtggtcccgtacgggtaccgaaacgggtacccttaacgttcccaacggtactccgttaggtaaccgtggaacgggccgggtacgtcgggaccgaaacgggccgtacgaagtaggannnnnnnnnnnnnnnnnnnnnnnnnnnnnn

SEQ ID NO: 110946 - DNA, 789 bp, Homo sapiens
  misc_feature: GYAE6OF01D2UAH.35.6.A06.1.454.CMB.1.raw
  modified_base (683)..(683): a, c, t, g, unknown or other
  misc_feature (683)..(683): n is a, c, g, or t
tcagtacagatcgtcacgaccggtgctcgatttagatctactgacaggggtctgagagaggagcccagccctgggattttcaggtgttttcatttggtgatcaggactgaacagagagaactcaccatgggagtttgggctgaggtggtctttttcttgtggtcttaattttaaaaggtgtccaatgtgaagtgcacctgttggagtcgtgggggaggcttggtacgagggcgggggggtccctggagacctctcctgtgcaggtcctcgtggtacttcctaaccttttagacctaaacttatcgaccctaagtcggacgtccgttcggggtccccgccgacgggtccgtcccggaaggggggggtacgggggtccgttgggggccggttacggggtacctacgtaaacgttagtttaggtcggtacgtaggtcgggttaggtaaataggaacgtaactacggacagtaaccttcgtacgtagggtaacggggtcccggttacacgtccaattcccgtaccgaacgggtaacctaacgttaaccgaaaggtacgaccgtaacgggtcgtaaccctggaaaccaaagtacggaaacctacggcccggtagggaacggaccgggaacgggtacccggaccgggtaccgttaagttaacgtttacgtcggtacgacccggtaaacncgttccggtacgggtccggggtaagggttcccgttaaaccctttaaacgttaggtaacgtaaacgttaaggttttacgggtttcgggtttacggaccccttaaacg

SEQ ID NO: 110947 - DNA, 613 bp, Homo sapiens
  misc_feature: GYAE6OF01A9RP5.35.6.A06.1.454.CMB.1.raw
  modified_base (193)..(193): a, c, t, g, unknown or other
  misc_feature (193)..(193): n is a, c, g, or t
  modified_base (600)..(600): a, c, t, g, unknown or other
  misc_feature (600)..(600): n is a, c, g, or t
tcagtacagatcgtcacgaccggtgctcgatttagatctactgacagggggagtcagtctcagtcaggacacagcatggacatgagggtccccgctcagctccgtggggctcctgctactctggctccggaggtgccagatgtgacatccagatgacccagtctcactcctccctgtctgcatcgtgtagganactagcgtacacctatctacgttcggccgggacaagtcagagcagttggctagttacttaagtgtatacgaacggaacaggaaacgccctaaactcctagactctagctctagctagtctagtttgacgtaaggtcggggtaccgacgtaaggttcgacggtaggcgtaggtaggtagtccgtagggaactacgtaaagttccaaacgtcctaccgactacgtaccacgtacctaggttcctacggaccctaacgtagtaacgttactttacgaaccttaactacttacgtacgtacaacttagtacgttaacgtagttacgtacttaccgtacggtttacggacggtacggtaacgtaggtacgaacgtacgtaacgtaagaccgtggtacgcgtacgactacgtntctcgtcgttacc

SEQ ID NO: 110948 - DNA, 599 bp, Homo sapiens
  misc_feature: GYAE6OF01CJP3T.35.6.A06.1.454.CMB.1.raw
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (596)..(596): a, c, t, g, unknown or other
  misc_feature (596)..(596): n is a, c, g, or t
tcagtacagatcgtcacgaccggtgctcgatttagatctactgacaggggggagtcagtctcagtcaggacacagcatggacatgagggtccccgctcagctcctggggctcctgctactctggctccggaggtgccagatgtgacatccagatgacccagtctccatccctccctgtctgcatctgtagganacagccgtcaccatccacttggccgggnaagtcaaggngcattggctagtttactttaaagttggtatacgaaacggaaaccaagggaaacgacccctaaactcctagatctatgctgactactctagttttgacgtaaacgggtcggggtacccgacgtaacggttcgaggtggacaggtggacgtcggtagggaacagtaacttcactctacacctataccgagtccgtagtctacgacctaaccgtaggtaagttacttttacgaaccttaaaccttacgttaacttacgaactaacgtaagtacgttaacgacgtacccgccgactactacgacgtcgttaccggacgaaggacacgacgtaggagtaaacgttaaagacgtggtagactagactcgtntcg

SEQ ID NO: 110949 - DNA, 688 bp, Homo sapiens
  misc_feature: GYAE6OF01EP76J.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagcgtcaccatcacttgccgggcaagtcagagcattggcagttctttaaattggtatacaacggaaaccagggaaacgcccctaaactcctagactctatgctgcatcctattttgacgtaaaggttcggggtacccggacgtaaggtttcagtttgggctaggtggattccgtaggggaactaaggtaactttccgaacttcctacctaaccctactacctaacggtccgtaacgttccgttacgaaccctaaacccgttggtaaaacgttacgtttttaccggaacccttaaacccgtttaaccttaacgtttacgttaaccaaaccgtaaggttaaacgtttaaccgaaccggttaacccgacccgtacgtacttaccgacgtccgttaccgggacccgtaaagggaccctaaccgggtacgttagggaaacggtaaacgttaaaaacggaacgttagggtacggtactacggacctaacccgtgttacccg

SEQ ID NO: 110950 - DNA, 441 bp, Homo sapiens
  misc_feature: GYAE6OF01DCCP2.35.6.A06.1.454.CMB.1.raw
  modified_base (428)..(441): a, c, t, g, unknown or other
  misc_feature (428)..(441): n is a, c, g, or t
tcagtacagatcgtcacgaccggtgctcgatttagatctactgacaggggtccgggagatcatgagggtgtccttgggttttggggggaagaggaagactgacggtccccccaggagttcaggtgctgggcacggtgtacctgcaaatgaacagcctgggagacgaggacacggccgtatattactgtgcgacatctgcgagggtgccttactatgacaatagtggttttgccacatctactactttgaggactggggccagggacccctggtcgccgtctcctcagcctccaccaaggcccatcggtccttccccctggccaccctcctccaagacgccacctcgtggggcacagcggccctgggctcgcctggtcaaggactactccacgatctgtactgagcgggctggacaagggcgacatagnnnnnnnnnnnnnn

SEQ ID NO: 110951 - DNA, 505 bp, Homo sapiens
  misc_feature: GYAE6OF01BFSEY.35.6.A06.1.454.CMB.1.raw
  modified_base (341)..(341): a, c, t, g, unknown or other
  misc_feature (341)..(341): n is a, c, g, or t
  modified_base (491)..(491): a, c, t, g, unknown or other
  misc_feature (491)..(491): n is a, c, g, or t
  modified_base (497)..(497): a, c, t, g, unknown or other
  misc_feature (497)..(497): n is a, c, g, or t
  modified_base (499)..(505): a, c, t, g, unknown or other
  misc_feature (499)..(505): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggcaagtcagagcattggcagttctttaaattggtatcaacggaaaccagggaaagcccctaaaactcctgatctatgctgcatccatttgcaagtgggtccgcaaggttcagtggcagtggatctgggacagaattcactctcaccatcagcagtctgcaacctgaagtattttcgactaacctattactcgacaacagtatggtnacttccgtctacgtttcggccctgggaccaaagtggataatacaaacgtacgtggtcgctgcaccatctcgtcttcgactccttcccgacctatctacgaactactcgtcgtactgacggcggtcgtggaccgagggccgcgtaagtagncgagcntnnnnnnn

SEQ ID NO: 110952 - DNA, 548 bp, Homo sapiens
  misc_feature: GYAE6OF01CO3WB.35.6.A06.1.454.CMB.1.raw
  modified_base (509)..(509): a, c, t, g, unknown or other
  misc_feature (509)..(509): n is a, c, g, or t
  modified_base (511)..(512): a, c, t, g, unknown or other
  misc_feature (511)..(512): n is a, c, g, or t
  modified_base (515)..(548): a, c, t, g, unknown or other
  misc_feature (515)..(548): n is a, c, g, or t
tcagtacagatcgtcacgaccggtgctcgatttagatctactgacagggggtccgggagatcatgagggtgtccttgggttttggggggaagaggaagactgacggtccccccaggagttcaggtgctgggcacggtgtacctgcaaatgaacagcctgggagacgaggacacggccgtatattactgtgcgacatctgcgagggtgccttactatgacaatagtggttttggccacatctactactttgaggactggggccagggaccctggtcgccgtctcctcagccctccaccaacgggcccatccggtccttcccccctggccacccctcctcccaaagacgccaccctcgtcgggggccacgacgccggccccgtgggcctcggcccgttgggtaccgaaacgggtaacccttaccgttccccgaacggtacttccgtacgttacgttcggaacgggtccggggccgttacggggaccgaacgggccgacgtaacgtaggctnanncgnnnnnnnnnnnnnnnnnnnnnnnnnnnnnnnnnn

SEQ ID NO: 110953 - DNA, 475 bp, Homo sapiens
  misc_feature: GYAE6OF01B0Q5Q.35.6.A06.1.454.CMB.1.raw
  modified_base (204)..(204): a, c, t, g, unknown or other
  misc_feature (204)..(204): n is a, c, g, or t
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
  modified_base (255)..(256): a, c, t, g, unknown or other
  misc_feature (255)..(256): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (279)..(280): a, c, t, g, unknown or other
  misc_feature (279)..(280): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
  modified_base (412)..(414): a, c, t, g, unknown or other
  misc_feature (412)..(414): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
  modified_base (438)..(438): a, c, t, g, unknown or other
  misc_feature (438)..(438): n is a, c, g, or t
  modified_base (442)..(443): a, c, t, g, unknown or other
  misc_feature (442)..(443): n is a, c, g, or t
  modified_base (445)..(447): a, c, t, g, unknown or other
  misc_feature (445)..(447): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
  modified_base (462)..(464): a, c, t, g, unknown or other
  misc_feature (462)..(464): n is a, c, g, or t
  modified_base (467)..(469): a, c, t, g, unknown or other
  misc_feature (467)..(469): n is a, c, g, or t
  modified_base (472)..(474): a, c, t, g, unknown or other
  misc_feature (472)..(474): n is a, c, g, or t
tcagtacagatcgtcacgaccggtgctcgatttagatctactgacaggggtccgggagatcatgagggtgtcctttgggttttggggggaagaggaagactgaccggtcccccaggagttcaggtgctgggcacggtgtacctgcaaatgaacagccgtgggagacgaggacacggcctatattactgtcgcgacatcgtgcgngttgcnccttactatgactaatgttggtttcgccanatctatcgttgaggnngggccaggacctgcncgtntccnncncncncgacgcnctctccncncgcacncncacncncncncgcgcacncgcgcgcgcgcgcgcgacgacgtactacgtcgtactcgtcgtcgcgcgacggcgtcgtcgtacgacgcgacgcgagngngcgcnnngcgctctcngcgcgcgcgngcgcncgcnncnnncgngncnctancgcnnncgnnngcnnnc

SEQ ID NO: 110954 - DNA, 875 bp, Homo sapiens
  misc_feature: GYAE6OF01EWOFF.35.6.A06.1.454.CMB.1.raw
  modified_base (327)..(327): a, c, t, g, unknown or other
  misc_feature (327)..(327): n is a, c, g, or t
tcagtacagatcgtcacgaccggtgctcgatttagatctactgacaggggtctgagagaggagcccagccctgggattttcaggtgttttcatttggtgatcaggactgaacagagagaactcaccatggagtttgggctgaggtggtctttttcttgtggtcttaatttaaaaggtgtccaatgtgaagtgcactgtggagtcgtggggagtcgttggtacgagggccggggggtcctggacgactctccgtgtcgcacgcctcgtggtacttcctaccgtttagacctaaactactcggacctagtgacgtcgttcggggtcccnccggacggtccgtccgggaggggggtacgggggtccgttcggggtccgggttcggggttccttaaccgtaaacgtttacggtttaacgggtcggtaccgtttaggggtaccgggttaaggggttaaaagtaacgggtaacgtaaacccgttaacggaccgtaaacggtaaccctttccggtaccggttaaggggtaaacccgggggttccccggtttaacgtaaccttacccgtacgtttacccgaaccccgggtaaaggggtaaaccctaaacgtttaccccggaaaaggtaaccggtaccggtaaccgggtttaccgttaacccgtaggaaaccgtaaaacgtcggaaaccgtccggtacccgggtaggggtaaccggaaccgggtaacggaacccggaccggggttaccttaagtttaacgttccgtaggtacgaccgtaacgtactccggtacgggcgggtaacgggttccgttaacccttaacgtagtacggttaaaccgttaaggtttaacggggttttcgggtttaccgaacccgttaacg

SEQ ID NO: 110955 - DNA, 764 bp, Homo sapiens
  misc_feature: GYAE6OF01AQVH6.35.6.A06.1.454.CMB.1.raw
  modified_base (201)..(201): a, c, t, g, unknown or other
  misc_feature (201)..(201): n is a, c, g, or t
tcagtacagatcgtcacgaccggtgctcgatttagatctactgacagggggagtcagtctcagtcaggacacagcatggacatggacgggtcccccgctcagctccgtggggctcctgctactctggctccgaggtgccagatgtgacatccagatcgacccagtctccatccctccctgtctgctatcgtgtaggagacngccgtcaccatcacgttcggccgggacaagtcagagctagttggtactagtttactttaaagttggtaactacgaaaccggaaaccgaacgggaaacctacccccgtaaactcctagtactctaatcgtcgtgactacttaccttaagtttcggaaccggtaaacgggtccggggtacccggacgtaacggttcgaggtcggacgtaggtacggtaacgtcggtacgggtaactacgtaaacttcctaaccgtcctacctaaccgactaccgagtaccgtagttaccgtacgaaacctaaccgtttaagggtaaacgtttaccgttttaccgaaacccttaaaccgtttaaccgtttaacgtttaaccggacctaaaaccggtaacggttaacgtttaaacccggaccgggttaaccccggtcccggtaaccgtacgtaccggtaaccgtacccggttaccgggaacccgtaaacggggtaaacccaacggtacggttaacgggaaacgtaaagttaaaacgggtacttacgggtacgtactacgacccttacgtacgttccg

SEQ ID NO: 110956 - DNA, 934 bp, Homo sapiens
  misc_feature: GYAE6OF01CQ0V8.35.6.A06.1.454.CMB.1.raw
  modified_base (95)..(95): a, c, t, g, unknown or other
  misc_feature (95)..(95): n is a, c, g, or t
tcagtacagatcgtcacgaccggtgctcgatttagatctactgacagggggagtcagtctcagtcaggacacagcatggacatgagggtccccgntcagctcctggggctcctgctactctggctccgaggtgccagatgtgacatccagatgacccagtctccatccctcctgtctgcatctgtaggagacagcgtcaccatctacgttggccgggacaagtcgaagagtactagttcggctaagtttacttttaaaagtttaggttaacttaccgaaaaccggggtaaaaccgaacggggtaaaaaccggtaccccccttaaaaaccgttcccgttaacggtaactttacccgttaagttcggtaccttcggtaacctaacgtttccctttaagtttttacggaaccggtaaaacgggttccgggggttaccccggtaacgttaaacgggtttccgtaaggttacgggaccgtaaggttagggtaacgttccggtacggggtaactaacgggttaaaacttcccgtaaccgtttacccacccggtaaaccctaacgtttacccgaacggtacccgttaacggttaccgtttaaccgggaaacccttaaacccgggttaaggttaaaaccggttttaacgtttttaaccggtaccccttaaaacccggtttaactttaacgttttaccggttaaacctaaaaaccggtaacgggtttaaccggtttaaaccgtaacccgggtttaaccccgggtaccccggttaacggtaaaccgtttccgtaaccggggtttacccgtttaaccggggaacccgaaaacggggtacccaaaccgggttaacggtaggggtaaaaccgtaaaagttttaaaaccgggacgttttacgggtaaccggtcgtttaccgggaacccctaaacgtcgttttacccgg

SEQ ID NO: 110957 - DNA, 853 bp, Homo sapiens
  misc_feature: GYAE6OF01DG7ZM.35.6.A06.1.454.CMB.1.raw
tcagtacagatcgtcacgaccggtgctcgatttagatctactgacagggggagtcagtctcagtcaggacacagcatggacatggagggtccccgctcagctccgtggggctcctgctactctggctccgaggtgccagatgtgacatccagatcgaccctattctccatccctccctgtctgcatctaggtaggagacagcgtacaccatcacgttcggccgggtacaagtcagagctagttggactagtttacttaaagttggtatacgaaacggaaaccgtagggaaactacccctaaacgtcctagactactatacgtctcgacacttctatttacgacgtaaacgggtcgggtacccgagtaaggtctaggtggagtaggtaggactcggtaacgggtataaggtaacttctaccgtactccgtaactacgtaccgagtaccgtagttcctacgggtaacctaacccggttagtaaaccgtttacgttttaccgtaaacccgttaaacccgtttaacttacgtttaacgttaaacctaacgttaacgggttaaacgtttaaaccggtaccccgggttaaccccggtaacccggtaaccgttaacccggtttacccggttaaccgggtaccccggtttaaaccccggggaaacccggggtaaaaccgggggtaaacccgtaaaacccgggttaacccggggttaaaaggggttaaaaaacccgggttaaaaacggttttaaaaaaacccggggttaaacggttttaaccgggggttaacccggttaaccccgggttaaccggtaaacccccgggtttaaacccggttaaaccctttttaaccccggggg

SEQ ID NO: 110958 - DNA, 651 bp, Homo sapiens
  misc_feature: GYAE6OF01ED0WL.35.6.A06.1.454.CMB.1.raw
  modified_base (346)..(346): a, c, t, g, unknown or other
  misc_feature (346)..(346): n is a, c, g, or t
  modified_base (408)..(408): a, c, t, g, unknown or other
  misc_feature (408)..(408): n is a, c, g, or t
tcagtacagatcgtcacgaccggtgctcgatttagatctactgacaggggtctgagagaggagcccagccctgggattttcaggtgttttcatttggtgatcaggactgaacagagagaactcaccatggagtttgggctgaggtggtctttttcttgtggctaattttaaaaggtgtccaatgtgaagtgcacctgttggagtcgtgggggagcttggtacaggcgggggggtccctgagactctcctgtgcagcctctggtattcacctttagcaactatgccatgagcgtggcccgcaggctccggaggggacggggctgggcgtggtctacaacgtattagngactaggcggtagtaatagacgactacgcaagaccgtctacgtaggaacgggtcccggttanagttaccattcctaccgaacgggaactaagttacccaaagacgaccgaacggttcgtaacccgtagaaccaaaagtacgaaacctaggcccgtaggggaacgaaccggaacggaacccgaaccgggtaccgttaattacgttaacgtcggtacgaccgtaactagtccgtaggaccggtagggttcgtacccttaagtagtaacgtaacctaaagttcggttttagggtttcggccctaaacg

SEQ ID NO: 110959 - DNA, 626 bp, Homo sapiens
  misc_feature: GYAE6OF01CHS1P.35.6.A06.1.454.CMB.1.raw
  modified_base (308)..(308): a, c, t, g, unknown or other
  misc_feature (308)..(308): n is a, c, g, or t
  modified_base (542)..(542): a, c, t, g, unknown or other
  misc_feature (542)..(542): n is a, c, g, or t
  modified_base (614)..(614): a, c, t, g, unknown or other
  misc_feature (614)..(614): n is a, c, g, or t
  modified_base (619)..(619): a, c, t, g, unknown or other
  misc_feature (619)..(619): n is a, c, g, or t
  modified_base (622)..(624): a, c, t, g, unknown or other
  misc_feature (622)..(624): n is a, c, g, or t
  modified_base (626)..(626): a, c, t, g, unknown or other
  misc_feature (626)..(626): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggcaagtcagagcattggctagttactttaaattggtatacaaacggaaaccagggaaacgcccctaaaactcctagatctatgctgcatcctattttgacgtaaaggtcggggtacccggacgaaggttcgaggtggcgaggtggatcgtggacagtaatcactcacacctancgagctagtctcgacctaacgtgaagtactttacgacctaaccttatagttctacaacgtagtaacgttaacgacgttaccgaccgacgtactcgacgtccgtacggaccgaagggaccacggtacgtaggaaagtaacttaaaagacgttgtacgcgtacggacaccctagttaccgtcgttaccttacctaccttcccgtacccgaccttaacttccgtaacgtaaccgttnttacccggttacgttaccgtggaccgggtacggccggttaacggaccgtacggggacaccgttagacgccgngtacngannngn

SEQ ID NO: 110960 - DNA, 743 bp, Homo sapiens
  misc_feature: GYAE6OF01EB73K.35.6.A06.1.454.CMB.1.raw
  modified_base (94)..(94): a, c, t, g, unknown or other
  misc_feature (94)..(94): n is a, c, g, or t
  modified_base (136)..(136): a, c, t, g, unknown or other
  misc_feature (136)..(136): n is a, c, g, or t
  modified_base (161)..(161): a, c, t, g, unknown or other
  misc_feature (161)..(161): n is a, c, g, or t
  modified_base (220)..(220): a, c, t, g, unknown or other
  misc_feature (220)..(220): n is a, c, g, or t
tcagtacagatcgtcacgaccggtgctcgatttagatctactgacagggggagtcagtctcagtcaggacacagcatggacatgagggtccccntcagctcctgggctcctgctactctggctccggagtgccagntgtgacatccagatcgacccagtcnccatccctcctgtctgctatcgtgtaggagacgagcgtcaccatcacgttcggccgganaagtcagacgctagttcggactagtttactttaaagtggtaactacgaacggaaacagggaaacctacccctaaacgtcctagactcgtagtcgctcgctactcttagtttagacgtaaagggtcggggtacccgagtaacggttcgaggtcggacgtaggtggacgtcggtacgggactaaggtacttccgtactcctaccgactacgtacgacgtacgtacgtacctacgaaccgtaacgttaggtaaacgtttacgttttaccggaacccttaaaccgtttacgttaacgttacgtaaaccgtaacgtaacggttaacgtttaaccggaaccgggttaaccccggaccccggtaacgttacttaccggtaaccggtttacccggttaaaccggggaacccgtaaacggggaacccgtaaaccggggttaacggttaacggggaaaacttaaaacgggttaaaacggaccggtttacgggttacggtaccgtacgggtaaccctaccgtaggtttacccgg

SEQ ID NO: 110961 - DNA, 715 bp, Homo sapiens
  misc_feature: GYAE6OF01B57Y9.35.6.A06.1.454.CMB.1.raw
  modified_base (316)..(316): a, c, t, g, unknown or other
  misc_feature (316)..(316): n is a, c, g, or t
  modified_base (366)..(366): a, c, t, g, unknown or other
  misc_feature (366)..(366): n is a, c, g, or t
tcagtacagatcgtcacgaccggtgctcgatttagatctactgacaggggtctgagagaggagcccagccctgggattttcaggtgttttcatttggtgatcaggactgaacagagagaactcaccatggagtttgggctgaggtggctttttcttgtggctattttaaaaggtgtccaatgtgaagtgcacctgttggagtctggggaggcttggtacaggcggggggggtccctggagactctccgtgtgcagcctctggattcacctttagcaactatgccatgagcgtgggtccgccaggctccgagggggngggctggcgtgggtctcaactagttagtgctaggcggtaggtaatagganactacgcagactctcgtaggaacgggtccggttcaactcgaactccgtacccgaaggggaacctaacgtttacccaaaggacgtaccgtaaccgggttacgttaacccgtagaacctaaaacgtcggaaaaccgtacggcccggttaagggggaacggaaccgggaacgggtaacccgaacccggggttacccggttaaagtttaacgtttaccgttacggttacggccggtaaccgtacgtacccgttgggacccgggtagggggttacgtaccccggttttaaactacgttacggtaaaccttaaggtttaacgggtttcggggttttttaccggaccccgttaacg

SEQ ID NO: 110962 - DNA, 539 bp, Homo sapiens
  misc_feature: GYAE6OF01B63CC.35.6.A06.1.454.CMB.1.raw
  modified_base (319)..(319): a, c, t, g, unknown or other
  misc_feature (319)..(319): n is a, c, g, or t
  modified_base (341)..(341): a, c, t, g, unknown or other
  misc_feature (341)..(341): n is a, c, g, or t
  modified_base (361)..(361): a, c, t, g, unknown or other
  misc_feature (361)..(361): n is a, c, g, or t
  modified_base (528)..(529): a, c, t, g, unknown or other
  misc_feature (528)..(529): n is a, c, g, or t
  modified_base (534)..(539): a, c, t, g, unknown or other
  misc_feature (534)..(539): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggcaagtcagagcattggcagttctttaaattggtatcaacggaaacctagggaaagcccctaaaactcctgatctatgctgcatcctattttgacgtaaaggtcggggtcccggacaaggttcagtggcgagtggatcgtgggacagattcactctcaccatcagcagtctgacaactgaagtntttgacaactactattgacaanagtagtacagtaccgcccgngatcagtcgtcggaccaagggacacgactaggaagtaattaaaagacgtagtaggactagaccgacctagtctagtcttcactccttccgctacttcgtacgtaaccgtattccgttacgtactggacggtccggcgtacgggtacgtacgggtccgactaacgacnncgacnnnnnn

SEQ ID NO: 110963 - DNA, 643 bp, Homo sapiens
  misc_feature: GYAE6OF01DHMMY.35.6.A06.1.454.CMB.1.raw
tcagtacagatcgtcacgaccggtgctcgatttagatctactgacaggggtctgagagaggagcccagccctgggattttcaggtgttttcatttggtgatcaggactgaacagagagaactcaccatggagtttgggctgaggtggtctttttcttgtggcttaattttaaaaggtgtccagtgtgaggtgcagctgttggagtcgtgggggagcttggcacgagccggtgggggtccctgacgactctcctgtgcagcctctggattccacctttagcctacctatggcatgagcgtgggtccgccggctccgaggggagggctgggaggtcgggtctcaactgttagagtggtagtcgctacaataaccacgtagtcggtaccgcgacgtaccgtccggtaggaccgggggtcccgttcaacccgtactcctaccgaaggaacgaaccctaacttacccgaaaggaaccacggtcttacgtaactactaaacgtaaagtcggaactagtcgtaggacgacggccgaaggacctaccggtactttaagtacttacgtggtacggaacggttaaacgttccggaaacgtgggtacggcgtacggggacctaacggggagggttacgggaattcggtaacggg

SEQ ID NO: 110964 - DNA, 635 bp, Homo sapiens
  misc_feature: GYAE6OF01C1SID.35.6.A06.1.454.CMB.1.raw
  modified_base (95)..(95): a, c, t, g, unknown or other
  misc_feature (95)..(95): n is a, c, g, or t
  modified_base (192)..(192): a, c, t, g, unknown or other
  misc_feature (192)..(192): n is a, c, g, or t
tcagtacagatcgtcacgaccggtgctcgatttagatctactgacagggggagtcagtctcagtcaggacacagcatggacatgagggtccccgntcagctcctggggctcctgctactctggctccgaggtgccagatgtgacatccagatcgacccagtctccatccctccctgtctgcatctgtagganacagcgtacaccatccacgttcggccgggacaagtcaagagtctagttggctagttttactttaaagttggtaactacgaaaacggtaaaccgaacgggaaaaccgtcccccttaaaacgtccgtagtaacttacgtagtcgtactcgactacttccttagttttacgaacgtaaacgggttccggggtacccgtagtaacggttctaggttcggacgtaggtgacgtcggaggtacagtactacactcacacatcagctagtcacgtactaacgtagtaacgttactttcgaaccttaacttacttagttacgtaacaacgtagtaacttacgaccgtaccgaccgagtacgtcgtacgtccgtacggacgaacggtaccaacggtacgtaggaaaggttaaactaaacggtcgtggacgtactacgactaacgtcgttacg

SEQ ID NO: 110965 - DNA, 620 bp, Homo sapiens
  misc_feature: GYAE6OF01BNYMB.35.6.A06.1.454.CMB.1.raw
  modified_base (214)..(214): a, c, t, g, unknown or other
  misc_feature (214)..(214): n is a, c, g, or t
  modified_base (555)..(556): a, c, t, g, unknown or other
  misc_feature (555)..(556): n is a, c, g, or t
  modified_base (561)..(562): a, c, t, g, unknown or other
  misc_feature (561)..(562): n is a, c, g, or t
  modified_base (564)..(564): a, c, t, g, unknown or other
  misc_feature (564)..(564): n is a, c, g, or t
  modified_base (566)..(568): a, c, t, g, unknown or other
  misc_feature (566)..(568): n is a, c, g, or t
  modified_base (571)..(572): a, c, t, g, unknown or other
  misc_feature (571)..(572): n is a, c, g, or t
  modified_base (574)..(574): a, c, t, g, unknown or other
  misc_feature (574)..(574): n is a, c, g, or t
  modified_base (580)..(580): a, c, t, g, unknown or other
  misc_feature (580)..(580): n is a, c, g, or t
  modified_base (587)..(587): a, c, t, g, unknown or other
  misc_feature (587)..(587): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (600)..(604): a, c, t, g, unknown or other
  misc_feature (600)..(604): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (610)..(620): a, c, t, g, unknown or other
  misc_feature (610)..(620): n is a, c, g, or t
tcagtacagatcgtcacgaccggtgctcgatttagatctactgacaggggtccgggagatcgatggagggtgtccgttggggttttggggggaagaggaagactggaccggtccccccaggagttcaggtgctgggcacggtgtacctgcaaatgaacagcctgggagacgaggacaacggcgtatatactgtgcgacatctggcgaggggtcnccttactatggaactaagttaggttcggttttggcccacattctaacttacgtttggaggaccgtggggcccaaggggtaacccctgggtccgccgtcctccctacacgccctccgacccaacggggcccctagtccgggtcccttccccccgtcggcccaccccgtcctaccgaaacgacgcctaacccgtccggtcggggggtccaaccgtacggccccggcccggtcgggccgttcgcccggttgggtaccgaacggggtaccttaccttacccgacgtacttcgttacgtacgtggacggccggggtctcgggaccgaacgggccgactaagtaggnngcgtnncntnnncgnncnctcgcncgcgtcnctcgcgngngngnnnnngngngnnnnnnnnnnn

SEQ ID NO: 110966 - DNA, 742 bp, Homo sapiens
  misc_feature: GYAE6OF01A9VA1.35.6.A06.1.454.CMB.1.raw
tcagtacagatcgtcacgaccggtgctcgatttagatctactgacaggggtctgagagaggagcccagccctgggattttcaggtgttttcatttggtgatcaggactgaacagagagaactcaccatggagtttgggctgaggtggtctttttcttgtggtcttaattttaaaaggtgtccaatgtgaagtgcacctgttggagtcgtgggggagtcgttgggtacgagggtccggggggggtccctggacgtaccttccgtccgtggtcgctacgccttcgtaggtacttcctaacctttagacctaaacttagtcgtactagtggacgtcgtcggggtcccgccgacgggtccgtaccgggaggggggacggggtcgtcggggtccggttacggggtcctacgtaaacgttagttacggtgtaccgttaggcgggttaggtaaataggaacgtacgtaccgcaacgtaccttcgtacgtacggggaacgggttcccggttacacgttccacgttccgtaccggaacgggtaacctaacgttaccgaaagacgaccgtacggtactaccgtagaacaaagtacgaacgcggtacccggtagggaacgacggaacggtaccgacgggtaccgttaattacgttacgtggtacgacgtaactcgtcgtgggaccggttagggtcctacctttaacgtagtaacgtaacgttaagtttagggttcggtttccggaccttaacg

SEQ ID NO: 110967 - DNA, 610 bp, Homo sapiens
  misc_feature: GYAE6OF01AT62I.35.6.A06.1.454.CMB.1.raw
  modified_base (605)..(605): a, c, t, g, unknown or other
  misc_feature (605)..(605): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgaccccagtcctccatccctccctgtctgcatctgtaggagacagcgtcaccatcacttggccgggacaagtcagagcagttggctagtttactttaaagtgtatacgaaacggaaacgagggaaacacccctaaactctagtatctatcgtctgctacttcctattttcgacgtaacggtcggggtacccggtacgtacggttacgaggtggcgtaggtcggattcggaggacgtagtaattcactcctacaccacgtacacgtctagtccgtacgaaccgtaaccgtggtaaacgtttacgttttaccgaaccttaacccttaagttacttacgtaaccaagtacggtaacttaaccgacgtacccgtcccgacgtatcgtacgtccgttacggaccgtaaccggacacggtacggtagaacgtaaacgtaaagtacgtgtagacctagcnctgtc

SEQ ID NO: 110968 - DNA, 581 bp, Homo sapiens
  misc_feature: GYAE6OF01A7V14.35.6.A06.1.454.CMB.1.raw
  modified_base (410)..(410): a, c, t, g, unknown or other
  misc_feature (410)..(410): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggctagttctttaaatggtatcaacggaaaccagggaaacgcccctaaactcctagatctatgctgcatcctattttgacgtaaaggtcggggtacccgacgtaacggttcaggtggcaggtggatcgtggacagtaattcactctacacatcagctagtctacgacctaacgtgtaacgtntttacgacctaacctacttattcgtacaacgtagtaacgttaacacggtacccgcccgtacgtactcgacggtctaccgggaccgaacggggacctaacgggaccgttaagggaacgtaaagttaaaaacggacgttacggtacggacttacggacctaccgtagttaccg

SEQ ID NO: 110969 - DNA, 636 bp, Homo sapiens
  misc_feature: GYAE6OF01CHJTC.35.6.A06.1.454.CMB.1.raw
  modified_base (96)..(96): a, c, t, g, unknown or other
  misc_feature (96)..(96): n is a, c, g, or t
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (303)..(303): a, c, t, g, unknown or other
  misc_feature (303)..(303): n is a, c, g, or t
tcagtacagatcgtcacgaccggtgctcgatttagatctactgacaggggggagtcagtctcagtcaggacacagcatggacatgagggtccccgntcagctcctgggctcctgctactctggctccggaggtgccagatgtgacatccagatgacccagtctccatccctcctgtctgcatctggtaggagacagcgtcaccatcacttggccggnaagtcagngctattggctagtttactttaaatgtatacgaaacggaaaccgagggaacacccctaaactcctagactactatgctnctatccttatttcgacgtaacgggtccgggtacccggagtaaggttcaggtggcgtaggtggtagtcggtagggaactaagtacttcaccttctacctacactcacgctacgtcgacactaacgtagtaagttcgtttacgaccttaacctacttacgttacgtactaacgtagtaaccgttaacgtacggtaacccgtccgtacgtacgtaccgtacggtaccggtaccggaaccggtaacgggaaccgtaacggtacggttaaggaaacggtttaaaacgtaaaccgtaacggttggtacggtacctacggaccctaaccgtggttacccg

SEQ ID NO: 110970 - DNA, 690 bp, Homo sapiens
  misc_feature: GYAE6OF01A5ZHD.35.6.A06.1.454.CMB.1.raw
  modified_base (94)..(94): a, c, t, g, unknown or other
  misc_feature (94)..(94): n is a, c, g, or t
  modified_base (231)..(231): a, c, t, g, unknown or other
  misc_feature (231)..(231): n is a, c, g, or t
  modified_base (563)..(563): a, c, t, g, unknown or other
  misc_feature (563)..(563): n is a, c, g, or t
  modified_base (659)..(659): a, c, t, g, unknown or other
  misc_feature (659)..(659): n is a, c, g, or t
  modified_base (678)..(678): a, c, t, g, unknown or other
  misc_feature (678)..(678): n is a, c, g, or t
  modified_base (684)..(684): a, c, t, g, unknown or other
  misc_feature (684)..(684): n is a, c, g, or t
tcagtacagatcgtcacgaccggtgctcgatttagatctactgacagggggagtcagtctcagtcaggacacagcatggacatgagggtccccntcagctccgtgggctcctgctactctggctccgaggtgccagatgtgacatccagatcgacccagtcctccacttcctccctgtcctgccattcgtagtacggagactagccgtcacctatcacgttcggccggganaagtccgagacgctagttcggactagtttacgtttaaagttggtaactaccgaaacggaaaccgaaggggaaaaccgtacccccttaaaacgtcccgtaggtaacttaccttaacgtacgtacccgtagtaacctacttcccgttaagttttacgaacggttaaaccgggttcgggggttaaccccgaccgttaaagggtttaccgaaggggttcggaacgtacgggttacggtacgttcgggtaacggtaagtacgttaactttcgaacctctaccgacctagtacagactacgctacgacgtactagtaacttgttacaccttactacgnttcataacgtagtagtaacctcgtaaccggctacgtactacggtcgtacccgtacggaccgacgggtaccacgtacgtaacggtataaacgtaaanagtacgtaggacttaaccnctacgnttaccg

SEQ ID NO: 110971 - DNA, 734 bp, Homo sapiens
  misc_feature: GYAE6OF01BVEMI.35.6.A06.1.454.CMB.1.raw
  modified_base (96)..(96): a, c, t, g, unknown or other
  misc_feature (96)..(96): n is a, c, g, or t
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (616)..(616): a, c, t, g, unknown or other
  misc_feature (616)..(616): n is a, c, g, or t
tcagtacagatcgtcacgaccggtgctcgatttagatctactgacagggggagtcagtctcagtcaggacacagcatggacatggagggtccccgntcagctccgtgggctcctgctactctggctccgaggtcgccagatgtgacatccgagatcgaccccagtcctaccactcctcctgtctagcatcgtagtagganacagtcctacacctatcgtacgtcggaccgggactacgtnacgnactggttcgacgtagtttaacgtttaaagtggtaactacggaaacggaaaccgaacgggaaacctaccccgtaaatcctacgtacttacgtacacggtactcgactacgttaccttaagttttacggaacgtaacggggtcccggggtacctaccgtaaggttccgaggttcgaggtacgggtgaacgttggtagactaacgtacctacaccgttactccaagtcgtacgacgtaccgtcgttaccgacgtaacctaacggttagtaaccttttacgtacgtaaaccgtaacctttaagtccttaaccggtaaactaaccgttaggtacccttaaccggtacgtaaccccgtccggtaattaccggtaccgnggttaccccgtaacggggacccttaaagggaccttacgggtaaggtacgggtaaaattaaaccgggttaaagcgggttaacaccgggtaaccttccggaactaacccggttgtaccgg

SEQ ID NO: 110972 - DNA, 850 bp, Homo sapiens
  misc_feature: GYAE6OF01ESMO9.35.6.A06.1.454.CMB.1.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
tcagtacagatcgtcacgaccggtgctcgatttagatctactgacagggggagtcagtctcagtcaggacacagcatggacatggacgggtccccgctcagctccgtggggctcctgctactctggctccggaggtgccagatgtgacatccagatcgacccagtcctccactccctcctgtctgctatctggtagganacagccgtacacatcacgttcggccggganaagtcgagacgctagttcggacttagtttactttaaagtcggtaactaaccgaaacggaaaaccggaagggaaacctaccccttaaaactccgtaagtaacttactaagtcgacttacgactacttaccttagtttacgaacgtaacgggttccggggacccgtagtaaggttcgaaggtcggacgtaggtacggtacgtcgggtaacgggaacttaaggtaacctttaccggaacctttacctaccaaaccgttacgtaccggtaacgtaccgttaacggttaccgtacggtaaacccgttaaaccggttaagttaaaccggttttacgttttaacccggaaaccctttaaaacccgtttaacgtttaaccgttaccgtaaacccgtaaaacgttaacgggtttaacgtttaaccgaaacccgggtttccccggaacccggttacgtaaccgttaaccgggtacccgggttacccggttaacccggggaaacccggtaaacggggtaacccgtaaaccgggttaaacggaacgggttaaaacgttaaaaacggttaaacgggaaaccgttcgggtaacggtaaccttaaccggaaccgtttaccgtaacggttttacccg

SEQ ID NO: 110973 - DNA, 529 bp, Homo sapiens
  misc_feature: GYAE6OF01E0QIE.35.6.A06.1.454.CMB.1.raw
  modified_base (483)..(483): a, c, t, g, unknown or other
  misc_feature (483)..(483): n is a, c, g, or t
  modified_base (517)..(517): a, c, t, g, unknown or other
  misc_feature (517)..(517): n is a, c, g, or t
  modified_base (521)..(529): a, c, t, g, unknown or other
  misc_feature (521)..(529): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggcaagtcagagcattggcagtttctttaaattggtatcaacggaaaccagggaaacgcccctaaactcctgatctatgctgcatcctattttgacaaaggtcggggtcccggcaaggttcaggtggcagtggatcgtgggacagattcactctcaccatcagcagtctgaccaacctgtaagtattttgacctaacctactattcgtacaacagagttacagtaccgcccgtacgactcagtcgttacggaccgaagggacacgacgtaggaagtaagttaaaagacgttaggtcgctacgactacctatctacgtcttcacttcctcccgctatcgtacgtaacgtnttctagtacgtgacgtcgggcgtggacgagcganatgnnnnnnnnn

SEQ ID NO: 110974 - DNA, 733 bp, Homo sapiens
  misc_feature: GYAE6OF01CD2PK.35.6.A06.1.454.CMB.1.raw
  modified_base (94)..(94): a, c, t, g, unknown or other
  misc_feature (94)..(94): n is a, c, g, or t
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (331)..(331): a, c, t, g, unknown or other
  misc_feature (331)..(331): n is a, c, g, or t
  modified_base (718)..(718): a, c, t, g, unknown or other
  misc_feature (718)..(718): n is a, c, g, or t
tcagtacagatcgtcacgaccggtgctcgatttagatctactgacagggggagtcagtctcagtcaggacacagcatggacatgagggtccccntcagctctgggctcctgctactctggctccggaggtcgccagatgtagacatccagatcgacccagtcctccactccctcctgtctcgctatctaggtacgganacaggtcctacaccatctacgtcggaccggganaagtcgaaganactagttcggcttaagtttactttaagtacggtaactaccgaaaaccggaacgaacgggaacctacccctaaacgtcctagacttatancgtacgtctactactacgttacgtttacggaacgtaacggtcggggtacccgtaaggtacggttacgaggtagtaccgtaggtcgtaacgtcggtaacggactaagttaacctacctaactcctacaactacgtaccgacgtaccgtacttaccgtacgtaaccgtaaacctaagggtaactttacgtttaaaccggacgttaaacccttagttaaccgttacgtaacctaaacgtaacgggttaacttaacgtaaccgtacggtaccgtacgtacgtaaccgtagtaacccgtccggttaaccggaaaccggtaacccgggaacgtaaccggtaagttaaacggaaccgtaaaaattaaaccgggtagttacggtagtacccgtanaccctacggttaacc

SEQ ID NO: 110975 - DNA, 764 bp, Homo sapiens
  misc_feature: GYAE6OF01BSKWO.35.6.A06.1.454.CMB.1.raw
  modified_base (282)..(282): a, c, t, g, unknown or other
  misc_feature (282)..(282): n is a, c, g, or t
  modified_base (388)..(388): a, c, t, g, unknown or other
  misc_feature (388)..(388): n is a, c, g, or t
  modified_base (761)..(761): a, c, t, g, unknown or other
  misc_feature (761)..(761): n is a, c, g, or t
tcagtacagatcgtcacgaccggtgctcgatttagatctactgacgagggggagtcagtctcagtcaggacacagcatggacatggacgggtccccgctcagcctccgtggggcctcctgctactctggcctccggaggtcgccgagatggtcgactactccgaagacgtcgacccctaggttccctaccctaccttcccccttcccttggttcctcgactacgttcgttaggaagggacgacacggtcctaccaacctatcctacgttcgggacccggganaacgtcgaaggcgctaggttggaccttaagttttacgtttaaagtggtaactacggaaaccggaaacgaagggaaccctaccccttaacgtctagacttacgttancgctcgacctacgttacttagtttacggaacgggttaaccggggttccgggtaacccggtacgttaaggggttcgtaaggggttcggacgggttaaggtacgtacggttacggggtaacgggaccttaaagggtaaactttcccaaccgtttccgaacccgtaccgttacgcgtaaacgtcgttacgttaccacgaacccgtaagttagtacggtttacttaccgaaaccttacctttagtaccgtactaaccgaattaggttaactaacggtaccggtcccacgtatacctaggcgttaccgtaccggaaccggaaggtaccaccgtaggacggtaaattaaagtaacgcggtgtcgataccgactacgttntcg

SEQ ID NO: 110976 - DNA, 586 bp, Homo sapiens
  misc_feature: GYAE6OF01BJMTB.35.6.A06.1.454.CMB.1.raw
  modified_base (94)..(94): a, c, t, g, unknown or other
  misc_feature (94)..(94): n is a, c, g, or t
  modified_base (222)..(222): a, c, t, g, unknown or other
  misc_feature (222)..(222): n is a, c, g, or t
  modified_base (403)..(403): a, c, t, g, unknown or other
  misc_feature (403)..(403): n is a, c, g, or t
tcagtacagatcgtcacgaccggtgctcgatttagatctactgacagggggagtcagtctcagtcaggacacagcatggacatgagggtccccntcagctcctgggctcctgctactctggctccgaggtgccagatgtgacatccagatgacccagtctccatcctcctgtctgcatctgtaggagacagctacaccatcacttggccggtcaagtcaganctattgactagtttactttaaagttgtatacgaaacggaaccagggaaactaccccgtaaactcctagactctacgtgctagactagtcctattttcgacgtaaaggttcggggtacccgagtacggttacaggtgctagtggactcgtaggactagtacttcactctacactatcagtcngtactcgactaactgtaacttatttacgactaaccttatagttacgtacaacgtagtacgttacaacgtaccgaccgtatacgtacgacgtccgttaccggaaccgtaacgggacgaacgtaacggtaggaacgttaaacgtaaacgtaccgtaggtacgacgtacgacctacgtagttaccg

SEQ ID NO: 110977 - DNA, 743 bp, Homo sapiens
  misc_feature: GYAE6OF01CLZC2.35.6.A06.1.454.CMB.1.raw
  modified_base (732)..(732): a, c, t, g, unknown or other
  misc_feature (732)..(732): n is a, c, g, or t
  modified_base (736)..(736): a, c, t, g, unknown or other
  misc_feature (736)..(736): n is a, c, g, or t
  modified_base (738)..(738): a, c, t, g, unknown or other
  misc_feature (738)..(738): n is a, c, g, or t
  modified_base (741)..(743): a, c, t, g, unknown or other
  misc_feature (741)..(743): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggacaagtcagagctattggctagtttactttaaagttggtaatacgaaacggaaaccaagggaacgacccctaaaactcctagactctagtgctgactactacctagttttacgaacgtaaacgggtcggggtaccggtacgtaacggttaccgaggttacgggaccgtaagggttaggtaacgttaccggtaagggggtaaactaaacgggttaacgttttaaccgaaccttaccggttaaccaaaccccgtaattaacgtaacggaccgtaacggttaccgtacggaaccctaaacggtaggtaaacgttacttttacggaaccctaaacttaacgttaattacgaacaaacgtaacgtaagtaacgtacggtaaccgacccgtagtaactcgacgtccgtacgggaccgaaagggacctttaacggaagtacggaaagtaaacgttaaaatcggtagtacggactgaaccgtactaattcgtacgttcctacgtacttccgtccgactaagttcgaaacgtacgtacttacgtacgttacgaacgggacgtccgggtagtaccgggaacgtaaccgggatacgtaagaggacanacananacnnn

SEQ ID NO: 110978 - DNA, 781 bp, Homo sapiens
  misc_feature: GYAE6OF01D6G0O.35.6.A06.1.454.CMB.1.raw
  modified_base (96)..(96): a, c, t, g, unknown or other
  misc_feature (96)..(96): n is a, c, g, or t
tcagtacagatcgtcacgaccggtgctcgatttagatctactgacagggggagtcagtctcagtcaggacacagcatggacatgacgggtccccgntcagctccgtgggctcctgctactctggcctccggaggtgaccagatgtcgacatccagactacgaccctagttcctccactccccttcccgtgtcctgctagttcgtggtaacggagacacgtccgtccaacctatccgtacgttcggacccggggactaacggtcgaaggtacgacgtaggtttacgggtacttaagtttttaacgttttaaagtttacgggttaaccttaaaccggaaaaaccggggtaaaaccggtaaacggggtaaaaccctaaccccccgttaaaaccttccgtagtaccttacgtacgtccgtcgtacgacctacttaccttagttttacggaaccggttaacggggttccggggtacccgtaacggtaacggttcgtaaggtcggtacgtaggttggtaacgtacggtaggaactaagtaacttccaacgtcctaccactagtaccgacgtacctagttccgtacgaacctaacggttagtaacgtttactttaccgaaccttaaacttacgttacttacgtaactaacgtacgtaacgttaccgaaccggtaccgccgtacgtacttcgacgttccgtaacggaccgaacgggtactaacgggtacgtaaggaacgtaaacgtaaacggtcgtacgggtcgtacgtacctacctaccgttctaccg

SEQ ID NO: 110979 - DNA, 666 bp, Homo sapiens
  misc_feature: GYAE6OF01BAOR0.35.6.A06.1.454.CMB.1.raw
  modified_base (661)..(661): a, c, t, g, unknown or other
  misc_feature (661)..(661): n is a, c, g, or t
tcagtacagatcgtcacgaccggtgctcgatttagatctactgacagggggagtcagtctcagtcaggacacagcatggacatgagggtccccgctcagctccgtggggctcctgctactctggctccgaggtgccagatgtgacatccagatgacccagtctccatccctccctgtctgcatctgtaggagacagcgtcaccatcacttggccgggacaagtcagagctattggctagtttactttaagttggtatacgaaacggaaaccgaagggaacgacccctaaactcctagactctatcgtctgctactcctagttttacggacgtaaacggttcgggggtaccccggtacgtaaacgggtttcgaaggttcggacgtacggtaggacgttcgtacggggaacgtaacgtaacgttcaccgtcctaccgaccctataccgagtccgtacgttcctacgaaccgtaaccggttagtaacgttacttttacgacccttaaaccttacttagttacgtaactaaaccgtagtaacgttaacaaccggtacccgacccgtacgtactcgtacgtccgtaaccggaccgaaacgggtacaccggtacgtagggaacgtaaacgttaaacgacggtacgtacgggactacgacctaccgtnttacg

SEQ ID NO: 110980 - DNA, 559 bp, Homo sapiens
  misc_feature: GYAE6OF01AM6NA.35.6.A06.1.454.CMB.1.raw
  modified_base (525)..(525): a, c, t, g, unknown or other
  misc_feature (525)..(525): n is a, c, g, or t
  modified_base (527)..(559): a, c, t, g, unknown or other
  misc_feature (527)..(559): n is a, c, g, or t
tcagtacagatcgtcacgaccggtgctcgatttagatctactgacaggggtccgggagatcatgagggtgtccttgggttttggggggaagaggaagactgacggtccccccaggagttcaggtgctgggcacggtgtacctgcaaatgaacagcctgggagacgaggacacggccgtatattactgtgcgacatctgcgagggtgccttactatgacaatagtggtttggccacatctactacttgaggacgtggggccagggaaccctggtcgccgtctcctcacgcctccaccaagggcccagtccggttcccttcccccgcggccctacccctccctacccgaaagcgccacccgtcgtcgggggccaccgacggccgggtccccgtggggcctcggtcccgttgggtaccgaaacggggtacccttaaccctttcccgaaccggtactttccgtaggttaccgtggaacgggtccggggtccgttacggggaccgaaaggggcccgtacgaagttacggnannnnnnnnnnnnnnnnnnnnnnnnnnnnnnnnn

SEQ ID NO: 110981 - DNA, 658 bp, Homo sapiens
  misc_feature: GYAE6OF01D47Q8.35.6.A06.1.454.CMB.1.raw
  modified_base (621)..(624): a, c, t, g, unknown or other
  misc_feature (621)..(624): n is a, c, g, or t
  modified_base (626)..(658): a, c, t, g, unknown or other
  misc_feature (626)..(658): n is a, c, g, or t
tcagtacagatcgtcacgaccggtgctcgatttagatctactgacagggggtccgggagatcatgagggtgtccttgggttttggggggaagaggaagactgacggtccccccaggagttcaggtgctgggcacggtgtacctgcaaatgaacagcctgggagacgaggacacggccgtatattactgtgcgacatctggcggagggtcgtccttactatgactaatagttggtttgccacatctacttactttgaggacgtggggccgacggggaccctggtccgccgtcctcctcgacgccctcccgaaccgaacggggcccctacgttcccggttcccctttacccccccgtcgggtacccctacccccgttccccgttaacccggaaacggtaccggaccccgtaaccccggttccggggtaccgggggggacccaaacccgggacccggggtccccgggtcccccgggttcggggtccctccgggtcccggtttacggggtaaccgaaacggggttacccttaccgtttaccccgaacgtacttccggttacgttacgtacgggacgggtccggggtaccgttacggggaaccggaacgggccgaactagtacggnnnngnnnnnnnnnnnnnnnnnnnnnnnnnnnnnnnnn

SEQ ID NO: 110982 - DNA, 505 bp, Homo sapiens
  misc_feature: GYAE6OF01C1P4P.35.6.A06.1.454.CMB.1.raw
  modified_base (324)..(324): a, c, t, g, unknown or other
  misc_feature (324)..(324): n is a, c, g, or t
  modified_base (476)..(476): a, c, t, g, unknown or other
  misc_feature (476)..(476): n is a, c, g, or t
  modified_base (478)..(505): a, c, t, g, unknown or other
  misc_feature (478)..(505): n is a, c, g, or t
tcagtacagatcgtcacgaccggtgctcgatttagatctactgacagggggtccgggagatcatgagggtgtccttgggttttgggggggaagaggaagactgacggtccccccaggagttcaggtgctgggcacggtgtacctgcaaatgaacagcctgggagacgaggacacggccgtatattactgtgcgacatctgcgagggtgccttactatgacaatagttggtttgccacatctactcttgaggactggggccagggacctggtcgccgtctcctcacgccctccaaccgaacggcccatccggtccttccccccgnggcctaccccctcctaccaagacgccaccctcggtcgggggacacgacggcccggcccgtgggcctcgccgtggtacgaacggacttaccttccacgacttcgtcgtactggacggcgggtcgtcgggacgtaacgggccgacaacgtggcngnnnnnnnnnnnnnnnnnnnnnnnnnnnn

SEQ ID NO: 110983 - DNA, 814 bp, Homo sapiens
  misc_feature: GYAE6OF01AGTN0.35.6.A06.1.454.CMB.1.raw
tcagtacagatcgtcacgaccggtgctcgatttagatctactgacaggggtctgagagaggagcccagccctgggattttcaggtgttttcatttggtgatcaggactgaacagagagaactcaccatggagtttgggctgaggtggtctttttcttgtggcttaattttaaaaggtgtccaatgtgaagtgcaccgtgttggagtcgtgggggtaggtttggtacgaggggtccgggggggtccctggacgtacctctccgtggtgcacgtcctcgtggtacttcctaccttttagcctaactatcgccagtggacgtccgtcgggtcccgccgacgggtccgtaccgggaggggggacgggccgtcgggtacgggtcgggttcctacgtaaacgttagtttacggtcggtacgtagggtcgggttaaggtaaacgtaggtacgtaaccgtacgacgtacgtaccgttccgtcggtacgggtaaccgggttcccggttacacgttaccacgttaccgtaccccgggtaaagggtaaaccttaacgttacccgaaagggtaccggtaccgtaacgggttaccgtaacccgtagaaaccgtaaacggttacgaaaccgtaccgggtaccgggtaaggggaaaccgaaccggggaacggtaacccggtaaccggggttacctttaaagttaccgttacgttcggacccgacgtacctaggtcggtacggtacgggtacgggttccttacccgtttaagacgttaccggaaacgttaacggtttgggtttaccggtttccgaccgttaaacgttacg

SEQ ID NO: 110984 - DNA, 827 bp, Homo sapiens
  misc_feature: GYAE6OF01BU35H.35.6.A06.1.454.CMB.1.raw
  modified_base (223)..(223): a, c, t, g, unknown or other
  misc_feature (223)..(223): n is a, c, g, or t
tcagtacagatcgtcacgaccggtgctcgatttagatctactgacaggggtctgagagaggagcccagccctgggattttcaggtgttttcatttggtgatcaggactgaacagaagagaactcaccatgggtaggtttgggctggaggtggtctttttcttggtggtacttaattttaaaaggtgtaccaatgtgaagtgcactgttggtagtcggtggggngcgttggacgacggggtcgggggggtcctggagagttcctccgtgtcgcgacgtcctcgtggactccgaccgttggtaagtacgctaagtcggctagtgagtcggtcggtccccggacgacggtccgtacccggaggggggtaccggggcgtaggggtacggttcggttcctttaccgtttacggtttagttaagtcggttacgttagggttcggttggttccgtacaacgtacttaacgtaccgtactacggtacttccgtaggtaggacccgggtccggttacctaccgctaccgagacgtaactataacccgaaacaaccgtaccttgtacttacgtacgtaactaaagtccgaaacgtcggtaaccgtacgggaaaccgtaccgggaaccccgaacgggtaccccggtaaaccgggtaccgttaacgtttaaacctacggttaacgggaacggttaaaaccgggttaaaaaggttaccgggtaaaccggggttaaaccgggttaaacggggggtaaacggtttaaccgggttaaccggtttacccgttaacgttacccgggtttccgggtaccgggggggtacccgtacgggtaaccccg

SEQ ID NO: 110985 - DNA, 741 bp, Homo sapiens
  misc_feature: GYAE6OF01DI29E.35.6.A06.1.454.CMB.1.raw
  modified_base (155)..(155): a, c, t, g, unknown or other
  misc_feature (155)..(155): n is a, c, g, or t
  modified_base (219)..(219): a, c, t, g, unknown or other
  misc_feature (219)..(219): n is a, c, g, or t
  modified_base (248)..(248): a, c, t, g, unknown or other
  misc_feature (248)..(248): n is a, c, g, or t
  modified_base (677)..(677): a, c, t, g, unknown or other
  misc_feature (677)..(677): n is a, c, g, or t
  modified_base (725)..(725): a, c, t, g, unknown or other
  misc_feature (725)..(725): n is a, c, g, or t
tcagtacagatcgtcacgaccggtgctcgatttagatctactgacaggggtctgagagaggagcccagccctgggattttcaggtgttttcatttggtgatcaggactgaacagagagaactcaccatggagtttgggctgaggtggtctttttntgtggtctattttaaaggtgtccagtgtgaggtgcagctgttggagtcgtggggagcttggcancgccgtgggggtccctgagtctctctgtncagtcctgtggtacttcctacctttagcctacctagtggacagtgagtccggtcggggtcccggccggtccgtaccggagggggaacgggtcgtagggtacggtcgggttacctacgtaacgttgtaggtagttagggtacgtcggtcctaactaaactaaaccgtaccgtaagttcgggtaaccgaccgacggtacccggtaccgggttacggggtaccgggggtaccccggtttaaccaacccgttacgttaccccgttaaaccggaaggtaaacgtaaaacccgttaacgttaacccggaaaacgggtaaaccctaccggtacctttaacggtaccttaaccgtaaacgtaaagggacgtaacgtacggtacctagggaacgaccggaccggtaacggacctacggttacttagtaacgtttacgngtacgtaacgtaaacgttacgacggtgtccggatcgggacgtaacggnggtaccgatcgtacgg

SEQ ID NO: 110986 - DNA, 547 bp, Homo sapiens
  misc_feature: GYAE6OF01DS341.35.6.A06.1.454.CMB.1.raw
  modified_base (337)..(337): a, c, t, g, unknown or other
  misc_feature (337)..(337): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (501)..(502): a, c, t, g, unknown or other
  misc_feature (501)..(502): n is a, c, g, or t
  modified_base (505)..(511): a, c, t, g, unknown or other
  misc_feature (505)..(511): n is a, c, g, or t
  modified_base (513)..(515): a, c, t, g, unknown or other
  misc_feature (513)..(515): n is a, c, g, or t
  modified_base (517)..(520): a, c, t, g, unknown or other
  misc_feature (517)..(520): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(527): a, c, t, g, unknown or other
  misc_feature (526)..(527): n is a, c, g, or t
  modified_base (529)..(532): a, c, t, g, unknown or other
  misc_feature (529)..(532): n is a, c, g, or t
  modified_base (534)..(537): a, c, t, g, unknown or other
  misc_feature (534)..(537): n is a, c, g, or t
  modified_base (539)..(547): a, c, t, g, unknown or other
  misc_feature (539)..(547): n is a, c, g, or t
tcagtacagatcgtcacgaccggtgctcgatttagatctactgacaggggtccgggagatcatgagggtgtccttgggttttggggggaagaggaagactgacggtccccccaggagttcaggtgcttgggcacggtgtacctgcaatgacagcctgggagacgaggacacggccgtatattactgtgcgacatctgcgagggtgccttactatgacaatagtggttttgcacatctactctttgaggactggggccagggaccctggtcgccgtctcctcacgcctccaccaagggaccacgtcggtccttcccccgtggccaccctctccaagcnccaccgtcgtggggcctacgacggccggcccgtagggcctacggcccgtggtaccaaacgggtaccttacccgtttcccaacggtacttccgtacgttaaccgtggaaccggccggggtactcggggacctaaagggccgacgtaagtacgggactnancgngnngcnnnnnnngnnngnnnncncncnncnnnncnnnncnnnnnnnnn

SEQ ID NO: 110987 - DNA, 820 bp, Homo sapiens
  misc_feature: GYAE6OF01BQ25Y.35.6.A06.1.454.CMB.1.raw
  modified_base (95)..(95): a, c, t, g, unknown or other
  misc_feature (95)..(95): n is a, c, g, or t
  modified_base (677)..(677): a, c, t, g, unknown or other
  misc_feature (677)..(677): n is a, c, g, or t
tcagtacagatcgtcacgaccggtgctcgatttagatctactgacagggggagtcagtctcagtcaggacacagcatggacatgagggtccccgntcagctccgtggggctcctgctactctggcctccgaggtgcagtatgtgactatccagtactcgacccagtcctccacttccctccctagtcctgactacttccgtaggtaggacgactagccgtaccaccgtataccaccggttcggacccgggactaaggtacgaggacgtcgttaggttcgtacttagttttaacctttaaggtacggttaactaacccgaaaaccggtaaaccgaacgggtaaacccgttacccccttaaacgttcccgtagtaccttacttagtccgtacgtacgactacgttacgtttacgttacggaacggttaacggggtccgggtaccgtagtaacggttcgacgggtacgacgtaggtggtaacgttaggtacgaacgttacgtacttaccgaccttacctaccgtaaccctagccgtaacccggagttacccgttacgaccgttaaacccgtaacggttaacttaaggtttaccttacggaaccctttacgttaacgttgttaaccgtaaccaacgtttacgggtaaacttaccggtacccggtaacccgtccgttaaacnccggtttaacccgcggtttaaccccgggaaccggtaaaccgggtacggtaaccgttacggaaaccggtttaaggaaaccggttaaattaacccgggtacgtcggttagggtaccccacggttaacacccgtttaggttccccg

SEQ ID NO: 110988 - DNA, 775 bp, Homo sapiens
  misc_feature: GYAE6OF01CWE0G.35.6.A06.1.454.CMB.1.raw
  modified_base (198)..(198): a, c, t, g, unknown or other
  misc_feature (198)..(198): n is a, c, g, or t
  modified_base (349)..(349): a, c, t, g, unknown or other
  misc_feature (349)..(349): n is a, c, g, or t
tcagtacagatcgtcacgaccggtgctcgatttagatctactgacaggggtctgagagaggagcccagccctgggattttcaggtgtttttcatttggtgatcaggactgaacagagagaactcaccatggtagttggctgaggttgtcttttctgtgcttaagtttaaaggtgtcaatgtgagtgctacgtgttggngtcgtggggagtcgttggtacgagggccggggggtcctggacgtccgttctccgtaggtcgctacggtccttcgttacggtactttaccgtaaccgttttagacctaaagtacgtacgaccgtagtcggacggtccggttacggggtcccnccggtaacgggtccgtaccggggaggggggcgggtccgttggggtaccggttcggggttacctacgttaaaacgtttaggttcggtacgtaccggttaacgggttacggggttaaggttaaagttaacggaaggttaacccgtaaccggtacgaacgttacccgttcgtaccgggttacgggaaccgggttccggtttacacgtactacgtaccgtaccgaacggaactaacgtaccgaagacgtaccggtacggttactacgtacggaaatacgtaagacgtacgcggtacgggagtaaccggaacggaccggtaccggttaacgtattacggttaactcggtacacgtacgtcgttcgagggcgttagggtcttaccttaagactaacgttaacgtaacggttggtttacggttcaccgttaac

SEQ ID NO: 110989 - DNA, 853 bp, Homo sapiens
  misc_feature: GYAE6OF01BKZDH.35.6.A06.1.454.CMB.1.raw
  modified_base (97)..(97): a, c, t, g, unknown or other
  misc_feature (97)..(97): n is a, c, g, or t
  modified_base (509)..(509): a, c, t, g, unknown or other
  misc_feature (509)..(509): n is a, c, g, or t
tcagtacagatcgtcacgaccggtgctcgatttagatctactgacagggggagtcagtctcagtcaggacacagcatggacatggacgggtccccgntcagctccgtggggctcctgctactctggctccggaggtcgccagatgtgactatccgaggtataccgaccgtacgttcctcctaccttcccttcccgttcggttccttgacctacttacgttagggaaggacgtacgacgtaccgacctactactccgttaccgttccgggaccgggactacgtacgacggagacttacggttcggaactttaacggttttaagtttttaaacgttaggaaccgttaaaccggaaaaccgggtaaaccggaacgggtaaaccccctaacctaaaccttcggtactaagttacctgtaccgacttacgacttactccgtttagttaacgaaaccgggttagggtcccgggttacgaacgtttaggtacggtacggtagaggttcggaacggngttacggtaacggactaacgtttcccacgtccctaccgtacacctagacccgtgaccttacggtctacggtaaccgttagtaacgttaacgttcttaaccgtaccgtaaactttcgttataccgtaacgtaacgtacgttaaccgttaaccgtaacggtccccgtaacgtacggtaacctaccgggtaccgttacccgggtaaacggggtaacccgaaaccggtaaaccgggtacccggttaaaggggtaaaccccgggtttaaaggtaaaaccgttaaaacgggttacgtacggggtttacctagggtaaaccccttacgaacccgttttacggttacccggg

SEQ ID NO: 110990 - DNA, 635 bp, Homo sapiens
  misc_feature: GYAE6OF01AM515.35.6.A06.1.454.CMB.1.raw
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
tcagtacagatcgtcacgaccggtgctcgatttagatctactgacagggggagtcagtctcagtcaggacacagcatggacatgacgggtccccgctcagctccgtggggctcctgctactcgtggctccggaggtcgccagatgtagactactccgagatacgacccctagttcctaccactccctccgtgtctgctatcgtagacgacgacacgcgtacacatcactcggccgacagtcagantntacggactagtttacttaagtcgtactacgaacggaacgaacggaactacccctaaatccgtagactactagccncgtcacncttcttattcgaacgtaagggccgggtaccaacgtaggtccgtaggacgagtggtacgacgttcggacgggactaacgtcgttacctaccgtactacacctagtaccgaacgtcgagttccgaccgaattaccgttaagtactttataccgaaccttaaccgtgtacttacggactaaacgtacgttcggtttacaacggtttccgagtttcccgagttccggaacgggacgtaccggaaggtgaaacctacgaaacgtagtacgaggtcccacgttgaaaccccttattctcgttactcgttacc

SEQ ID NO: 110991 - DNA, 895 bp, Homo sapiens
  misc_feature: GYAE6OF01EHO0V.35.6.A06.1.454.CMB.1.raw
tcagtacagatcgtcacgaccggtgctcgatttagatctactgacaggggtctgagagaggagcccagccctgggtattttcaggttgttttcatttggtgatcaggactgaacagaagagaactccaccatggtagtttgggctggtaggttggttcttttttcgttggtggtacttaagtttttaaaaggtcgtacctaattggtgaagtgcctaccgttggttggaggttcggtggggggtaggtccgtttagggtaccgacgggggtccggggggggttccctaggacgtaccgttccgttcccgttggtcgaccgtacgtcccgttcgttacggtactttacccttaaccttttacgaccctaaacttacgtcgacccgtagtggtacggtccggtccgggtccccgccggaccggccgtaccggggaggggggtacggggtcggtgggtccgggttacgggtaccttacgtaaacgtttagtttaggtcgtacgtacgggtacgggttaaggtaaacgtaggaaacgtaccgtacgacgtaacggtaccttccgtacggtacgggtaaccggggttccgttactacgttacaccgttaccgtaccggaacggtaacctaacgttaccgaaagtaccggtaccgtacgggttccgtacctacgaaacaagtacgaacgtaccgggtcggtaggggaaacgaaccggggtaacgaaccggttaaccgggtacgtttaaacgttaccggttagttacgggcctaaccgtaacgttacggtccggttacggggacccggttagggttaccccgttacgtttaaaccgtaggttaaaccggtaaacgttaaaggttttacggggttttcggtttaacccggacccgttaaaccg

SEQ ID NO: 110992 - DNA, 712 bp, Homo sapiens
  misc_feature: GYAE6OF01BWTLY.35.6.A06.1.454.CMB.1.raw
  modified_base (166)..(166): a, c, t, g, unknown or other
  misc_feature (166)..(166): n is a, c, g, or t
  modified_base (226)..(226): a, c, t, g, unknown or other
  misc_feature (226)..(226): n is a, c, g, or t
tcagtacagatcgtcacgaccggtgctcgatttagatctactgacagggggagtcagtctcagtcaggacacagcatggacatgagggtccccgctcagctccgtggggctcctgctactctggctccggaggtgccagatgtgacatccagatcgacccagtccnccactccctccctgtctgcatcgtgtaggagacagcgtccaccatcacgttcggccgganaagtcgagagctagttggactagtttactttaagtagtactacgaaacggaaaccgaagggaaacctaccccctaaacgtcctagtacttacgtagtcgcgtgacctacttaccgttagttttacgacggtaaacgggtccggggtacccggtacgtaagggttccaaggtcggacgtaggtaggtacgtacggtaggtacgtaagtaacttaccgaccttacctacctaacctacgtacgacgtaccgtagtacctcgaaccgttaacgtagtaaacgtttgttttaaccgaaccttaaaccgttacgttacgttacgtaacgtaaacgtaacgttacgttaaccgacggtacccgtacccgtacttacgtccgacggttcgtacccggaacgtaaaccgggacctaccgggtaacgtagggtaaactaaacgttaaaacggcgttaacgggtaccgtacgttaccgacctaaccgtgttacccg

SEQ ID NO: 110993 - DNA, 919 bp, Homo sapiens
  misc_feature: GYAE6OF01AVLDS.35.6.A06.1.454.CMB.1.raw
tcagtacagatcgtcacgaccggtgctcgatttagatctactgacaggggtcctgagagaggagcccagccctgggattttcgaggtgttttcatttggtgatcaggactgaacagagagaactcaccagtggagttggctgaggtgtcttttcgttgtgtctaagttttaaaagtcgtaccaatgtgaagtgcaccgtgttggagtcgtggggagcgttggtacgacgggtccggggggttccctggacgtaccgtccgttccgtggtcgaccgacgtcccgttcgtcggtactttccgtaaccgtttaacgacgtaaccgttacgtccgtaccgtagtacggtacgtccggttaccgggtccccgtaccggtaccgggtaccgtaccggggacgggggtaccggggtcgttcggggtccggttacgggttaccttaccgtaaacgtttacgttacggtacgtacgttacgggtacgggttaaggttaacgtaacggacgtaaccgtaccgtacgtaacgtaccgttacgtacggttaacgggtaaccgggttccggttacctaacgtaccgtaaccgttaccgtaacccgggtaaacggttaacctaaaccggttacccgaaaggtaccggtaaccggtaaccggtttaccgtaacccgtaacgtaaacgtaaaccggttacgaaaccggtccggtaccgggtaaggggaaccgtaaccgggaaacccggtaccggtaacccgggttacccgtttaaagttaaccggtttaccgtacggtaacggtaaccgtaaccggttaaacgttcccgggttaacgggtaacccgggttacgggtttaacccctaccgtttaacgtaacgttaacggttaacggttaaacggtttacgggttttcggttacccggaacgtaacg

SEQ ID NO: 110994 - DNA, 704 bp, Homo sapiens
  misc_feature: GYAE6OF01CYTFY.35.6.A06.1.454.CMB.1.raw
  modified_base (650)..(651): a, c, t, g, unknown or other
  misc_feature (650)..(651): n is a, c, g, or t
  modified_base (654)..(654): a, c, t, g, unknown or other
  misc_feature (654)..(654): n is a, c, g, or t
  modified_base (659)..(659): a, c, t, g, unknown or other
  misc_feature (659)..(659): n is a, c, g, or t
  modified_base (663)..(663): a, c, t, g, unknown or other
  misc_feature (663)..(663): n is a, c, g, or t
  modified_base (665)..(665): a, c, t, g, unknown or other
  misc_feature (665)..(665): n is a, c, g, or t
  modified_base (668)..(668): a, c, t, g, unknown or other
  misc_feature (668)..(668): n is a, c, g, or t
  modified_base (671)..(671): a, c, t, g, unknown or other
  misc_feature (671)..(671): n is a, c, g, or t
  modified_base (673)..(673): a, c, t, g, unknown or other
  misc_feature (673)..(673): n is a, c, g, or t
  modified_base (676)..(676): a, c, t, g, unknown or other
  misc_feature (676)..(676): n is a, c, g, or t
  modified_base (678)..(681): a, c, t, g, unknown or other
  misc_feature (678)..(681): n is a, c, g, or t
  modified_base (683)..(685): a, c, t, g, unknown or other
  misc_feature (683)..(685): n is a, c, g, or t
  modified_base (687)..(695): a, c, t, g, unknown or other
  misc_feature (687)..(695): n is a, c, g, or t
  modified_base (697)..(702): a, c, t, g, unknown or other
  misc_feature (697)..(702): n is a, c, g, or t
tcagtacagatcgtcacgaccggtgctcgatttagatctactgacaggggtccgggagatcatgagggtgtccttgggttttggggggaagaggaagactgacggtcccccaggagttcaggtgctgggcacggtgtacctgcaaatgaacagcctgggagacgagacacggccgtatattactgtgcgacatctgcggaggggtcaccttaactagtggaactaaagttaggtttgggttttcggaccctactacgttccgttaaccttacgttttagggaacgggtaccgttacggggggaccctaaacgggggaaccccttggggtccgtcccggttaccgtcccgttccaacggtcccctacccgtaacccggaaaacggggtccccaacgtttacccgggttccccttcccccccggtagggcccctaccccccttaccgtcccgaaacggtaccgccgtaacccgttcgggtcgggggaacctaccggtacggcccgggtacccggtcgggccgttccgtccggttaggtaaccgaaacgggtaccctttaccgttacccgaacgtattccgtacgttacgtcggaacggtccgggtaccgttggaaccgtaacggggcccttaacacggttagcacgtcgacnncgntcatnacgncngcngangngtncnnnntnnnannnnnnnnncnnnnnncg

SEQ ID NO: 110995 - DNA, 634 bp, Homo sapiens
  misc_feature: GYAE6OF01ARMKE.35.6.A06.1.454.CMB.1.raw
  modified_base (95)..(95): a, c, t, g, unknown or other
  misc_feature (95)..(95): n is a, c, g, or t
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (528)..(528): a, c, t, g, unknown or other
  misc_feature (528)..(528): n is a, c, g, or t
  modified_base (625)..(625): a, c, t, g, unknown or other
  misc_feature (625)..(625): n is a, c, g, or t
tcagtacagatcgtcacgaccggtgctcgatttagatctactgacagggggagtcagtctcagtcaggacacagcatggacatgagggtccccgntcagctccgtggggctcctgctactctggctccggaggtgccagatgtgacatccagatcgaccccagtcctccactccctccctgtctgcatctggtaggntacngcgtcacctatcactggaccgggnaagtcagagctatcggactagtttactttaaagttggtaactacgaacggaaaccgaagggaaacctaccccgtaaactccgtagtatactatcgtacgtgtactacttccttagtttacggaacggttaaacgggtccggggttacccggacgtaacggttaccggaggtcggtacggtaggtacggtacgtacgggtacggtactaacggtaacttaccgtaaccttccgtaaccaccgtactcgaacgtcgtaacgtcctacgacctacgtagtaagttctttacgactacgtatacgtnactagagtacgtacacgaccgtccgagtactcgtacgtcgtacggacgacggaccaggtacaagggataaacgtaagacgtggtacgtataccgacncgtagtccg

SEQ ID NO: 110996 - DNA, 887 bp, Homo sapiens
  misc_feature: GYAE6OF01EG0G5.35.6.A06.1.454.CMB.1.raw
  modified_base (266)..(266): a, c, t, g, unknown or other
  misc_feature (266)..(266): n is a, c, g, or t
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
tcagtacagatcgtcacgaccggtgctcgatttagatctactgacaggggtctgagagaggagcccagccctgggattttcaggtgttttcatttggtgatcaggactgaacagagagaactcaccatggagtttgggctgaggtggtctttttcttgtgcttaattttaaaaggtgtaccaatgtagaagtgccaccgtgttggagttcgtgggggagtcgttggtacgagggccgggggggtccctggacgactctccgtgtcncagcctgtggtacttcctacctttagactaactntacgccaagtgacgtcggtcgggtacccnccgaggccgtccgggaggggacggggtctcgggcggtcggtcctataacgttgttacgcggtaccgtagggtaccgggttaggtaaacgttacggaacgttaaccgtaccggacgtaaaccgtcccgtttaccgtaccggtttaaccgggggaaccggggttaccccggtttactaaacgttacccgtacggtttacccccgaaaccgggtaaaccgggtaaaaccttaacccgtttaaaccgggaaagggttacccgccccggttaaagggttacccgtaaccgtaacgtaaaacctaaacgggttacgaaccgtaccgggtacccggtaaaggggaaaccgtaaccgggaacccgggtaaacggtccccgggttaacggttaactttaaccggggttacttacgggacccgtaaccgtaaacggttcccgtcgtaaccgggggggttaaccggtgggtttaacccccttacgtttaaaccgtttagaaacccggggttaaaacttttaaccgggttttggggggttttaccccgttaaggacccctttaaaacccg

SEQ ID NO: 110997 - DNA, 749 bp, Homo sapiens
  misc_feature: GYAE6OF01CEZHQ.35.6.A06.1.454.CMB.1.raw
  modified_base (97)..(97): a, c, t, g, unknown or other
  misc_feature (97)..(97): n is a, c, g, or t
  modified_base (140)..(140): a, c, t, g, unknown or other
  misc_feature (140)..(140): n is a, c, g, or t
  modified_base (209)..(209): a, c, t, g, unknown or other
  misc_feature (209)..(209): n is a, c, g, or t
  modified_base (441)..(441): a, c, t, g, unknown or other
  misc_feature (441)..(441): n is a, c, g, or t
  modified_base (663)..(663): a, c, t, g, unknown or other
  misc_feature (663)..(663): n is a, c, g, or t
  modified_base (683)..(683): a, c, t, g, unknown or other
  misc_feature (683)..(683): n is a, c, g, or t
  modified_base (741)..(741): a, c, t, g, unknown or other
  misc_feature (741)..(741): n is a, c, g, or t
tcagtacagatcgtcacgaccggtgctcgatttagatctactgacagggggagtcagtctcagtcaggacacagcatggacatggacgggtccccgntcagctccgtgggctccgtgctactctggcctaccggaggtcnccagtatgtcgaaccagtccaaggtactcggaccctagtcctcctacttccccgttccgttgttaccgngtacctagttcgttacggtaaggacgaccgacgtccgtaccgtaacctactacccgtaacggttccgggacccgggtaataaccggacgtaaacggtgaccgtaagttcgggtacgttaacgttttaaccgttttaaaaggtttcgtaagttaaaccgaaaaccgggaaacggtaacgggtaaaccctaacccccgtaacttacctacggtattacgttcgacgttccgtanacgtaccgtttaccttacgtttacggaaccggtaaagggttcccgggtaccggtaggtaccgtttacgagggtagtcgagggttacgtacgttacggacggaactagtaacctttccggaaccttctaccgtaactacgtacgtcgtacgtactcgtactaccgtaagtacgtaacgttcgttaacaaccgtactacgtagttactacgagttatacgttanaccgcgtaccgtatcgtacncgacgtacgacgtaccagaacgcgtaagaacgtaatacgacgttcggaagtcgatacncgtcgtcg

SEQ ID NO: 110998 - DNA, 422 bp, Homo sapiens
  misc_feature: GYAE6OF02IOZB7.35.6.A06.1.454.CMB.1.raw
  modified_base (421)..(422): a, c, t, g, unknown or other
  misc_feature (421)..(422): n is a, c, g, or t
tcagtacagatcgtcacgaccggtgctcgatttagatctactgacaggggtccgggagatcatgagggtgtccttgggttttgggggaagaggaagactgacggtcccccaggagttcaggtgctgggcacggtgtacctgcaaatgaacagcctgggagacgaggacacggccgtatattactgtgcgacatctgcgagggtgccttactatgacaatagtggttttggccacatctactactttgaggactggggccagggaaccctggtcgccgtctcctcagcctccaccaagggccccatcggtcttccccctggcaccctcctccaagagcacctctgggggcacagcggccctgggctgcctggtcaaggctacttccacgatctgtactgagcgggctggcaaggcgcatagnn

SEQ ID NO: 110999 - DNA, 204 bp, Homo sapiens
  misc_feature: GYAE6OF02HHC7W.35.6.A06.1.454.CMB.1.raw
  modified_base (202)..(204): a, c, t, g, unknown or other
  misc_feature (202)..(204): n is a, c, g, or t
tcagtacagatcgtcacgaccggtgctcgatttagatctactgacaggggtccgggagatcatgagggtgtccttgggttttgggggaagaggaagactgacggtccccacggagttcaggtgctgggcacagcggccctgggctgcctggtcaaggactacttccacgatctgtactgagcgggctggcaaggcgcatagnnn

SEQ ID NO: 111000 - DNA, 493 bp, Homo sapiens
  misc_feature: GYAE6OF02GWM81.35.6.A06.1.454.CMB.1.raw
  modified_base (204)..(204): a, c, t, g, unknown or other
  misc_feature (204)..(204): n is a, c, g, or t
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
  modified_base (361)..(361): a, c, t, g, unknown or other
  misc_feature (361)..(361): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (404)..(404): a, c, t, g, unknown or other
  misc_feature (404)..(404): n is a, c, g, or t
  modified_base (484)..(484): a, c, t, g, unknown or other
  misc_feature (484)..(484): n is a, c, g, or t
  modified_base (486)..(493): a, c, t, g, unknown or other
  misc_feature (486)..(493): n is a, c, g, or t
tcagtacagatcgtcacgaccggtgctcgatttagatctactgacagggaggtagttggggaggacgtagggacatccgaccgagtgtacccaggtctccagtcctccctgtcgtcgcgatctgtaggagacgagcgtccaccatcacttgccggcgaagtcgagagcatggcagtcttaatgtatcaacggaaacagggaaanccctaaactcctgatctatgctgcatccatttgcaaagtgggcccggnaaggttcagtggcagtggatntgggacagaattcactctcaccatcagcagtctgcaacctgaanattttncaacctataattggcaacagattaccagtacgcccganatcagctcggacaaggacacgtanggaanaataaagatgtgcngacacatctatctcactcctccactatctacgaactactctagtactgacgcggtcgtcggacgaacggcgacaagtagngnnnnnnnn

SEQ ID NO: 111001 - DNA, 487 bp, Homo sapiens
  misc_feature: GYAE6OF02H2ONN.35.6.A06.1.454.CMB.1.raw
  modified_base (214)..(214): a, c, t, g, unknown or other
  misc_feature (214)..(214): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagcgtcaccatcacttgccgggnaagtcagagcattggcagttctttaaattggtatcaacggaaaccagggaaagcccctaaaatcctgatctatgctgcatccattttgcaaagtggggtcccgcaaggttcagtggcagtggatctgggacagaattcactctcacatcagcagtctgcaacctgaagtattttgctaacctactattgtcaacagagttacagtacgccgcgatcagcttcggccagggacacggactggaagattaaagaactgtcggctagcaccatccg

SEQ ID NO: 111002 - DNA, 473 bp, Homo sapiens
  misc_feature: GYAE6OF02F0F64.35.6.A06.1.454.CMB.1.raw
  modified_base (465)..(473): a, c, t, g, unknown or other
  misc_feature (465)..(473): n is a, c, g, or t
tcagtacagatcgtcacgaccggtgctcgatttagatctactgacagggaggatggagactgggacatccagatgacccagtctaccatcctccctgtctgcatctgtaggagacagcgtcaccatcacttgccgggcaagtcagagcattggcagttctttaaattggtatcaacggaaaccagggaaagcccctaaactcctgatctatgctgcatccattttgcaaagtgggtcccgcaaggttcagtggcagtggatctgggacagaattcactctcaccatcagcagtctgcaacctgaagattttgcaacctactattgtcaacagagttacagtacgccgcgatcagcttcggccaagggacacgactggagattaaaagaactgtgctgcaccatctgtcttcatcttcccgccatctgaacgatctgtactgagcgggctggctaaggcgcatagnnnnnnnnn

SEQ ID NO: 111003 - DNA, 499 bp, Homo sapiens
  misc_feature: GYAE6OF02ITRLH.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagaccattcgcgtctatttaaatggtatcgcagaggccaggagaacgcccctaacctactgatgtatactgtatctactttgcatatgcggtccatcaaggttcagtgcagtggatcgtgggacagtatttcactctcaccatcaaacaatatacaactgaagtactttgactaacttaactactgtacaaacagtaaccttacgacgggtccccattcctactttcggccctcgggaccacacgtccaatactaccaacgactgtcgctgcacatctc

SEQ ID NO: 111004 - DNA, 512 bp, Homo sapiens
  misc_feature: GYAE6OF02GVI2G.35.6.A06.1.454.CMB.1.raw
  modified_base (321)..(321): a, c, t, g, unknown or other
  misc_feature (321)..(321): n is a, c, g, or t
tcagtacagatcgtcacgaccggtgctcgatttagatctactgacagggggaggtcagtctcagtcaggacacagcatggacatgagggtccccgcgtcagctccgtggggctcctgctactctggctccgaggtgccagatgtgacatccagatgacccagtctccatcctccctgtctgcatctgtaggagacagcgtcaccatcacttgccgggcaagtcagagcattggcagttcttaaattggtatcaacggaacagggaaagcccctaaactcctgatctatgctgcatccattttgctaaagtggggtcccggnaaggttcagtggcagtggatctggacagaattcactctcacatcagcagtctgcactgaagtatttgactaacctactattcgtacaacagattacagtacgcccgagatcagcttcggaccaagggacacggactaggaacgtaattaaaaacgacgttacggtacggtactaggacctaccgattaccg

SEQ ID NO: 111005 - DNA, 576 bp, Homo sapiens
  misc_feature: GYAE6OF02IEIK5.35.6.A06.1.454.CMB.1.raw
  modified_base (275)..(275): a, c, t, g, unknown or other
  misc_feature (275)..(275): n is a, c, g, or t
  modified_base (405)..(405): a, c, t, g, unknown or other
  misc_feature (405)..(405): n is a, c, g, or t
tcagtacagatcgtcacgaccggtgctcgatttagatctactgactaggggtaggggatggagacctgggacatccgaagatggaccctagtcttcccgatcctccctgtcctgcaatctgtagggagacagcgtcgacctagtcacgttgccggggttcaagtcagtagttcagttggcagttctttaaattggtatctaacggaaccagggaaggcccgtaaactccgtgatctagtgactcgcatccattttcgctaaaggtgggtcccggngaaggttcattggtcgagtggactctgggacagaattcgactctcgaccactcgagacgtagtcctggcgtaaccgtgtaagtattttggacaacctactattgtacaactagtagttacgatacgccgngagtcagtcgttcggccaagggcacgacgtagaatataaaagactagtaggactgacacctatactgtacttcatcttccgcctagtcctagaacgtattcttgtactgacgcggtacgtacggacgaacgggcggacggaacgtacggtggcgacgtgacgcgtcactcg

SEQ ID NO: 111006 - DNA, 426 bp, Homo sapiens
  misc_feature: GYAE6OF02IWVFO.35.6.A06.1.454.CMB.1.raw
  modified_base (422)..(426): a, c, t, g, unknown or other
  misc_feature (422)..(426): n is a, c, g, or t
tcagtacagatcgtcacgaccggtgctcgatttagatctactgacaggggtccgggagatcatgagggtgtccttgggttttgggggaagaggaagactgacggtcccccaggagttcaggtgctgggcacggtgtacctgcaaatgaacagcctgggagacgaggacacggccgtatattactgtgcgacatctgcgagggtgccttactatgacaatagtggttttggccacatctactactttgaggactggggccagggaaccctggtcgccgtctcctcagcctccaccaagggccccatcggtcttccccctggcaccctcctccaagagcacctctgggggcacagcggccctgggctgcctggtcaaggactacttccacgatctgtactgagcgggctggcaaggcgcatagnnnnn

SEQ ID NO: 111007 - DNA, 665 bp, Homo sapiens
  misc_feature: GYAE6OF02JW8YI.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttgcctggtatcagcaagaaaccagggaaacgcccctaaactcctgatctttaaggcgtctacttagagagtgggtccagttaaggttcagcggcagtggatcgtggacagacttcgactctcaccatcaccagcctgacacgtcctgacttgtacttttgacctaacccgttattacgtcgaccctaaacgtacgttatcgggttactaacgttttcccgtacctaaccgttttcccgggaccccggtttacgggtaaacccgttaaaacggtcggggtaaacctaacgttaacccgaaaaccggttaaccgtttaggttaccggggtaccttaccggggtaccctaaaccccgttacgttacccggttttacggtttaaccccgtttttaccgaacgttttacccccgttttacccccggtaaccc

SEQ ID NO: 111008 - DNA, 570 bp, Homo sapiens
  misc_feature: GYAE6OF02JW584.35.6.A06.1.454.CMB.1.raw
  modified_base (213)..(213): a, c, t, g, unknown or other
  misc_feature (213)..(213): n is a, c, g, or t
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
  modified_base (318)..(318): a, c, t, g, unknown or other
  misc_feature (318)..(318): n is a, c, g, or t
  modified_base (357)..(357): a, c, t, g, unknown or other
  misc_feature (357)..(357): n is a, c, g, or t
  modified_base (436)..(436): a, c, t, g, unknown or other
  misc_feature (436)..(436): n is a, c, g, or t
tcagtacagatcgtcacgaccggtgctcgatttagatctactgacaggggaggtcgagtctcagtcaggacacagcatggacatgagggtccccgctcagctcctgggctcctgctactctggctcgaggtgccagatgtgacatccagatgacccagtctccatcctccctgtctgcatctgtaggagacagcgtcaccatcacttgccggnaagtcagagcattggcagttctttaaatggtatcaacggaaccagggaacncccctaaatcctgatctancgactgcatcctattttgcaaaggtcggggtcccntaaggtcagtcgctagtggatcgtgggaacaggtacttnacctgtaccaccagtaccagtacacgtctgcctaaaccgtgaagttcttagacctaaccgttactaactttgacctaanagtagttacacgttaccaccgtagacttacacgccgtttacgaccgtaagggactacccggtaagtacggaacggttaaacttaaaacggacttaggtaccgggtacttagtacccgtaacccgtatttaccgg

SEQ ID NO: 111009 - DNA, 491 bp, Homo sapiens
  misc_feature: GYAE6OF02GXW6P.35.6.A06.1.454.CMB.1.raw
  modified_base (426)..(426): a, c, t, g, unknown or other
  misc_feature (426)..(426): n is a, c, g, or t
  modified_base (447)..(447): a, c, t, g, unknown or other
  misc_feature (447)..(447): n is a, c, g, or t
  modified_base (475)..(475): a, c, t, g, unknown or other
  misc_feature (475)..(475): n is a, c, g, or t
  modified_base (483)..(491): a, c, t, g, unknown or other
  misc_feature (483)..(491): n is a, c, g, or t
tcagtacagatcgtcacgaccggtgctcgatttagatctactgacagggaggatggagactgggacatccagatgacccagtctccatccctccctgtctgcatctgtaggagacagcgtcaccatcacttgccgggcaagtcagagcattggcagttctttaaattggtatcaacggaaaccagggaaacgcccctaaactcctgatctatgctgcatcctattttgacaaaggtcggggtcccggcaaggttcagtggcagtggatcgtgggacagaattcactctcaccatcagcagtctgcaacctgaagtattttgactaacctactattgtactaacagtagttacagtacgcccgcgatcagctcggccgaagggacacgactggaagaattaaaagatgtgctgcaccatctgtctcntccttccgcctatctagaacntctgtactgagcggctggacgacgggcncgagtagnnnnnnnnn

SEQ ID NO: 111010 - DNA, 423 bp, Homo sapiens
  misc_feature: GYAE6OF02I36IS.35.6.A06.1.454.CMB.1.raw
  modified_base (412)..(412): a, c, t, g, unknown or other
  misc_feature (412)..(412): n is a, c, g, or t
  modified_base (418)..(423): a, c, t, g, unknown or other
  misc_feature (418)..(423): n is a, c, g, or t
tcagtacagatcgtcacgaccggtgctcgatttagatctactgacaggggtccgggagatcatgagggtgtccttgggttttgggggaagaggaagactgacggtcccccaggagttcaggtgctgggcacggtgtacctgcaaatgaacagcctgggagacgaggacacggccgtatattactgtgcgacatctgcgagggtgccttactatgacaatagtggttttgccacatctactactttgaggactggggccagggaaccctggtcgccgtctcctcagcctccaccaaggcccatcggtcttccccctggccaccctcctccaagacgcacctctggggcacagcggccctggctgcctggtcaaggctacttccacgatctgtactgagcgggctggcaaggcncatagnnnnnn

SEQ ID NO: 111011 - DNA, 442 bp, Homo sapiens
  misc_feature: GYAE6OF02HCP5M.35.6.A06.1.454.CMB.1.raw
  modified_base (309)..(309): a, c, t, g, unknown or other
  misc_feature (309)..(309): n is a, c, g, or t
  modified_base (338)..(338): a, c, t, g, unknown or other
  misc_feature (338)..(338): n is a, c, g, or t
  modified_base (420)..(420): a, c, t, g, unknown or other
  misc_feature (420)..(420): n is a, c, g, or t
  modified_base (425)..(442): a, c, t, g, unknown or other
  misc_feature (425)..(442): n is a, c, g, or t
tcagtacagatcgtcacgaccggtgctcgatttagatctactgacaggggttccggggagatcatgaggtgtccttgggttttgggggaagaggaagactgaggtcccccaggagttccaggtgctggtcacggtgtacctgcaaatgaacagcctgggagacggaggacacggccgtatattactgtgcgacatcctgcgagggtgtccttacgtatgacaatagtggttttggccacatctactactttgaggactggggtccagggaaccctggtcgccgtctcctcagcctccaccaaggcccancggtctccccctggcaccctcctccaagngcacctctcgggggcacagccggccctgggctcgcctggtcaagggctacgttccagctctgtactgagcggctgcaaggcncatgnnnnnnnnnnnnnnnnnn

SEQ ID NO: 111012 - DNA, 487 bp, Homo sapiens
  misc_feature: GYAE6OF02HRG19.35.6.A06.1.454.CMB.1.raw
  modified_base (316)..(316): a, c, t, g, unknown or other
  misc_feature (316)..(316): n is a, c, g, or t
  modified_base (363)..(363): a, c, t, g, unknown or other
  misc_feature (363)..(363): n is a, c, g, or t
  modified_base (435)..(435): a, c, t, g, unknown or other
  misc_feature (435)..(435): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttctttaaattggtatcaacggaaacagggaaagccctaaactcctgatctatgctgcatccattttgcaaagtggggtccgnaaggttcagtgcagtggatctgggacagaattcactctcaccatcancagtctgcaacctgaagtatttagactaacctactattgtacaacagagttacagtaccgccgacgatcgancgttcgaccaggacacgactggagattaaagaactgtcggactgacacatcg

SEQ ID NO: 111013 - DNA, 514 bp, Homo sapiens
  misc_feature: GYAE6OF02GGL43.35.6.A06.1.454.CMB.1.raw
  modified_base (436)..(436): a, c, t, g, unknown or other
  misc_feature (436)..(436): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttctttaaattggtatcaacggaaaccagggaaagcccctaaaactcctgatctatgctgcatccattttgcaaagtggggtcccgcaaggttcagtggcagtggatcgtgggacagaattcactctcacatcagcagtctgcaacctgaagtattttgactaaccttacttattgtacaacagtagttacagtaccgcccgngactcgagcttcggccaacgggacacggacgtaggaacgaattaaaacgacttaggtacggctagacaccgattaccg

SEQ ID NO: 111014 - DNA, 644 bp, Homo sapiens
  misc_feature: GYAE6OF02JEWA8.35.6.A06.1.454.CMB.1.raw
  modified_base (295)..(295): a, c, t, g, unknown or other
  misc_feature (295)..(295): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagcgtcaccatcacttgccggcaagtcagagcattggctagttcttaaattggtatacaaacggaacagtaacgacctaacctactcgatactatatctgtacnctacttacttagttacgaacgtacggggtccggtacgtaacggtacgtacgtaggtcgtagtaggtagtacgtaggtaacggaacgtaagttaaccttcgtacctactacccgaacttaccgtacgacgtacgtacgttccgacgtaaacccgtagtaagtaaacttttcgttaccgaaacccttaacttagttacgtacaaacgtaacgaagtttaacgtacgttaacgcccgtacgtacgtactacgtaccgttacggtaaccgaacggaacgtaaccgtaaccgtaaggtagggtaaactaaaacgttaagccggtttaggaccgacgttaaccaccgtataacgg

SEQ ID NO: 111015 - DNA, 502 bp, Homo sapiens
  misc_feature: GYAE6OF02G1PXU.35.6.A06.1.454.CMB.1.raw
  modified_base (317)..(317): a, c, t, g, unknown or other
  misc_feature (317)..(317): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttctttaaattggtatcaacggaaccagggaaagcccctaaactcctgatctatgctgcatccattttgcaagtggggtcccgnaaggttcagtgcagtggatctgggacagaattcactctcaccatcagcagtctgcaacctgaagtatttgactaactactattcgtacaacagtagttacacgtacgcccgagactcgagcttacggccaagggcacgacgtaggaagtaagttaaaagacttaggtggactcgactaccatccg

SEQ ID NO: 111016 - DNA, 426 bp, Homo sapiens
  misc_feature: GYAE6OF02GWU9D.35.6.A06.1.454.CMB.1.raw
  modified_base (421)..(426): a, c, t, g, unknown or other
  misc_feature (421)..(426): n is a, c, g, or t
tcagtacagatcgtcacgaccggtgctcgatttagatctactgacaggggtccgggagatcatgagggtgtccttgggttttggggggaagaggaagactgacggtcccccaggagttcaggtgctgggcacggtgtacctgcaaatgaacagcctgggagacgaggacacggccgtatattactgtgcgacatctgcgagggtgccttactatgacaatagtggttttggccacatctactactttgaggactggggccagggaaccctggtcgccgtctcctcagcctccaccaagggcccatcggtcttccccctggcaccctcctccaagagcacctctgggggcacagcggccctgggctgcctggtcaaggctacttccacgatctgtactgagcgggctggcaaggcgcatagnnnnnn

SEQ ID NO: 111017 - DNA, 427 bp, Homo sapiens
  misc_feature: GYAE6OF02HM55F.35.6.A06.1.454.CMB.1.raw
  modified_base (422)..(427): a, c, t, g, unknown or other
  misc_feature (422)..(427): n is a, c, g, or t
tcagtacagatcgtcacgaccggtgctcgatttagatctactgacaggggtccgggagatcatgagggtgtccttgggttttggggggaagaggaagactgacggtccccccaggagttcaggtgctgggcacggtgtacctgcaaatgaacagcctgggagacgaggacacggccgtatattactgtgcgacatctgcgagggtgccttactatgacaatagtggttttggccacatctactactttgaggactggggccagggaccctggtcgccgtctcctcagcctccaccaaggcccatcggtcttccccctggccaccctcctccaagacgcacctctgggggcacagcggccctgggctgcctggtcaaggactacttccacgatctgtactgagcgggctggcaggcgcatagnnnnnn

SEQ ID NO: 111018 - DNA, 562 bp, Homo sapiens
  misc_feature: GYAE6OF02JBQP5.35.6.A06.1.454.CMB.1.raw
  modified_base (328)..(328): a, c, t, g, unknown or other
  misc_feature (328)..(328): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttcttaaattggtatacaacggaaaccagggaaacgcccctaaactcctagactctatgctgacatcctattttgactaaagtcggggtacccgnaaggttcagtgcagtggatcgtgggacagaattcactctacactatcagcagtctgacaacctgaagtatttcgactaaaccttactattcgtacaaactagtaagttacaacgttaccgacccgtcgtaactcgacgtccgttaccgaccgtaacgggacctacggaaccgtaggaacgtaacttaaaacggaaccgttaggtacggtccttacggacctaccgtagttaccg

SEQ ID NO: 111019 - DNA, 587 bp, Homo sapiens
  misc_feature: GYAE6OF02GRBDH.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttcttaaattggtatcaacggaaaccagggaaagcccctaaactcctagatctatgctgcatcctattttgactaaaggtcgggggtacccggcgtaaggttcaggtggcaggtggatcgtgggacagaattcactctcacatcagcagtctgacaacctgaagtatttcgactaaccttacttattcgtactaacgtagtaacgttaacacggtaccgacccggtacgtaacttccgacgtaccgtttaccgggaccgtaacggggacctaaccggtaacgtacgggtaaacgtaaagtttaaaaacggaacgttaggtacgggtaccttacggacctaacccgtattacccg

SEQ ID NO: 111020 - DNA, 673 bp, Homo sapiens
  misc_feature: GYAE6OF02GZ5N1.35.6.A06.1.454.CMB.1.raw
  modified_base (93)..(93): a, c, t, g, unknown or other
  misc_feature (93)..(93): n is a, c, g, or t
  modified_base (189)..(189): a, c, t, g, unknown or other
  misc_feature (189)..(189): n is a, c, g, or t
  modified_base (197)..(197): a, c, t, g, unknown or other
  misc_feature (197)..(197): n is a, c, g, or t
tcagtacagatcgtcacgaccggtgctcgatttagatctactgacaggggagtcgagtctcagtcaggacacagcatggacatgaggtcccgntccagctcctgggctccgtgctactctggctccgaggtgccagatgtgacatccagatgacccagtctccatcctccctgtctgcatctgtagganacagcgtnaccatcattgccggcaagtcagagcattggcagttcttaatgtatcaagaacaggaaacgccctaaatccctgatctatgactgcaacgtcctaattttgactaaaaggttcgggggttacccggcgtaaaggtttccgtaaggttacggacagggttaggtacgttcgttacgggggtacaagggtaaactttcggaaccgttacttaccaacccagtttacccaaggtcctaacggttctacggtacctaaacccgttagaaacgttactttttagggaacccttaaaccctttaactttaacgttacggttaactaaaccgtaagtaacgttaacctacggtttaaacccgcccggtaccgtaaacgtccgtaaacgtccgttaccggacccttaacgggggaccaacgggtaacctaggaccgtaaagttaaacaacggttagtcggtactcgggtacaccggtaattccgg

SEQ ID NO: 111021 - DNA, 493 bp, Homo sapiens
  misc_feature: GYAE6OF02G0DCU.35.6.A06.1.454.CMB.1.raw
  modified_base (489)..(489): a, c, t, g, unknown or other
  misc_feature (489)..(489): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccctccaccctgtctgcatctgtaggagacagagtcactattacttgtcggccagtgagagtataagtagttggttggcctggtatcagcagaaaccagggaaagcccctagactcctgatgtatagggcgtctgttctacaaaatggggtcccaccaaggttcagcggcagtggatctgggacaggaattcactctcaccatcagtagcctgcagcctgatgactttgcaaccttattactgaccaacattacagctacttatttctctttcggcgaggaccaaggtgacatcgagacgaactgtggctgaccacatctgtccttntacc

SEQ ID NO: 111022 - DNA, 482 bp, Homo sapiens
  misc_feature: GYAE6OF02GN2TY.35.6.A06.1.454.CMB.1.raw
  modified_base (474)..(482): a, c, t, g, unknown or other
  misc_feature (474)..(482): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggcaagtcagagcattggcagttctttaaattggtatcaacggaaaccagggaaagcccctaaactcctgatctatgctgcatccattttgcaaagtggggtcccggcaaggttcattggcagtggatctgggacagaattcactctcaccatcagcagtctgcaacctgaagattttgcaacctactattgtcaacagagttacagtacgcccgcgatcagcttcggccaagggacacgactggagattaaaagaactgtaggctgacaccatctgtccttcatccttcccgccactctgaacgtatctgtactgacgcggctggcaaggcgcagtagnnnnnnnnn

SEQ ID NO: 111023 - DNA, 562 bp, Homo sapiens
  misc_feature: GYAE6OF02GV74Y.35.6.A06.1.454.CMB.1.raw
  modified_base (190)..(190): a, c, t, g, unknown or other
  misc_feature (190)..(190): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtagganacagcgtcaccatcacttgccgggcaagtcagagcattggcagttctttaaattggtatcaacggaaaccagggaaacgcccctaaactcctgatctatgctgcatccattttgactaaaggtggggtacccggctaacggttcagtggcaggtggatcgtgggactagattcactctcaccatcagcagtctgactaactgaagtattttcggacctaaaccttacttattcgtactaactagtaacgttacgacgttaccgcccgacgtacttacgagtccttccgggaccgtaacgggacctaacggactacgggtaagtaacgttaaaacggacgttacggtacggacctacggactaccgattaccg

SEQ ID NO: 111024 - DNA, 630 bp, Homo sapiens
  misc_feature: GYAE6OF02IJU6K.35.6.A06.1.454.CMB.1.raw
  modified_base (252)..(252): a, c, t, g, unknown or other
  misc_feature (252)..(252): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (612)..(612): a, c, t, g, unknown or other
  misc_feature (612)..(612): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
  modified_base (623)..(623): a, c, t, g, unknown or other
  misc_feature (623)..(623): n is a, c, g, or t
  modified_base (625)..(630): a, c, t, g, unknown or other
  misc_feature (625)..(630): n is a, c, g, or t
tcagtacagatcgtcacgaccggtgctcgatttagatctactgacaggggaggatggagactgggacatccagatgacccagtctccatcctccctgtctgcatctgtaggagacagcgtcaccatcacttgccgggcaagtcagagcattggcagtttctttaaattggtatacaacggaaaccagggaaacgcccctaaactcctgatctatgctgcatcctattttgacgtaaaggtcggggtcccggntaaggttcaggtggcaggtggatcgtgggacagtatttcactctcacatcagcaacctgcagcctgaggtactttgacctaacttattacncgaccaanagttaataacttaacgtttaaccccttactttaaaccgtttcggggacgggaacggggtaaccgtaaagggtaacggaaaccgaaccgtaaaacggtaacgttacggtacgggaccgtacgcctaaacctagttaccgttacggttccttactacttcccgtttaccccgacctacttccgtacgtaacgttactacgttacgtaaccgtgggtacgggccgggtcgtcgggaaccgtacgggacggtaccaggttacggnacgncngngcngnnnnnn

SEQ ID NO: 111025 - DNA, 467 bp, Homo sapiens
  misc_feature: GYAE6OF02HGZUU.35.6.A06.1.454.CMB.1.raw
  modified_base (350)..(350): a, c, t, g, unknown or other
  misc_feature (350)..(350): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
  modified_base (460)..(467): a, c, t, g, unknown or other
  misc_feature (460)..(467): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggcaagtcagagcattggcagttctttaaattggtatcaacggaaaccagggaaagcccctaaaactcctgatctatgctgcatccattttgcaaagtgggtcccggcaaggttcagtggcagtggatctgggacagaattcactctcaccatcagcagtctgcaacctgaagattttgcaacctactattgtcaacagagttacagtacgcccgngatcagcttcggccaagggcacgactggagaattaaagactgtggctgcaccatctgtcttcatcttcccgctatctgaacatctgtacngagcggntggcaggcnatgnnnnnnnn

SEQ ID NO: 111026 - DNA, 543 bp, Homo sapiens
  misc_feature: GYAE6OF02G5VNT.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatccctccctgtctgcatctgtaggagaaagcgtcaccatcacttgccgggcaagtcagagcattggcagttctttaaattggtatcaacggaaaccagggaaagcccctaaactcctgatctatgctgcatccattttgcaaagtcgggtccggcgtaaggttcagtggcagtggatcgtggacagattcactctcacatcagcagtctgcaactgaagtacttttgacctaacctacttattgtacaactagtacgttaacgacgttaccgcccgtacgactcacgtcgttaccggacgtaacgggaccacggtaccgtaggaacgtaaagtaaaacggtaacgttggtacggtacgtagaccaccgtatacgttcg

SEQ ID NO: 111027 - DNA, 709 bp, Homo sapiens
  misc_feature: GYAE6OF02JBKEW.35.6.A06.1.454.CMB.1.raw
  modified_base (218)..(218): a, c, t, g, unknown or other
  misc_feature (218)..(218): n is a, c, g, or t
  modified_base (253)..(253): a, c, t, g, unknown or other
  misc_feature (253)..(253): n is a, c, g, or t
  modified_base (297)..(297): a, c, t, g, unknown or other
  misc_feature (297)..(297): n is a, c, g, or t
tcagtacagatcgtcacgaccggtgctcgatttagatctactgacaggggtctgagagaggagcccagccctgggattttcaggtgttttcatttggtgtatcaggactgaacagagagaactcaccatggagtttgggctgagcgtgtcgtttctaggtggctagtttaaaggtgtcagtgtgagtgcagtctgtggagtcgtggggagcttggcanagtcctgggggccctgagctctcctgtgcagcctntggattcacttgcaaccgtatggacatgacgcttcggggtcccnccggggtcctacccgagggggaaggggttccttgggaaacgttggggttccctacggaaacttattcgggaacttgggtagttccgactttccaattaaaacccgacgtacggttacggtaaccgacgtaacggtacccgtcgggtagggtaccgggggttccgttaaccgacccgtatcccggtaccgaaggtaacgaaccgttaaaccgtccggaaacggtaccgaccgttcgtataaccgtactaactaaaggtcgacgtagtacctaggacgaccggaccgaacggttaccgaccgttacttaacgttacttacggtcggtaaccgggtaacgtaaacggttaccgaagtttcggtacggtaccggttacggacccggtaaggggtacgggttaacggtagttaccgg

SEQ ID NO: 111028 - DNA, 513 bp, Homo sapiens
  misc_feature: GYAE6OF02J2CKW.35.6.A06.1.454.CMB.1.raw
  modified_base (353)..(353): a, c, t, g, unknown or other
  misc_feature (353)..(353): n is a, c, g, or t
  modified_base (506)..(507): a, c, t, g, unknown or other
  misc_feature (506)..(507): n is a, c, g, or t
  modified_base (509)..(513): a, c, t, g, unknown or other
  misc_feature (509)..(513): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggcaagtcagagcattggcagttctttaaattggtatcaacggaaaccagggaaagcccctaaactcctgatctatgctgcatccattttgcaaagtgggtcccggcaaggttcattggcagtggatctgggacagaattcactctcaccatcagcagtctgcaacctgaagtattttgactaacctactattcgtacaacagagttacagtacgccgngatcagctcggcaaggacacgactggaagaattaaagactgtgctgcacatctcgtctcacttccttcccgctatcctagtaaccgtattcgtacgttacgtggacggtccgggaccgtgggtacccgaaagggcccgtataacgtaggcagnngnnnnn

SEQ ID NO: 111029 - DNA, 491 bp, Homo sapiens
  misc_feature: GYAE6OF02GSZB8.35.6.A06.1.454.CMB.1.raw
  modified_base (482)..(483): a, c, t, g, unknown or other
  misc_feature (482)..(483): n is a, c, g, or t
  modified_base (485)..(491): a, c, t, g, unknown or other
  misc_feature (485)..(491): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggcaagtcagagcattggcagttctttaaattggtatcaacggaaaccagggaaagcccctaaactcctgatctatgctgcatccattttgcaaagtggggtcccgcaaggttcagtggcagtggatcgtgggacagaattcactctcaccatcagcagtctgcaacctgaatattttgcaacctatattgtacaacagattacagtacgcccgcgatcagcttcggccaagggacacgaactggaacaagttaaaagactgtcggctacgacaccagtctgtcttacattctcccgctatctagaacgatctgtactaggacgcgggctggacaagggcacgatagnntnnnnnnn

SEQ ID NO: 111030 - DNA, 594 bp, Homo sapiens
  misc_feature: GYAE6OF02HGIQR.35.6.A06.1.454.CMB.1.raw
  modified_base (190)..(190): a, c, t, g, unknown or other
  misc_feature (190)..(190): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatccttcctgtctgcatctgtggganacagagtcaccatcacttgccaggctagtcaggacattaactctaatttaaattggtatcaacagaaatcaaggcaaaagcccctaaatcctagactctacgatgcaataccaatttacgggaaaacagggggtcccaagtcgaagtacttcaggtggaaagtggaatcgtagggactaggtattttacttcactatcagtcagcctagcagcctagaagtattaattcgactaaactattaattaccgtagtaaccaaactaagttaataggtaattacgtaaacctttccggaacctaagttacgttacttaccgttttagggacccgtaaagggggtaccctaaaggtttacggaacgtaacttacgaaacgttcggaaactttgggtacggtacctacgg

SEQ ID NO: 111031 - DNA, 519 bp, Homo sapiens
  misc_feature: GYAE6OF02IQHHY.35.6.A06.1.454.CMB.1.raw
  modified_base (323)..(323): a, c, t, g, unknown or other
  misc_feature (323)..(323): n is a, c, g, or t
  modified_base (415)..(415): a, c, t, g, unknown or other
  misc_feature (415)..(415): n is a, c, g, or t
  modified_base (439)..(439): a, c, t, g, unknown or other
  misc_feature (439)..(439): n is a, c, g, or t
  modified_base (453)..(453): a, c, t, g, unknown or other
  misc_feature (453)..(453): n is a, c, g, or t
  modified_base (486)..(486): a, c, t, g, unknown or other
  misc_feature (486)..(486): n is a, c, g, or t
  modified_base (496)..(496): a, c, t, g, unknown or other
  misc_feature (496)..(496): n is a, c, g, or t
tcagtacagatcgtcacgaccggtgctcgatttagatctactgacagggggagtcagtctcagtcaggacacagcatggacatgagggtccccgctcagctcctgggctcctgctactctggctccgaggtgccagatgtgacatccagatgacccagtctccatcctccctgtctgcatctgtaggagacagcgtcaccatcacttgccggcaagtcagagctattggcagttctttaaattggtatcaaacggaaaccagggaaaagcccctaaaactcctgatctaatgctgcatcgtatttgcaaagtggggtcccganaaggttcagtggcagtgatcagggacagaattcactctcacctatcagctagtctagacaactggaatattttgactaaaccttataagttnacaactaagacgtttacagtaccnccgtacgattacgnaccgttgacccaagggactacggaactaggaanaagttaaaanagttggagctggacaccgatccg

SEQ ID NO: 111032 - DNA, 508 bp, Homo sapiens
  misc_feature: GYAE6OF02F1YE9.35.6.A06.1.454.CMB.1.raw
  modified_base (320)..(320): a, c, t, g, unknown or other
  misc_feature (320)..(320): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgccatctgtaggagacagcgtcaccatcacttgccgggcaagtcagagcattggcagttctttaaattggtatcaacggaaaccagggaaagcccctaaactcctgatctatgctgcatccattttgcaaagtggggtcccgnaaggttcagtgcagtggatcgtgggacagattcactctcacatcagcagtctgcaacctgaatattttgactaaccttactattgtacaactagtagttacagtaccgccgacgactcacgtcttccggaccagggacacggtactaggaagaattaaagaactaggtcggactagcctaccattccg

SEQ ID NO: 111033 - DNA, 568 bp, Homo sapiens
  misc_feature: GYAE6OF02HGOK5.35.6.A06.1.454.CMB.1.raw
  modified_base (190)..(190): a, c, t, g, unknown or other
  misc_feature (190)..(190): n is a, c, g, or t
  modified_base (562)..(562): a, c, t, g, unknown or other
  misc_feature (562)..(562): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtagganacagcgtcaccatcacttggccgggcaagtcagagcattggcagttcttaaattggtatacaacggaaacagggaaacgacccctaaactcctagatctatagctgcatcctattttgactaaaggtcggggtacccggactaagggttcaggttcggctaggtggactcgtagggacagtaattcacgtctcgacctatcgagctagtcttgacctaacgtagtaagtatttacgactaacctacttattacgtacaacgtagtaacgttacacgtaccgccgacgtatcgacgtcttacggacctaagggtacacggtacgtaggaagtaacgttaaaacggacttacggtacgactacggactaaccgnttaccg

SEQ ID NO: 111034 - DNA, 585 bp, Homo sapiens
  misc_feature: GYAE6OF02HW8TD.35.6.A06.1.454.CMB.1.raw
  modified_base (244)..(244): a, c, t, g, unknown or other
  misc_feature (244)..(244): n is a, c, g, or t
  modified_base (563)..(563): a, c, t, g, unknown or other
  misc_feature (563)..(563): n is a, c, g, or t
  modified_base (571)..(571): a, c, t, g, unknown or other
  misc_feature (571)..(571): n is a, c, g, or t
  modified_base (581)..(581): a, c, t, g, unknown or other
  misc_feature (581)..(581): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggcaagtcagagcattggcagttctttaaattggtatcaacggaaaccagggaaagcccctaaactcctgatctatgctgcatcctattttgacaaaggtgggtcccggnaaggttcagtggcagtggatcgtgggacagaattcactctcaccatcagcagtctgcaacctgaagtatttgcaacctatattgtacaacagacgttacagtacgcccgacgatcacgtccgttcggaccgtaagggaacacgacgtagggaagtaaagttaaaacgacgttaggtaggcttcgactaaccattctacgttccttacgtattccctttccccgcctaacttcgtacgtaaacgtacttccgttagttacgtacggtacggaccgggtcgtacgggtaccggaacggggtaccgacgttaacgtaacggngtacgcgntacggatcgngacg

SEQ ID NO: 111035 - DNA, 491 bp, Homo sapiens
  misc_feature: GYAE6OF02GE99N.35.6.A06.1.454.CMB.1.raw
  modified_base (463)..(463): a, c, t, g, unknown or other
  misc_feature (463)..(463): n is a, c, g, or t
  modified_base (468)..(491): a, c, t, g, unknown or other
  misc_feature (468)..(491): n is a, c, g, or t
tcagtacagatcgtcacgaccggtgctcgatttagatctactgacgaggggtccgggaggatcatgagggtgtccttggggtttgggggaagaggaagactgacggtcccccaggagttcaggtgctgggtcacggtgtacctgcaaagtgaacagccgtgggacgacggaggactacggccgtatattactgtgcgacatctgcgagggtgccttactagtgaccaagtaggttggttttggcccaacatctaacctactttgacggactggggcctagggaaccctggtcgccgtctcctacagcctccaccaacgggcccaatcgggtccttacccccgtggccaccccgtccctccgaagcgccaccttcgtgggggtccacgacgccggccctagggcctcggccctggtaccaaggcctacgtccacgagtcgtgtactgagcgggctggcaggcgnatagnnnnnnnnnnnnnnnnnnnnnnnn

SEQ ID NO: 111036 - DNA, 547 bp, Homo sapiens
  misc_feature: GYAE6OF02GVW2C.35.6.A06.1.454.CMB.1.raw
  modified_base (465)..(465): a, c, t, g, unknown or other
  misc_feature (465)..(465): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttctttaaattggtatcaacggaaaccagggaaagcccctaaactcctgatctatgctgcatcctatttttcgactaaaggtcgggggtacccggctaacggtttcgaaggttgggcgtaggttggagtcgtgggacagtaattcacttctcaccatcacgcagtctgacaacctgaacgtatttcgactaaccttacttattgtacaacagtagttacacgtaccgcccgngactcgagtcttcggccaagggacacggactaggaagtaattaaaacggacgtggttacggctacggacctaccgattaccg

SEQ ID NO: 111037 - DNA, 677 bp, Homo sapiens
  misc_feature: GYAE6OF02JYC6K.35.6.A06.1.454.CMB.1.raw
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
tcagtacagatcgtcacgaccggtgctcgatttagatctactgacagggggagtcagtctcagtcaggacacagcatggacatgagggtccccgctcagctcctgggctcctgctactctgctcgaggtgccagtatgtgacatccagatgacccagtctccatccctcctgtctgccatcgtggtagagacagcgtcaccatctacgttgccggganaagtcagacnctaagttcgctagtttctttaaagttcggtaatacaaacggaaaccgagggaaccacccctaaatccgtagatcctagtcgactgactactacctattttacgactaacgggtccggggtacccgacgtaaacggttcaaggtcggctaaggtcgacgtgtagggactagtacttctacgtcttaccgaaccacgtacaggtactacgtcgtacgaacctaaccgtaggtaacttacggtttacacctttaacgttacttaacttacgtactaaaccgtagttacgttaaaccgtacggtaaccgtcccggtactaaccgtaccgtacggttaccgttacccgggaccgaacgggtacctacgggtaaacccgttggaaaacgtaaacgttaaaaacgggtacgttaccggttaggtacccgtaggtaccctaccggtaatttacccgg

SEQ ID NO: 111038 - DNA, 497 bp, Homo sapiens
  misc_feature: GYAE6OF02FKHX0.35.6.A06.1.454.CMB.1.raw
  modified_base (462)..(462): a, c, t, g, unknown or other
  misc_feature (462)..(462): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttctttaaattggtattcaacggaaaccagggaaagccccctaaaactcctagatctatgctgcatccattttgcaaagtggggtccgcaaggttcagtggcagtggatcgtgggacagaattcactctcaccatcagcagtctgcaactgaagattttgcaaccttactattgtacaacagtagttacagtacgccgcgatcagcttcgccaggacacgacgtggaanaagttaaagaacgtcgtgacgttagctaccatacg

SEQ ID NO: 111039 - DNA, 610 bp, Homo sapiens
  misc_feature: GYAE6OF02GT7PI.35.6.A06.1.454.CMB.1.raw
  modified_base (463)..(463): a, c, t, g, unknown or other
  misc_feature (463)..(463): n is a, c, g, or t
tcagtacagatcgtcacgaccggtgctcgatttagatctactgacaggggtctgagagaggagcccagccctgggattttcaggtgttttcatttggtgatcaggactgaacagagagaactcaccatggagtttgggctgaggtggctttttcttgtggctattttaaaaggtgtccaatgtgaagtgcacctgttggagtctgggggaggcttggtacaggcgggggggtccctgagactctcctgtgcagcctctggattcacctttagcaactatgccatgagcgtgggtccgccgaggctccgagggggagggcgtggcggtgggtctacaactagttagtgctaggcggtggtaatagagactacgcaagactctcgtaggaacgggtccggttcactcattcctcgaagggtacaagttcccgaagacgctacgggtgtacctgactaatcgaacngccgtagggacgacggaggaccgacggtccgtaattacgttacgtggtacgaccgtactacttcgcggtcgggtaacgggttcgtacccttttacgaacttacggaaccttaaggtttacggtttcgggttttaccgaccttaacgg

SEQ ID NO: 111040 - DNA, 480 bp, Homo sapiens
  misc_feature: GYAE6OF02HN16F.35.6.A06.1.454.CMB.1.raw
  modified_base (241)..(241): a, c, t, g, unknown or other
  misc_feature (241)..(241): n is a, c, g, or t
  modified_base (435)..(435): a, c, t, g, unknown or other
  misc_feature (435)..(435): n is a, c, g, or t
  modified_base (469)..(470): a, c, t, g, unknown or other
  misc_feature (469)..(470): n is a, c, g, or t
  modified_base (473)..(480): a, c, t, g, unknown or other
  misc_feature (473)..(480): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggcaagtcagagcattggcagttctttaaattggtatcaacggaaaccagggaaagcccctaaactcctgatctatgctgcatccattttgcaaagtgggtcccggnaaggttcagtggcagtggatctgggacagaattcgctctcaccatcagcagtctgcaacctgaagattttgcaacttactactgtacaacagtagttacagtggcttctactttcggcggaggaccgaagggtcgacatacaaacgacgtgtaggctgcacatctgtcttcattccttccgcctatctagaacntctgtactgacgcggctgcgaggcgacgagtagnntgnnnnnnnn

SEQ ID NO: 111041 - DNA, 620 bp, Homo sapiens
  misc_feature: GYAE6OF02IW9QY.35.6.A06.1.454.CMB.1.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
  modified_base (407)..(407): a, c, t, g, unknown or other
  misc_feature (407)..(407): n is a, c, g, or t
tcagtacagatcgtcacgaccggtgctcgatttagatctactgacagggggagtcagtctcagtcaggacacagcatggacatgagggtccccgctcagctccgtggggctcctgctactctggctccgaggtgccagatgtgacatccagatcgacccagtcctccatccctccctgtctgcatctgtagganacagcgtcaccatcacttggccgggnaagtcagagcagttggctagtttactttaaattggtatacgaaacggaacgtaagggaaactcccctaaaactcctagatctatgctgactatcctatttgacgtaaaggtcgggggtaccgacggtaagttacgaggtggctaggtggtatcgtagggactaagtaacttcactctacaccatcancagtctagaccaactagaattatttacgaccttaacttacttagttacgtacaacgtagtaacgtttacgaacgttaacccgccgtactaacgtactacggtaccgttaccgggaccgaacgggtaaccaaccggtaacggtacggtaaacggttaaaattaaaaccggtagttacgggtacggaccttacggaaccctacgtacgtttaccg

SEQ ID NO: 111042 - DNA, 440 bp, Homo sapiens
  misc_feature: GYAE6OF02G0ZFV.35.6.A06.1.454.CMB.1.raw
  modified_base (429)..(440): a, c, t, g, unknown or other
  misc_feature (429)..(440): n is a, c, g, or t
tcagtacagatcgtcacgaccggtgctcgatttagatctactgacaggggtccgggagatcatgagggtgtccttgggttttggggggaagaggaagactgacggtccccccaggagttcaggtgctgggcacggtgtacctgcaaatgaacagcctgggagacgaggacacggccgtatattactgtgcgacatctgcgagggtgccttactatgacaatagtggttttggccacatctactactttgaggactggggccagggaaccctggtcgccgtctcctcagcctccaccaagggcccatcggtccttccccctggccaccctcctccaagacgccacctcgtgggggcacgagccggccctgggctgcctggtcaaggctactcacgatctgtactggagcgggctggcaaggcgcagtagnnnnnnnnnnnn

SEQ ID NO: 111043 - DNA, 530 bp, Homo sapiens
  misc_feature: GYAE6OF02IZBVL.35.6.A06.1.454.CMB.1.raw
  modified_base (486)..(486): a, c, t, g, unknown or other
  misc_feature (486)..(486): n is a, c, g, or t
  modified_base (490)..(490): a, c, t, g, unknown or other
  misc_feature (490)..(490): n is a, c, g, or t
  modified_base (492)..(530): a, c, t, g, unknown or other
  misc_feature (492)..(530): n is a, c, g, or t
tcagtacagatcgtcacgaccggtgctcgatttagatctactgacaggggtccgggagatcatgagggtgtccttgggttttggggggaagaggaagactgacggtccccccaggagttcaggtgctgggcacggtgtacctgcaaatgaacagcctgggagacgaggacacggccgtatattactgtgcgacatctgcgagggtgccttactatgacaatagtggttttggccacatctactactttgaggactggggccagggaaccctgggtcgccgtctcctcagccctccaccaagggccccagtcggtccttccccgtgccacccctcctccaagacgccacctcgtgggggccacgagccggcccgtgggctcggcctgggtacaaacgggtacctacgtttcccgaacgtacgttacgtaccgtggaacgggccggggccgttcgggaccgaaacgggcccgtacgaagtaaggcagntcgnannnnnnnnnnnnnnnnnnnnnnnnnnnnnnnnnnnnnnn

SEQ ID NO: 111044 - DNA, 532 bp, Homo sapiens
  misc_feature: GYAE6OF02GR76F.35.6.A06.1.454.CMB.1.raw
tcagtacagatcgtcacgaccggtgctcgatttagatctactgacaggggtctgagagaggagcccagccctgggattttcaggtgttttcatttggtgatcaggactgaacagagagaactcaccatggagtttgggctgaggtggctttttcttgtggctattttaaaaggtgtccaatgtgaagtgcacctgttggagtctgggggaggcttggtacaggcgggggggtccctgagactctcctgtgcagcctctggattcacctttagcaactatgccatgagctggggtccgccaggctccgaggggagggctgggcgtgggtctcaactattagtgctagcggtggtaatagagactacgcagactctctgaagggtccggttcatcatctccagggacaattaccaagagcacggtcgtacctgacaaatagaacacgcctagggagacggaggacacggccgtatagttactgtgcgacatcgtgcggaggtgccttactatgacataggtggtttcggctacg

SEQ ID NO: 111045 - DNA, 588 bp, Homo sapiens
  misc_feature: GYAE6OF02G31I2.35.6.A06.1.454.CMB.1.raw
  modified_base (214)..(214): a, c, t, g, unknown or other
  misc_feature (214)..(214): n is a, c, g, or t
  modified_base (276)..(276): a, c, t, g, unknown or other
  misc_feature (276)..(276): n is a, c, g, or t
tcagtacagatcgtcacgaccggtgctcgatttagatctactgacagggggagtcagtctcagtcaggacacagcatggacatgagggtccccgctcagctcctgggctcctgctactctggctccgaggtgccagatgtgacatccagatgacccagtctccatcctccctgtctgcatctgtaggagacagcgtcaccatcacttgccgggnaagtcagagctattggctagtttactttaaattggtatacgaaacggaaaccgagggaaacncccctaaactcctagactctatgctgcatcctattttcgacgtaaaggtcggggtacccggacgtaacggttcgaggtcggcgaggtggtagtcgtagggacagtacttcactctacactatcacgctagtctagacctaacgtagtaagttatttcgacctaaccttacttattacgtacaacgtagtaagttaacgtacgtaccgcccgtacgtactcgacgtccgttaccggaccgacgggaccacggtaacgtacggaagtaacgttaaaaggacgtacggtacggtactacgacctacgtagttccg

SEQ ID NO: 111046 - DNA, 638 bp, Homo sapiens
  misc_feature: GYAE6OF02IYOH1.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttctttaaattggtaatcaacggaaaccagggaaagacccctaaactcctagactctatgctgcactcctattttcgacgtaaacgggtcgggggtacccgtacgtaaggtcaggtggcgtaggtggactcggtagggaactaagtaacttcacgttactaccgaactatccgaagcacgtcctcgacacgccgttgagttagttaactttttgaaccttaaaccgttacttaacgcgtaacctaaactaaggttacgttaggtacgttaacctttccggtaccttaccggttcccggtacccggtacgggtaacccgtaaaggttacggtaactttaaccgtaaccgtaaaaccggttaaccgttgggtaccggtcttaccgacctaaccgtacttccgttacg

SEQ ID NO: 111047 - DNA, 803 bp, Homo sapiens
  misc_feature: GYAE6OF02HB0DX.35.6.A06.1.454.CMB.1.raw
  modified_base (189)..(189): a, c, t, g, unknown or other
  misc_feature (189)..(189): n is a, c, g, or t
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
tcagtacagatcgtcacgaccggtgctcgatttagatctactgacagggggagtcagtctcagtcaggacacagcatggacatgagggtccccgctcagctcctgggctcctgctactctggctccgaggtgccagatgtgacatccagatgacccagtctccatcctccctgtctgcatctgtagganaacngcgtcaccatcacgttggcccggnaacgtcagagctagtggctagttacttaaattggtatcgaacggaaacgacgggaaacgaccctaaactcctagactcctaagtcgtacgtcgtctaacttccttagttttacggacgtaaaaagggttccgggggtacccggaacgttaacggggttactaacgggttcggacgtaaggtcgggtaaactcggttaggggacctaagtaacttcgaccttctaccaacctacgtacgtaagccgttaaagttccgtacgtaacccgtaaaccgttaggtaacgtttaccggtttaaagtttttaaccgggtacccctttaaaaaccgtttacttttaaacccggttaacccggttaaacccgaaaacccggtttaaagggtttaccgttaacggggtttaacttaaacccgttttcccgtaacccggtttacccggttttaacccggtacccccggttacgggtaaaacccgttaaggggttaacggtaacggttaaaacgttaaccgtaaaacggtaaccgtttaacggtcggtacccgttacggaccgttaaaccccgtacgttaacggtttcggttaacccc

SEQ ID NO: 111048 - DNA, 612 bp, Homo sapiens
  misc_feature: GYAE6OF02H96ZO.35.6.A06.1.454.CMB.1.raw
  modified_base (192)..(192): a, c, t, g, unknown or other
  misc_feature (192)..(192): n is a, c, g, or t
  modified_base (278)..(278): a, c, t, g, unknown or other
  misc_feature (278)..(278): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatcgacccagtctccatccctccctgtctgcatctgtagganacagcgtcaccatcacgttcggccgggacaagtcagagctattggctagtttctttaaagttggtatacaacggtaacaaggaacncccctaaactctagatctatgctgcactccttatttacgacgtaaaggtcgggggtacccgacgtaaggttcaggtggcgaggtaggactcgtagggacaagtaacttcgactctacactatacacgtactagtcacgactaaccgtagtaacgttatttcgaaccttaacttacttattacgaacaacgtagtaacgttaacgacgtaccgaccgacgtaatcgacgccgttaccggaacgaacgggacctaacgggtacgtaacgggtaacgtaaaacgttaaaacggacgttagggtacggtacgtacgacccgtaaccgtagtttacccg

SEQ ID NO: 111049 - DNA, 553 bp, Homo sapiens
  misc_feature: GYAE6OF02GVIUV.35.6.A06.1.454.CMB.1.raw
  modified_base (239)..(239): a, c, t, g, unknown or other
  misc_feature (239)..(239): n is a, c, g, or t
  modified_base (543)..(543): a, c, t, g, unknown or other
  misc_feature (543)..(543): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggcaagtcagagcattggcagttctttaaattggtatcaacggaaaccagggaaagcccctaaactcctgatctatgctgcatccatttgcaaagtgggtcccgnaaggttcagtgcagtggatcgtgggacagaattcactctacaccatcagcagtctgcaacctgaagtattttcgactaaccttatattgtacaacagtagttacagtaccgccagatcgagtccttcggaccaagggacacgacgtaggaagtaagttaaaacgactaggtacggtactacgacgacctactactcgttcttactacttcccttcccgacctacttaccgtactaacgtacttcgttagtactcgggacgtcgggtcgtacgggaccggaacggtccggtacgaagtacgcgancgatncangn

SEQ ID NO: 111050 - DNA, 205 bp, Homo sapiens
  misc_feature: GYAE6OF02FXQHI.35.6.A06.1.454.CMB.1.raw
  modified_base (203)..(205): a, c, t, g, unknown or other
  misc_feature (203)..(205): n is a, c, g, or t
tcagtacagatcgtcacgaccggtgctcgatttagatctactgacaggggtccgggagatcatgagggtgtccttgggttttgggggaagaggaagactgacggtccccccaggagttcaggtgctgggcacagcggccctgggctgcctggtcaaggactacttccacgatctgtactgagcgggctggcaaggcgcatagnnn

SEQ ID NO: 111051 - DNA, 553 bp, Homo sapiens
  misc_feature: GYAE6OF02F6VC4.35.6.A06.1.454.CMB.1.raw
  modified_base (216)..(216): a, c, t, g, unknown or other
  misc_feature (216)..(216): n is a, c, g, or t
  modified_base (391)..(391): a, c, t, g, unknown or other
  misc_feature (391)..(391): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagcgtcaccatcacttgccgggnaagtcagagcattggcagttctttaaattggtatcaacggaacaggaaacgacccctaaactccctagatctatgctgcacttcctattttcgacgtaaaggtcggggtaccgcgtaaggttcaggtggctaggtaggacttcgtgggaacaggtaattcgactctacacatcanctagtctgacaactagaagttatttagacctaaccttactacttacgtacaactagtacttaactaggtaccgcccgtagactcgacgtaccgttcgaccgaggaccgacgaacgtaggagtaattaaacgacgtaggtaggtcgtacgactacgattaccg

SEQ ID NO: 111052 - DNA, 574 bp, Homo sapiens
  misc_feature: GYAE6OF02H5TJN.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctcatcctcctgtctgcatctgtaggagacagcgtacaccatcacttgccgggacaagtcagagctattggctagtttactttaaattggtaatacgaaacggaaaccaagggaacgtacccctaaactcctagatctatgctgcatcctattttgactaaggtcgggtccggagtaacggttcaggtgcgagtggactgtaggactagaattcactctacacatcacgcagtcgtagactaacgtagtaagttattttcgaccttaaccttacttaacttgtacaacgtaagtaacgttaacgtacgtaccgtccgacgtacgtacacgtaccgttccggaaccgaacgggtaccaacggtaacggtaggaacgtaaagttaaacgaacgttggtagcgtacgacacctattc

SEQ ID NO: 111053 - DNA, 743 bp, Homo sapiens
  misc_feature: GYAE6OF02JS4F1.35.6.A06.1.454.CMB.1.raw
  modified_base (95)..(95): a, c, t, g, unknown or other
  misc_feature (95)..(95): n is a, c, g, or t
tcagtacagatcgtcacgaccggtgctcgatttagatctactgacagggggagtcagtctcagtcaggacacagcatggacatgagggtccccgntcagctccgtgggctcctgctactctggctccgaggtgccagatgtgacatccagatcgacccagtcctccatccctccctgtctgcatctgtagagacagctacacctatccacgtcggccgggactaaggtccaaggacgccgtaagttggacttaaggtttacctttaaagttggtaactaaccggaaaccgggtaaaccgaagggtaaaccgacccccgttaaactccgtagacttactacgtcgtacgtcgacctacttacctagtttacgaacgtaacgggtccggggtaccgacggttaacgtcgaggtcggacgtaggtagtacgtgtacggaactagtaacttaccgtactaccgtactaccagtaccgacgtacgcgtacgcctaccgtaaacgaagttaacgttacgtttaccgaaacccttaaccttacgtttaacgtacgttaaccgtaacgttacggttaaacgtttacccgaacgggttaaacccgcccgggttaactaacgttacccggtaacggtccggtttaaacccgggaccgacggggtaaccctaacgggtaaccgggttaaaggaacgttaaaacgttaaccggacggtttacggcggtaacctacggtaacccacgttattacgg

SEQ ID NO: 111054 - DNA, 754 bp, Homo sapiens
  misc_feature: GYAE6OF02HF4W7.35.6.A06.1.454.CMB.1.raw
  modified_base (736)..(736): a, c, t, g, unknown or other
  misc_feature (736)..(736): n is a, c, g, or t
tcagtacagatcgtcacgaccggtgctcgatttagatctactgacaggggagtcagtctcagtcaggacacagcatggacatgacgggtccccgctccgagcctccgtggggcctcctgctactctggctccgaggtcgccagactgtgacatccagatcgacccagtcctccatcccctcctgtctagctactctggtaggacacagccgtacaacctatccagttcggcccgggataaaggtccaaggagccgtaattcggactagttactttaaagttggtactacgaaacggaaacctaacgggaaaaccgtaccccctaaaacgttaccctagtaacgttactaacgtcgtactagtactacgtaccttagttttacgacgttaaacgggtccggggtacccggtacggttaacggttacgtagggtcggacgtaggtacggtagtacggtcgggaactaaggttaacttaccgaccttaccgtaccgtaacctaggtaccacggtacgacgtttaccgacgtaacccggtaactacggtaaagtttaccgtttacgaaccccttaacctttaacggttaaccgttacgttaaccaaaccgttagggttaaacttaccgaaccggtttaacccgacccggtaccgtaatccggtaaactcccgttaccggaccaaacggggtcctaacggtaacgtacggaaagttaaacgtaaagtacgttcggacggtnaccggtaccacgtatacg

SEQ ID NO: 111055 - DNA, 707 bp, Homo sapiens
  misc_feature: GYAE6OF02FEXC0.35.6.A06.1.454.CMB.1.raw
  modified_base (380)..(380): a, c, t, g, unknown or other
  misc_feature (380)..(380): n is a, c, g, or t
tcagtacagatcgtcacgaccggtgctcgatttagatctactgacaggggtctgagagaggagcccagcccctgggattttcaggtgttttcatttggtgatcaggactgaacagagagaactcaccatggagtttgggctgaggtggctttttcttgtggctattttaaaaggtgtccaatgtgaagtgcacctgttggagtcgtggggagcttggtacaggcgggggggtccctgagactctcctgtgcagcctcgtggattcacctttagccaatatgccatgagtcgtgggtcccgcaggctccgaggggagggcctggcgtgggtctcaacttagttagtgctaggcggtaggtaataggagactacgcagactntacgtaggaacgggtccggttacatccacttcctaccgaagggtaccaaacgtttcccgaaaggtacgaccgtaaccggttcgtaacccgttagaacgtaaaacgttacggaaacccgacggtacccggtaggggaacgaaacggaacgggaaccgtaacccggggtaaccggttaacgtttaaccgtttacgttacggtcgtacccgtaaccgttacgttaccggtcggtaaccgggttacggggtacccgttaccctttaacgtaacgttaacggtaaccgttaaaggttacgggttttacgggttttacggacccttaaaccgg

SEQ ID NO: 111056 - DNA, 570 bp, Homo sapiens
  misc_feature: GYAE6OF02HEPS5.35.6.A06.1.454.CMB.1.raw
  modified_base (192)..(192): a, c, t, g, unknown or other
  misc_feature (192)..(192): n is a, c, g, or t
  modified_base (565)..(565): a, c, t, g, unknown or other
  misc_feature (565)..(565): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatccctccctgtctgcatctggtagganacagcgtcaccatcacttcggccgggacaagtcagagctattggactagtttactttaaagttggtaactacgaaacggaaaccgaagggaaacgtaccccctaaaactccgtagtactctatcgctgctatcctatttgacgtaaagggttcggggtcccgagtaaggttcgaggtcggacgtaggtaggatcggtagggactaagtaacttccacgtctacactactcagctagtctgacacgtagaacttagtttcgaacttaacctatattcgacaagagtacttacagtccgaccgacgtactcgacgtcgtacggacctaggacacggagtacggaataagtaacgagtggtcgacctgacctacgnttacg

SEQ ID NO: 111057 - DNA, 536 bp, Homo sapiens
  misc_feature: GYAE6OF02GAB2T.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttctttaaattggtatcaacggaaaccagggaaagcccctaaactcctgatctatgctgcatccattttgcaaagtggggtcccggcaaggttcagtggcagtggatctgggacagaattcactctcaccatcagcagtctgaccaacctgaacgtattttcggacctaaaccttactaatttcgtacaaaccgtagaacgtttacacggtaccgcccgacgactcagtcgttcggaccaagggacacggactggaagtaacttaaaagacgttaggtacgggccttaggccctacagttacc

SEQ ID NO: 111058 - DNA, 610 bp, Homo sapiens
  misc_feature: GYAE6OF02IFMZU.35.6.A06.1.454.CMB.1.raw
  modified_base (243)..(243): a, c, t, g, unknown or other
  misc_feature (243)..(243): n is a, c, g, or t
  modified_base (325)..(325): a, c, t, g, unknown or other
  misc_feature (325)..(325): n is a, c, g, or t
  modified_base (598)..(598): a, c, t, g, unknown or other
  misc_feature (598)..(598): n is a, c, g, or t
  modified_base (604)..(605): a, c, t, g, unknown or other
  misc_feature (604)..(605): n is a, c, g, or t
  modified_base (607)..(607): a, c, t, g, unknown or other
  misc_feature (607)..(607): n is a, c, g, or t
  modified_base (609)..(610): a, c, t, g, unknown or other
  misc_feature (609)..(610): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgtcgggcaagtcagagcattggcagtttctttaaattggtatcaacggaaaccagggaaagcccctaaaactcctgatctatgctgcatccattttgacaaagtgggtcccgnaaggttcagtggcagtggatcgtagggacagaattcactctacaccatcagcagtctgcactagatatttgacaacctattntagtacaagagacttacagtaccgccgacgatacagtcgttaccggaccgtaaacgggacaaccggtacgtagggtaacgtaaattaaaaacggtaccttagggtacggtacgtacggacctaacctacgtttactcggtttccttactaaccgtttccgttccccgtacctaacgttcctaacggtaacgtaacttacgttacgttaacgtcgggaacgtccggggtacttacgggaacgtaaccgggaccgtaccgtaagttacgacgtancgtagnngngnn

SEQ ID NO: 111059 - DNA, 618 bp, Homo sapiens
  misc_feature: GYAE6OF02G14W3.35.6.A06.1.454.CMB.1.raw
  modified_base (190)..(190): a, c, t, g, unknown or other
  misc_feature (190)..(190): n is a, c, g, or t
  modified_base (395)..(395): a, c, t, g, unknown or other
  misc_feature (395)..(395): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtagganacagcgtcaccatcacttgccgggcaagtcagagcattggctagttctttaaattggtatacgaaacggaaaccgagggaaacgacccctaaactcctagatctatgctgactactcctattttgactaaggtcgggggtaccggataacggttcaggtggctaggtggatcgtagggactagtaattcactctcactatacganctagtctacgactaacgtgtaagttactttagacctaaaccttacttacttagtaacctaaagtacgtaacgttaccgacggttacccgacccggtacgtacttacgacgttaccggttccggaccggtaacgggacctaacgggtaacggttaagggtaaacgtaaacgttaaaacggaacgttacggttacggtaccgtacggtaccgacgttagtacccg

SEQ ID NO: 111060 - DNA, 723 bp, Homo sapiens
  misc_feature: GYAE6OF02G80LD.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttctttaaattggtatcaacggaaaccagggaaagcccctaaactcctgatctaatgctgcatcctatttttcgcaaaaggttcgggggtccccggacgtaaaggggtttccaagggttcggggactagggttcggggaattccggttaggggaacctaaggtaaacgttttccaaccttccgttaccaaccctacttaccgaacgccgaaaggttcccttaggaccgtaaaccccgttaggtaaacgttaacgtttttcggaacctaaaccccgtttaacttaacgttttacgtaccgtaaacccgtaaaggtaacggttttaaaccgtaacggtaacccggtacccccggtacgtaacgttaccgtaacgttcccgttacccgggaccggtaaacggggtaacccaaccgggtacgtagggtaaacgtaaagtttaaaaccggtaacttagggtacggttaccgtacggaccgtaccgtacttacccg

SEQ ID NO: 111061 - DNA, 718 bp, Homo sapiens
  misc_feature: GYAE6OF02IP2TA.35.6.A06.1.454.CMB.1.raw
  modified_base (286)..(286): a, c, t, g, unknown or other
  misc_feature (286)..(286): n is a, c, g, or t
  modified_base (706)..(706): a, c, t, g, unknown or other
  misc_feature (706)..(706): n is a, c, g, or t
tcagtacagatcgtcacgaccggtgctcgatttagatctactgacaggggtctgagagaggagcccagccctgggattttcaggtgttttcatttggtgatcaggactgaacagagagaactcaccatgggagtttgggctgaggtggttttcctcgttgctcttttaagaggtgtccagtgtcaggtgctagttggtggagtcgtgggggaggcgtggtccagccgtggggacggtccctggacgactcgtcctggtcgcagtcctcgtagtacttccacctttnaagttagctagtggactagtcgcctaacggtcggggtccccgaccacgggtcctaccgaaggggtacctaaagggggaccgttggggagggttcgggggtaggaccttaaggtttaatatacgaattagtagagttaagggaaattaagtaggtaagttacgtaaagtcgaacgtaaggtacgtacggtaggaacggggtacctaacttccgaaacctacgttaccgtaccgaaaggactaaccgtaaacgttacccgaaagaaacccgacgttacgtacgttactacgttacgaacctaaaagtacgaaaccgtacgaccgttagacgtacgtacgacgggaacgacgtaaccggtgtggttacgttacttacgtacggtaagtaacggtaaacgttccgttaaccggttaacccgttnttaacggtacgg

SEQ ID NO: 111062 - DNA, 704 bp, Homo sapiens
  misc_feature: GYAE6OF02JQRHV.35.6.A06.1.454.CMB.1.raw
  modified_base (95)..(95): a, c, t, g, unknown or other
  misc_feature (95)..(95): n is a, c, g, or t
  modified_base (191)..(191): a, c, t, g, unknown or other
  misc_feature (191)..(191): n is a, c, g, or t
  modified_base (630)..(630): a, c, t, g, unknown or other
  misc_feature (630)..(630): n is a, c, g, or t
tcagtacagatcgtcacgaccggtgctcgatttagatctactgacagggggagtcagtctcagtcaggacacagcatggacatgagggtccccgntcagctctgggctcctgctactctggctccgaggtgccagatgtgacatccagatgacccagtctccatccctccctgtctagcatctggtagganaccagccgtacaccaatccacgttcggcccgggtacaaaggtcgagacgtctagtttcggacctagtttactttaaaagttgggtaactaccgaaaaccgggtaaaaccgaacggggtaaaacgtacccccctaaaacgttccgtaggaacttaccttaaggtcgtaccgttaggacctaacttacccgttagtttttacggaacgttaaaacgggttccgggggtacccccggagttaacggttacgaagggttcgtacggtaaggtaggtacgttcggtaagggaactaaggttaactcgtacgtaccgtacaccgtatcgaacgtctagtccttacgactaacgtagaatttcgtttacgacgtttacttttaacgtcttacgtacgatacgtaaacgttaattacgtaggtcctaccggtcctttacgagtttcnccggtttaacgtggaaccgtacggggactaagggctacgggaattacgtacaacgtacgtggtcggactcgaac

SEQ ID NO: 111063 - DNA, 438 bp, Homo sapiens
  misc_feature: GYAE6OF02IPQDC.35.6.A06.1.454.CMB.1.raw
  modified_base (424)..(424): a, c, t, g, unknown or other
  misc_feature (424)..(424): n is a, c, g, or t
  modified_base (431)..(438): a, c, t, g, unknown or other
  misc_feature (431)..(438): n is a, c, g, or t
tcagtacagatcgtcacgaccggtgctcgatttagatctactgacaggggtccgggagatcatgagggtgtccttgggttttggggggaagaggaagactgacggtccccccaggagttcaggtgctgggcacggtgtacctgcaaatgaacagcctgggagacgaggacacggccgtatattactgtgcgacatctgcgagggtgccttactatgacaatagtggttttggtcacatctactactttgaggactggggccagggaaccctggtcgccgtctcctcagcctccaccaagggcccatcggtcttccccctggcaccctcctccaagacgcacctctcggggcacagcggccctgggctgcctggtcaaggacctacttcccacgactctgtactgacgcgggctgggcaagggcncagtagnnnnnnnn

SEQ ID NO: 111064 - DNA, 848 bp, Homo sapiens
  misc_feature: GYAE6OF02H1PDO.35.6.A06.1.454.CMB.1.raw
  modified_base (192)..(192): a, c, t, g, unknown or other
  misc_feature (192)..(192): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtcctccatccctccctgtctgcatctgtagganacagcgtcaccatcacttgccggcaagtcagagcagttggactagtttactttaaagttggttaatacgaaacgggaaaacccgaaggggtaaaacgacccccttaaaacgttcctaggtaactacgttaagtcgacgtcgtacacttcccttagtttttacgacgtaaagggttccgggggtacccggtacgtaacgggtttacgaggttcgggacgttaaggtacgggtaacgttacggtacggggaactaaggttaaacctttaccgtaaccctttccgttaaccctacccgaacgtttacccgaacgggtacccgtaacggtttaccgtacggtaacccgtaaaccccggttaaggtaaaccgttttaaggttttttaacccgtaacccgttaaaaccgttttaaccgtttaaaccgtttaccgggtaaaccctaaaaccggttacgtttaaacgggtttaaccgggtttaacgttaaccgttttcccggttaacccgtttacccggtttttacccgggtaccccggttaacgggtaaacccggtttaaacggtacgggtaactttaaacgtaacccgtaaacggttaaccttaacgggttaccggtacttacggtaccctaaccgttattaccggtttactccgttttacc

SEQ ID NO: 111065 - DNA, 619 bp, Homo sapiens
  misc_feature: GYAE6OF02IPXCG.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagcgtcaccatcacttggcccgggcaagtcagagcattggctagtttactttaaattggtaactacaaacggaaaccgaaggaaacgacccctaaactcctagatctatgctgactactcctagttttcgacgtaaaggttcggggtacccggtacgtaaggttcgaggtggtcaggtggatacgtgggaacaagtaatactactcctacacctatcacgactagtctgactaacctgtaaacgttactttacgtacctaaacccgttacttaacgttacgtaacaacgtaacgtagttaaccgtagtacccgcccgtacgtactactacgtccgtcggacccgacgggaaccgtacggaacgttaggaaacgtaacgttaaaacgtaacgtacggtcggtacgtaccggtactacctagttaccg

SEQ ID NO: 111066 - DNA, 765 bp, Homo sapiens
  misc_feature: GYAE6OF02JSQOH.35.6.A06.1.454.CMB.1.raw
  modified_base (361)..(361): a, c, t, g, unknown or other
  misc_feature (361)..(361): n is a, c, g, or t
  modified_base (467)..(467): a, c, t, g, unknown or other
  misc_feature (467)..(467): n is a, c, g, or t
  modified_base (495)..(495): a, c, t, g, unknown or other
  misc_feature (495)..(495): n is a, c, g, or t
tcagtacagatcgtcacgaccggtgctcgatttagatctactgacaggggtctgagagaggagcccagccctgggattttcgaggttgttttctattttggtgtatcaggactgaacagagagaactcaccataggagtttgggctgaggtggtctttttcttggtggtcttaagttttaaaaggtgtaccgaatgtagaagtgctacctgttggagtcgtgggggtaggcgttggtacgagggtcggggggttccctggacggtactccgttccttggtcgactacggccttccggtaggtacttcctaaccgtttagaccctaagtactcgacctagtcggagtccgttcgggggtccncccgtagggtccgtcccggaagggggtcggggccttcggggcgttagggtccgtacgaacgttagttagtcgtcgtagggcggtaggtaatacgagacgttacganacgactctacgtgggaacgggccgttanacgttctacgtcgtaccgaagggactaaacgttccgaaagtcgtacgaccgttacgtacgtacgtactaaaaggttcgaaacgtccgtacgggtacggtaagtaaccgggacgggtaaaccgtacccgggtaacggttaaccgtaacgtttaccgtgggtaaccccgagtaacccgtagtcggtcggtaacgggtaccgggttcctaaccggttacgttaacggacgttaccgtaaggttacggtttccgggtttacgaccgttaaaccg

SEQ ID NO: 111067 - DNA, 695 bp, Homo sapiens
  misc_feature: GYAE6OF02GTLS2.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggctagttctttaaattggtatacgaacggtaaaccagggaaacgacccctaaactcctgatctatgactgcatcctattttcgacgtaaaggttcgggggtacccggacgtaaacgggtttccaaggttcgggtactagggttagggtaattccggtaggggaaccaagggtaactttaccacgttcctaccaacctaatccaacgtctaacggttaccttacgacctaaaccgtaggaaacgttattttacggaacctaaacccttacttaacgttacgtacctaaacgtaacgttaacgtttaaccgaacggttacccggacccgtacgtaacttaccgaacggtaccgtttaccgggaaccggtaacggggaacctaaccgggtaacggttaacgggtaaagtaaacgtttaaaaacggacgttaggtacggtacgttacggaacctaccgtactttacccgg

SEQ ID NO: 111068 - DNA, 516 bp, Homo sapiens
  misc_feature: GYAE6OF02GJVH5.35.6.A06.1.454.CMB.1.raw
  modified_base (303)..(303): a, c, t, g, unknown or other
  misc_feature (303)..(303): n is a, c, g, or t
  modified_base (480)..(516): a, c, t, g, unknown or other
  misc_feature (480)..(516): n is a, c, g, or t
tcagtacagatcgtcacgaccggtgctcgatttagatctactgacaggggtccgggagatcatgagggtgtccttgggttttggggggaagaggaagactgacggtccccccaggagttcaggtgctgggcacggtgtacctgcaaatgaacagcctgggagacgaggacacggccgtatattactgtgcgaaagttcgaacagtggctggcacgaggtcgggatatgactactggggccagggaaccctggtcaccgcctcctcagccctccaccaaggcccatccggtcttccccctgccnccctcctccaagacgccacctcgtcgggggccacgacgccggccccgtggggcctcgcccgtcgggtaccaaacgggtaccttaacctttcccgaaccggtaacttccgtacggttaacctgggtaacgggccgggggtacctcggggaccgaaacgggccggtctaagttaacggnnnnnnnnnnnnnnnnnnnnnnnnnnnnnnnnnnnnn

SEQ ID NO: 111069 - DNA, 858 bp, Homo sapiens
  misc_feature: GYAE6OF02JD7BH.35.6.A06.1.454.CMB.1.raw
  modified_base (259)..(259): a, c, t, g, unknown or other
  misc_feature (259)..(259): n is a, c, g, or t
tcagtacagatcgtcacgaccggtgctcgatttagatctactgacagggggagtcagtctcagtcaggacacagcatggacatgagggtccccgctcagctcctggggctcctgctactctggctccggaggtgccagatgtgacatccagatgacccagtctccatccctccctgtctgctatctagtaggacgacagccgtcaccaatcacttggccggcaagtcagagcagttggctagttactttaaattggtanactaaacggaaccaagggtaaaccgacccctaaaacgtcctaggtaactcttaacgtcgccgttacgcctaacttacccgttaagttttaggaaccgtaaacgggttccggggggtaccccggtaacgttaaaccgggttacgtaacggtcggggtaacgtagggttacggtagtccggtaggggtaaccgtaacgtaaagtttccaaccgttacctacccgtaaacccgtaccgtaccgtacgggtaccgttaaccggttaccgttacccgtaaccgtaaacccgttaagtaaacggtttaacgtttttaccggaaacccgtttaaacccctttaaacggttaacttttaaccggttaaccgttaaaaccgttaacggttaaacggtttaacttaacgttttaccggttaacctttaccggttaaccggttttacccggggtaacgggttaaaccgggggtaaccgtaaaccgggtacgggttaaccgtaaaccggttaaaccgtaaaaccggttaacgggtttaaccggtacgggttaaccggttaccgtaaccctaacccggttacgttacccgttacggtttaccctttaacccg

SEQ ID NO: 111070 - DNA, 774 bp, Homo sapiens
  misc_feature: GYAE6OF02HX3RA.35.6.A06.1.454.CMB.1.raw
  modified_base (192)..(192): a, c, t, g, unknown or other
  misc_feature (192)..(192): n is a, c, g, or t
tcagtacagatcgtcacgaccggtgctcgatttagatctactgacagggggagtcagtctcagtcaggacacagcatggacatgagggtccccgctcagctccgtggggctcctgctactctggctccgaggtgccagatgtgacatccagatcgacccagtctccatcctccctgtctgcatctgtagganacagcgtcaccatcacgttcggccgggacaagtcgagacgctagttggactagtttaactttaaagttggtaactacgaaacggtaaaccgaagggaaaccgtaccccttaaacgtcctagtattactagtcgctcgactacttccttagttttacgaacgtaaggttcggggtcccgtagtaacggtttacgaggtcggacctaggtggtaacgtcggtaaggaacgtaacgtaactttaccgaacgttcctaccgtaactaactaccgtaagtaccgtaacgtccgttacgaaccgttaaaccgtaggttaaacgttaacgttttaccggaacctttaaacccgttagtttaacgttccgtaaaccgtaaaccggttaagttaaaccgttaacgtaaccgggttaacccggtaaccccgtacgttaaccgttaccgtaaccggtccgttaacccgggaaccggtaaacgggtaaccgaaccgggttaacggttaacgggtaaacgttaaaaacgttaaaaaccggtacggttcggtaacgggttaccgtaacggtaaccccttaccgtaacgttttaccg

SEQ ID NO: 111071 - DNA, 681 bp, Homo sapiens
  misc_feature: GYAE6OF02IZHUN.35.6.A06.1.454.CMB.1.raw
  modified_base (199)..(199): a, c, t, g, unknown or other
  misc_feature (199)..(199): n is a, c, g, or t
tcagtacagatcgtcacgaccggtgctcgatttagatctactgacagggggagtcagtctcagtcaggacacagcatggacatgagggtccccgctcagctccgtggggctcctgctactctggctcgaggtgccagatgtgacatccagatcgacccagtctccatccctccctgtctgctatcgtagtacggagacngctcaccatcactcggaccgggacaacgtcaggagtacagttcggactagtttactttaaagttggtaactaacgaaaccggaaaccgaagggaaaccgtaccccctaaaactccgtagtacttacttatcgactgacctacgtcctattttcgaacgtaacggtccggggtacccggtagtaacggttctaggcggacgtaggttcggacgttcggtacggaacaagttactaccgtactcctaccacgtactaaccacgtcctagtccttaccgaaccgtaaccgttaggtaaacgttgttttaacccgaaccttaaacccttacgtttatttaaccgtaaaccaaaggttacgttaacgttaacgtccggaacccgtcggtaacctaggtaccgtacgtacccgttaggaacccagggtaccgacgtaacggtggaataaacgtaagtacgtagggtacgctacgaccctacgtacttc

SEQ ID NO: 111072 - DNA, 614 bp, Homo sapiens
  misc_feature: GYAE6OF02GJ8I8.35.6.A06.1.454.CMB.1.raw
  modified_base (586)..(586): a, c, t, g, unknown or other
  misc_feature (586)..(586): n is a, c, g, or t
  modified_base (610)..(610): a, c, t, g, unknown or other
  misc_feature (610)..(610): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgccatctgtaggagacagcgtcaccatcactgccgggcaagtcagagctagttggctagtttactttaaagttggtaactacgaaacggaaaccgaagggaaacgtacccctaaactcctgactctatcgctgctactacctattttacgacgtaaacggtcggggtacccgagtaacggttcaggtcggctaggtggtacgtcgtagggaactaagtacttcgactacctacaacctatacgacgtacgtacgtctagtacctaaccgttaggaacgttacgtttacgaacctaacctttacgtacttacgtactaaacgtagtaacgttacgtaacgtaccgccgacgtactccgtacgtccgtaccggaaccgaggaccgacgtacgtaggaactaagttaaacgngtacgtcggcgtacgactaccgtntacg

SEQ ID NO: 111073 - DNA, 741 bp, Homo sapiens
  misc_feature: GYAE6OF02G5D74.35.6.A06.1.454.CMB.1.raw
  modified_base (309)..(309): a, c, t, g, unknown or other
  misc_feature (309)..(309): n is a, c, g, or t
  modified_base (444)..(444): a, c, t, g, unknown or other
  misc_feature (444)..(444): n is a, c, g, or t
tcagtacagatcgtcacgaccggtgctcgatttagatctactgacaggggtctgagagaggagcccagccctgggattttcaggtgttttcatttggtgatcaggactgaacagagagaactcaccatggagtttgggctgaggtggctttttcttgtggctattttaaaaggtgtccaatgtgaagtgcacctgttggagtcgtgggggaggcttggtacagggcgggggggtccctgagactctcctgtgcagcctcgtggacttccacctttagactaactatgccagtgagtcgtcggggtcccnccgaggccgtccggagggggacggggcgtgggcggttcggggtcctacaacgttagttagtgtcgtaggtcgggtaggtaataggacgtaacgtacgacagtaccttcgtacgtacgggaacgggtcccggttanacttctactccgtaccgaacgggaactaaacgttacccgaaaggacgtaccgaccgggttacgtaacccgttggaaacctaaaagttcggaaaccgtacgggtacccggtagggggaaccgaacgggtaaccgggaccgtaacccggggtacccggtttaagttaccgtttaaccgtcggttaccgacggtaacccgtgttccgtacgggtaccgggtaacggggttctacccgtttaacgtagtaaccgtaacgttaaggtttaacgggtttcgggttttaccggacccgttaacg

SEQ ID NO: 111074 - DNA, 742 bp, Homo sapiens
  misc_feature: GYAE6OF02HTCA6.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatcgacccagtctccactccctccctgtctgcatcgtgtaaggagacagcgtacacctatcacgttcggccggacaagtacaagacgctagttggctagtttaacttttaaagttggtaactacgaaacggaaacgaacgggaaacctacccctaaactcctagactctatgctcgactacttccttagtttacgacgtaaacggggtcggggtacccggacgtaacgggttcgaggtacggactaggtagtacgtcggtacgggaactaagttaacttccgtaccgttaccctaccgtaacctactaccgaacgtccgtagtacccgtacgtaaaccgtaaccgtaagtaaacgtttacgtttacgaaacccgttaaccttacgtttacgttacgtaaccgtaaacgtaacgttaacgtttaaccgaaccggtacccgtacccgtaacgtaccgttacgaacgttccgggttaacccgggaaccggtacgggtaacctaacgggtaaccggttaaggtaaaaccggttaaacgtttaaaaccggtacggttacggttaccggacgtaccgtaaccgtaccctagtttcccg

SEQ ID NO: 111075 - DNA, 528 bp, Homo sapiens
  misc_feature: GYAE6OF02GFKVV.35.6.A06.1.454.CMB.1.raw
  modified_base (192)..(192): a, c, t, g, unknown or other
  misc_feature (192)..(192): n is a, c, g, or t
  modified_base (249)..(249): a, c, t, g, unknown or other
  misc_feature (249)..(249): n is a, c, g, or t
  modified_base (502)..(502): a, c, t, g, unknown or other
  misc_feature (502)..(502): n is a, c, g, or t
  modified_base (513)..(513): a, c, t, g, unknown or other
  misc_feature (513)..(513): n is a, c, g, or t
  modified_base (520)..(520): a, c, t, g, unknown or other
  misc_feature (520)..(520): n is a, c, g, or t
  modified_base (522)..(528): a, c, t, g, unknown or other
  misc_feature (522)..(528): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggcaagtcagagcattggcagtttctttaaattggtatcaaacggaaaccagggaaancccctaaactcctgatctatgctgcatcctattttgactaaaggtcggggtcccggntaaggttcattggcaggtggatcgtgggacagaattcactctcaccatcagcagtctgcaacctgaaagtattttgacctaaaccttacttattcgtacaaacagtaagtttaacacgttaccgcccgacgactcagtccgttcggaccaagggacacgacgtggaagtaaagtaaaagaacgtagtggctgacacatcgttctcttcacttcctcccgctactctacgaactcttctgtactgacgcggtcncggcgaaggcnaagtcgncnnnnnnn

SEQ ID NO: 111076 - DNA, 604 bp, Homo sapiens
  misc_feature: GYAE6OF02IGFRM.35.6.A06.1.454.CMB.1.raw
  modified_base (307)..(307): a, c, t, g, unknown or other
  misc_feature (307)..(307): n is a, c, g, or t
  modified_base (592)..(592): a, c, t, g, unknown or other
  misc_feature (592)..(592): n is a, c, g, or t
  modified_base (595)..(595): a, c, t, g, unknown or other
  misc_feature (595)..(595): n is a, c, g, or t
  modified_base (599)..(604): a, c, t, g, unknown or other
  misc_feature (599)..(604): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcacttgccgggcaaggtcagagcattggcagttctttaaattggtatcaacggaaaccagggaaagcccctaaaactcctagatctatgactgcactcctattttagcaaaggtggggtcccgacaaggttcagttggacaggtggtatcgtggggaacacgacttcgaactctactaaccntacaaccgacgtcctacgcagccctagatgtattttcgactaacctattacgcgtaccaactagtatggatacttcgtctaacgtttccggaccgttcggaaccgtaaagtcggtaacgtactaacgaaacgtaactcggtacggtctacggacactatccgttgttcctacgtactccgtttaccgaccctagttacctcggaaaccgttactaccgttacgtaacgttacgggaacggtccgggtacgacgggaccgaacggtacggcgtaacgtacgcgtanacncgcnnnnnn

SEQ ID NO: 111077 - DNA, 764 bp, Homo sapiens
  misc_feature: GYAE6OF02F88DA.35.6.A06.1.454.CMB.1.raw
  modified_base (527)..(527): a, c, t, g, unknown or other
  misc_feature (527)..(527): n is a, c, g, or t
tcagtacagatcgtcacgaccggtgctcgatttagatctactgacaggggtctgagagaggagcccagccctgggattttcaggtgtttcatttggtgatcaggactgaacagagagaactcaccatggagtttgggctgaggtggtctttttcttgtggtcttaattttaaaaggtgtaccaatgtagaagtgcacctgttggagtcgtgggggaggcgttggtacgagggccgggggggtccctaggacgacctcctccgtgtcgcacgtcccttcgtggtacttacctaaccttttagacctaaacttactcggaccctagttcggaacgcgttacggggtccccgccgaacgggtcccgtacccgggaaggggggtacggggtccgtcggggtccgggttcggggttacctaccgtaaacgttagtttaacggtcgtaccgtacgggtccgggttaggtaaagttaaggacgtaccgtaacggactaagtacctcgtacgtagggaaacggggtcccgtttanacttactacgtccgtaccgtaggaacctaacgttaccgaagtacgacgtacggtcgtacctagtaacaagtacgaacgacgtaccgtgggaacgaccggaaggaccgtaaccggtaccgttaattaacgttacgtaggtacgacgtactagtaccgtggtacgggtaggttaccgtaccctttaacgtagtacggtaacgttaagttacgggtttcggttttaccggacccttaacg

SEQ ID NO: 111078 - DNA, 825 bp, Homo sapiens
  misc_feature: GYAE6OF02FZS5D.35.6.A06.1.454.CMB.1.raw
tcagtacagatcgtcacgaccggtgctcgatttagatctactgacagggggagtcagtctcagtcaggacacagcatggacatgaggtcccgctcagctctgggctctgctactctggctcgaggtgccagatgtgacatacgaaatcgaccagtctccttccaccctgtactgctatcgtgtacggagacacgtcgtcaagtcaatcacttgcctaggcctagtaccgaagtacgtaagttggtacgtacgtggttggtaccctgggtaacttccgaaggtaccgtaaacggaaaacccgtaacggtaaaccctaaaaaacccccgttaaacgttccgtaagttaacgttttaaacgaaccggttaacccgttactttaaacggttttaaccgaaaaggttccgggggtaaccccttaggaccgggttaaaacggttccggggaaccgtacgtagggttacggtacgttacggtacggggaacctagttaccgttaccgtaacgtttccaccaaccgtagtacccgtaaccggtaacctaaaccggtcgtaacgtaccgtcccgttaggttaacggtaccgtttcggaacctttaaccgttaactttaccgaaccgttaccaaaccgggttaatttaaacgtaaccgttaaaccgtttaccctaaaccgttttaccgtttaccggggacggtaacggttaaccgaaaggttaaccggaaacctaacggaaacccgttagcggttacgggtaccaacgtaccgtaaacgtaccgttcgttacgttaccttaacggttacctccccgttaccggacccttaaccgg

SEQ ID NO: 111079 - DNA, 794 bp, Homo sapiens
  misc_feature: GYAE6OF02I2OHZ.35.6.A06.1.454.CMB.1.raw
  modified_base (316)..(316): a, c, t, g, unknown or other
  misc_feature (316)..(316): n is a, c, g, or t
tcagtacagatcgtcacgaccggtgctcgatttagatctactgacaggggagtcagtctcagtcaggacacagcatggacatgagggtccccgctcagctcctgggcctcctgctactctggctccgaggtgccagatgtgacatccagatgacccagtctccatccctccctgtctgctatctgtaggacgactagccgtacacctatacaccgttggcccggggtcaagtccagagctacttggacctagttctttaaagttggtattaccaaacgggaaaccaagggaaaacgcccccgttaaaactccgtanactacttatcgcttacgcttaccgtccttaattttagaccgtaaaacgggttcggggggttacccccgtagtaaacggggtttcccgtaaggtacgggtactagggttacggtaagttccgtacgggggtaactaaggtaaactttccaaccgttttccaccgtaaccctacgttaccaacggtccctaggtaccctacggttaccgaaaccgttaggtaaacgttaacttttacggaacctttaaacccgttacgttaatttaccgggtactaaaaccgggtaagtaaaccggttttaccgaaaggttacccccgtaccggaaccgttaacgtacccgtaccgttacccggttaccgggaaccccgtaaccggggtacgtaaccgggtaacccggttagggtaaacgttaaagtttaaaaccggtacgttagggttaccggtacccgtaggttaacccccgacttaaccggttcccg

SEQ ID NO: 111080 - DNA, 715 bp, Homo sapiens
  misc_feature: GYAE6OF02HWISI.35.6.A06.1.454.CMB.1.raw
  modified_base (192)..(192): a, c, t, g, unknown or other
  misc_feature (192)..(192): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatcgacccagtctccggcctccctgtctggtgctggtcgganacagactgaccatcacgttcggccgggacaacgtcagtaccgttgcgttacttaatttaaattggtatcagtcgaagaaaccgagggaaccgcccctcgaagtcctgactcgcttactattacttcgtacttacttacgttttacccaagtttccgttcggggttaccccagttaccgtaaaggttcgaggttcgacgtaggttcggtttacgtagggactagtactttctaacgttctacaacttactacgagtcgtaagttctacgacctaaccgttaaggaacgttacgttacggttacgtaaccgttaaaccgtttaaccttaaccgttacggttaaccaaacgttaaccgttaaaccgtttaaccgggaacccgggtaccccttaacgtttaccgttacccgttttacccgggacccgttaccgggtaaccctaaccggtaacgttaccggtaaacttcccggtaacgacgtaacgtcggtacggccgttcgaacctacctacgttaccttgttaccc

SEQ ID NO: 111081 - DNA, 568 bp, Homo sapiens
  misc_feature: GYAE6OF02HMOUJ.35.6.A06.1.454.CMB.1.raw
  modified_base (218)..(218): a, c, t, g, unknown or other
  misc_feature (218)..(218): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtcctccatcctccctgtctgcatctgtaggagacagcgtacaccatcacttgccggganaagtcagagctagttggctagttactttaaattggtatacgaaacggtaaaccaagggaaacgacccctaaactcctagatctaatgctgcatctatttgacgaaaggtcggggtaccgataaggttcagtgcgagtggaatcgtaggacagtaatcactctacaccatcagctagtctagaccaacgtagaacgttatttcgaacctaactaacgttattacgtactaacgtagtacgttaacacgtaccgacccgagtactcgacgtcgttaccggaccgaaggaccacggtaacgtacggtaagtaaacttaaaggaacgtggtacgactacgacctacctgtaccg

SEQ ID NO: 111082 - DNA, 515 bp, Homo sapiens
  misc_feature: GYAE6OF02HEHH4.35.6.A06.1.454.CMB.1.raw
  modified_base (210)..(210): a, c, t, g, unknown or other
  misc_feature (210)..(210): n is a, c, g, or t
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (480)..(487): a, c, t, g, unknown or other
  misc_feature (480)..(487): n is a, c, g, or t
  modified_base (489)..(505): a, c, t, g, unknown or other
  misc_feature (489)..(505): n is a, c, g, or t
  modified_base (507)..(507): a, c, t, g, unknown or other
  misc_feature (507)..(507): n is a, c, g, or t
  modified_base (509)..(515): a, c, t, g, unknown or other
  misc_feature (509)..(515): n is a, c, g, or t
tcagtacagatcgtcacgaccggtgctcgatttagatctactgacagggggtccgggagatcatgagggtgtccttggggttttgggggggaagagggaagactgacggtcccccaggacgttcaggtgctgggcacggtgtacctgcaaatgaacagcctgggagacgaggacacggccgtatattactgtgcgacatctgcgagggtnccttactatgacaatagtggttttggccacatctactacttgaggactgggccagggaacctggtcgccgttctcctcagcctccaccaaggcccatcggtcttccccctggccacccctcctccaacgtacgcacctcgtcgggggtcacagcggcccgtcgggctcgcctggtcgaaaggcctacttccgaacgtactcgtcgtactggaacggccgggcgtcggacgaagggtccgacgtaagtacggacncancgancncgcatgnnnnnnnncnnnnnnnnnnnnnnnnngngnnnnnnn

SEQ ID NO: 111083 - DNA, 682 bp, Homo sapiens
  misc_feature: GYAE6OF02JFXEG.35.6.A06.1.454.CMB.1.raw
  modified_base (95)..(95): a, c, t, g, unknown or other
  misc_feature (95)..(95): n is a, c, g, or t
  modified_base (220)..(220): a, c, t, g, unknown or other
  misc_feature (220)..(220): n is a, c, g, or t
tcagtacagatcgtcacgaccggtgctcgatttagatctactgacagggggagtcagtctcagtcaggacacagcatggacatgagggtccccgntcagctcctgggctcctgctactctggctcgaggtgccagatgtgacattcagatgacccagtcctccatccgtcctgtctgcatctgtaggagacagagtccaccgtctacgttcggccggganaagtccaggacgactaattaaacgaaagttaaatttaaagttggtatacgagacaagaaaccgtagggtaaacgtccgtacgtctcctacactctagtgacctgtaccttcctacgtttacgacgtaaggtcgttacgggtcctagtacgtaacggttcgaacggagacgtacgtaggtacttcggtaagggtactaacggtaacgtttccgctttaccgacctaccgtaatacgacgtcgtacgtctacgtacgtaaccgtagtaagttatttacgaacttacgttaactacgttacgtaacaaacgttaggtaacgtttaacgaggttccggttacttaccgtttaaccgggtttcgggaaccgggtaacgggttacccgtaagggtccgtaaacgtaacgtaaccgtaaacggttacgttagggaccgtacgtccggaactaccgtacgttcgttaccg

SEQ ID NO: 111084 - DNA, 603 bp, Homo sapiens
  misc_feature: GYAE6OF02HMJY3.35.6.A06.1.454.CMB.1.raw
  modified_base (216)..(216): a, c, t, g, unknown or other
  misc_feature (216)..(216): n is a, c, g, or t
  modified_base (294)..(294): a, c, t, g, unknown or other
  misc_feature (294)..(294): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacgttgccgggnaagtcagagcattggctagtttctttaaattggtatcgaaacggaaaccaagggaaacgccctaaactcctgatctangctgcatcctatttcgactaaaggtcggggtaccggacgtaaggttcaggtggcaggtggatcgtagggaacaggtaacttcgaactctacgaccatactagcacgtctgactaaaccgtagaacgtagtttactaccgtaacctacgttaacttagttaccaaactacgtaagttaacgtacgtaaccggtcccgaccgtatcgtacgtaccgttaccggacccgaacgggacgtaaccggaacgttacgggaataaacgttaaaaacgtaacgttaggtacggtacgtacgaccgtaccgtataccg

SEQ ID NO: 111085 - DNA, 736 bp, Homo sapiens
  misc_feature: GYAE6OF02GNJYS.35.6.A06.1.454.CMB.1.raw
tcagtacagatcgtcacgaccggtgctcgatttagatctactgacaggggtctgagagaggagcccagccctgggattttcaggtgtttcatttggtgatcaggactgaacagagagaactcaccatggagttgggctgaggtggtctttttcttgtggtctaagttttaaaggtgtccaatgtgaagtgcactgttgagtcgtggggaggtcgttggtacgagggccggggggtcctggacgacttctctgtgcgacgcctcgtggacttcctacctttagctaaacgtatcgcctagtggacgtcggtcgggtccccgcgacggccctccggggaagggggagggtccgtgggtcggttcggggttacctacgtaaacttagtttcggtgtaccgttaggcgggttaaggtaagtacggacgtaacctacgacgtaaggtacctcgttacgtaacggggtaaacggggttcccgttagaccgtacgaccgttacccgtacggtaacgggtaaacctaaccgttaccgaaaacgggtaccgtaacggtaccgggttaaccgtaccgaacggtaactaaaacggtcgaaaccgacgtccgggtaaaggggactaaacgggacgaccgtaacggtaccgttattacgtagtcggtcgaccgtagtgtgcgggacggtacgggtcctaacgtttacgagtacgttaacgtagtttacggttcggttacgaccttaacg

SEQ ID NO: 111086 - DNA, 620 bp, Homo sapiens
  misc_feature: GYAE6OF02GZ0CM.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtctcatcctcctgtctgcatctagtaggagaccagcgtcaccatcactgccggacaagtcagcgcatggctagttactttaaatggtactacgaaacggaaaccgaggaaacgcccctaaagtcctagactactatcgactcgacactccttatttcgataaacgggtcggggtcccgacgtaacggttcagtcggacgtgtaggtactcgtagggaacagtaactacctaccgttctaccgtaccatcgacgcacgtctagacctaaacgtgtaaagttactttacgaaacctaccttacttacgttacgacctaaacgaagttaacgttaaccgtacgtaccggcccgtacgtacttacgacgtccgttaacgaccgggtaacggacgtaaccgtaacggtaggaaaacgttaagtaaaaccggacgttaggacggactacggacctaccgtaacttcg

SEQ ID NO: 111087 - DNA, 732 bp, Homo sapiens
  misc_feature: GYAE6OF02GG5Z8.35.6.A06.1.454.CMB.1.raw
tcagtacagatcgtcacgaccggtgctcgatttagatctactgacaggggggtagggtacagtcttcagtcaggacacagccatggacatagagggtccccgctcagctcctggggcctccctgctactctggctccgaggtgccagatgtgacatccagatgacccagtctccatccctccctgtctgctatctgtaggagacagcgtcaccatctacttcggcccggtacaagtcagagactagttggcgtagtttactttaaagttcggtaactaccgaaaccgggaaaccgaacgggaaaccgtaccccctaaacgtccgtagtactctaagtcgactgtactactccgttatttacggaacgtaacgggtccggggtacccgtacgtaacggttcgaggtcggacgtagtcggtactacggtacgggaactaaggtaccttaccgtacctaccgtacctaacctactacgacgtaccgtagttccgtacgaaccgtaaccgtaggtaacgttacgtttaccgaacccttaaacctttacgttactttacgaactaaacggtaggttaaaccgttaaccggtacgtaacccggtccgtagtaacctcgtacggtccgttaaccggaccgaacgggtaccaccggtaacggtaagggtaaacttaaacggtttaaaacgtacggttagggttaccggtacggtaccggacccgtaacccgtgttacccg

SEQ ID NO: 111088 - DNA, 716 bp, Homo sapiens
  misc_feature: GYAE6OF02FW6KY.35.6.A06.1.454.CMB.1.raw
tcagtacagatcgtcacgaccggtgctcgatttagatctactgacagggaggatggagactgggacatccagatgacccagtctccatcctccctgtctgcatctgtaggagacagcgtcaccatcacttgccgggcaagtcagagcattggctagttctttaaattggtatcgaacggaaaccagggaaacgcccctaaactcctagaactctatgcgtagcatcctattttacgacgtaaaggttcggggtacccggacgtaaggttccaggttcggacaggtagggaacttcgtacggggactaagtaacttcgaacttcctacaacctaatccgaagtcgtaagttccgtacgaccgtaaaccgtgtaaagttacttttacggaccttaaaccttactaattacgtacaaagacggtaacgttaacgaacggtacccgaccgtacgtaactccgtaagtaccgttaccgggtaaccgaaacggggtacctacggtaacgtaggaagtaaacgttaaaaggacgttaggtacggtactacggacctaaccgtagttccgttagttaccgttactaccgtttacccgtccccgaacgttacgtcctaacgggtaacctacgttcgttaacgtacgttcgggaacgtccgggggtacgtacggaccgaacgggtccaacggtaagttacggactcgaccgtatcggctagcgaac

SEQ ID NO: 111089 - DNA, 439 bp, Homo sapiens
  misc_feature: GYAE6OF02F27O0.35.6.A06.1.454.CMB.1.raw
  modified_base (414)..(414): a, c, t, g, unknown or other
  misc_feature (414)..(414): n is a, c, g, or t
  modified_base (420)..(439): a, c, t, g, unknown or other
  misc_feature (420)..(439): n is a, c, g, or t
tcagtacagatcgtcacgaccggtgctcgatttagatctactgacaggggtccgggagatcatgagggtgtccttgggttttggggggaagaggaagactgacggtccccccaggagttcaggtgctgggcacggtgtacctgcaaatgaacagcctgggagacgaggacacggccgtatattactgtgcgacatctgcgagggtgccttactatgacaatagtggttttggccacatctactactttgaggactggggccaggggaacccctggtccgccgtctcctcagcctccaccaagggcccatcgtctccccctggcaccctcctccaagacgcacctctgggggcacagcgcctggctgcctggtcaaggctactccacgatctgtactgagcgggctggcaaggcncatagnnnnnnnnnnnnnnnnnnnn

SEQ ID NO: 111090 - DNA, 764 bp, Homo sapiens
  misc_feature: GYAE6OF02I9TWW.35.6.A06.1.454.CMB.1.raw
  modified_base (332)..(332): a, c, t, g, unknown or other
  misc_feature (332)..(332): n is a, c, g, or t
  modified_base (629)..(629): a, c, t, g, unknown or other
  misc_feature (629)..(629): n is a, c, g, or t
tcagtacagatcgtcacgaccggtgctcgatttagatctactgacaggggtctgagagaggagcccagccctgggattttcaggttgttttcatttggtgatcaggactgaacagagagaactcaccatgggagtttgggctgaggtggtctttttcttgtggcttattttaaaggtgtaccaatgtgagtgcactgttggagtcgtgggggaggcgttggtacgagggccgggggggttcctggaggacctcgttcctggtcgaccacgccttcgtggtacttcctaccgttttagaccaacttagtgccagtgacgtcgtcgggtacccncgacggccgtccgggagggggtcggggcgttcgggcggtgggtctcgtaaacgttagttacggtgtcgtaggtcggttaggtaaacgtaggagtaccgtacgacgacgtactcgtcgtacggtaacgggtcccgttagacttcgattccgtaccgagggaactaacttacgaaagacgtacggtaacggtccgtaaccgtacgaacgtaaagtaacgaacgtaccggaccggtaaggggaacgaaccgggaacgtaaccgggtaaccgggtcccgttaaagttacggttttaaccgnggttaccgaccggtaacttacggttacgtacggggacgggttaccgggttaccggttaacccgtttaacggttacgttaacggtaacggttaaaggtttgggtttaccggtttttacgggaccctttaaacccgg

SEQ ID NO: 111091 - DNA, 912 bp, Homo sapiens
  misc_feature: GYAE6OF02IWQ07.35.6.A06.1.454.CMB.1.raw
tcagtacagatcgtcacgaccggtgctcgatttagatctactgacaggggtctgagagaggagcccagccctgggattttcaggtgttttcatttggtgatcaggactgaacagagagaactcaccatggagtttgggctgaggtggtctttttcttgtggcttaattttaaaaggtgtccagtgtgaggtgcagctggttggagtcgtgggggaggtcttggcacacggtccggtcggggggttcccctggagtaccgtccgtccgttggtcgctacgtccctcgttacggttactttccgtaacccgttttacggaccctaacccgttagttcggtacctagttaggaacggtccgttccgggggtccccgccccggggtaccggtacccgggtaacggggggaaacggggtccgttacggggtacggttcggggttaccgttaaccgaaacgtttacgttggtaagttgggttaacgtcggtactacctaaacgtaaactaaccgtaagtacggttaacccgacgtacggttaccgtacccgggttacggggtaccggggtaccccgtttcgaacccttaacttacccggtaacgaaacggtccgtaaaacttaccgttaaaccggtaacggaaacccgtaccggtacgttaacgtaacccttaacggtaaactaaacgtacgggtaactacggttaaccgttagggaacggtaaccgggtaccggtaaaccgggaacccgttaaaccgggttacccgtttaaagttttaaccgttaaacccggtttgggttaaacgttaaaccccgggttaaaaggtttacccggtaaaaccggtggtttccgggtaacgttccggggtaaacgttaaccgggtacggggttaccggtaacgttacggttaaacccgg

SEQ ID NO: 111092 - DNA, 781 bp, Homo sapiens
  misc_feature: GYAE6OF02HQ0WT.35.6.A06.1.454.CMB.1.raw
  modified_base (329)..(329): a, c, t, g, unknown or other
  misc_feature (329)..(329): n is a, c, g, or t
  modified_base (557)..(557): a, c, t, g, unknown or other
  misc_feature (557)..(557): n is a, c, g, or t
  modified_base (737)..(737): a, c, t, g, unknown or other
  misc_feature (737)..(737): n is a, c, g, or t
tcagtacagatcgtcacgaccggtgctcgatttagatctactgacaggggtctgagagaggagcccagccctgggtatttcgaggtgtttctagtttggtgatcaggactgaacagagagaactcacatggtagttggctggacggtggtcttttctgtggtcttaagtttaaaggtgtacctaatgtagaagtcgctaccttggttaggagtcggtagggggtagtcgttacgggtaacgcggggtccggggggtaccctggacgtaccgtctccgttgcgcgtacgtccctgtacgtaacgttctaaccgttaacgctaaacttacncgtacctagtacgtagtcggtcgggtcccaccggtacggtaccgtccgggtaaggggggcgggtccgtacgggtccggttacgggtacctaacccgttaaaccgttaagtaccgggttccggtcgttaaaccggggttcgggttaaacggttaaacggaggtaaaccggtaaccgtaacggctaacggtacccttcgtacggtaacggggtaaacggtcccggtttanacgttcccgtaacgtccgttaaccgacggtaaactaaaccgttacgaaacgtcggacgtaccggtacggtacctagaactaaacggtacgaaacgtcgtacggaggtacgaggacggaccgacgtagttaactatcgtacgcggtacagtacgtgtacggtacggacgggtctaaccgtntaacgtacgaacgttaggtaggtttcggttaccgtaaccgtacg

SEQ ID NO: 111093 - DNA, 686 bp, Homo sapiens
  misc_feature: GYAE6OF02GK2VD.35.6.A06.1.454.CMB.1.raw
  modified_base (444)..(444): a, c, t, g, unknown or other
  misc_feature (444)..(444): n is a, c, g, or t
tcagtacagatcgtcacgaccggtgctcgatttagatctactgacaggggtctgagagaggagcccagccctgggattttcaggtgttttcatttggtgatcaggactgaacagagagaactcaccatggagtttgggctgaggtggctttttcttgtggctattttaaaggtgtccaatgtgaagtgcacctgttggagtcgtgggggagcgttggtacgagggccgggggggtccctggagtactcgtcctgtgcacgcctcgtggacttctacctttagacctaactatgccagttgacgcgtcgggtcccgcgacggtcctcggagggggcgggcgtgggcggtcgggtctacgtaacttagttaggtcgacgtacggtcggtaggttaactaggagtaaccgtacggcacgtacttctcgtaggaacgggtcccgttanacttacgacttaccgacggtagggaacctaagttccgaaagtcgacgtacggtactaccgacgaacaagtacgaacgtacgtccggtagggaacgacgggaacggaccgtaaccgggtcgtaacgttaacgttacgtaggttacgtacgtacgtcgttacgtacggtcggtagggttaccgtaccttaagttaacgtacggtaaaccttaaaggttggtttacgggtttaccgaccttaacg

SEQ ID NO: 111094 - DNA, 875 bp, Homo sapiens
  misc_feature: GYAE6OF02IB8CH.35.6.A06.1.454.CMB.1.raw
tcagtacagatcgtcacgaccggtgctcgatttagatctactgacaggggtctgagagaggagcccagccctgggattttcaggtgttttcatttggtgatcaggactgaacagagagaactcaccatggagtttgggctgaggtggtctttttcttgtggcttattttaaaaggtgtcaatgtgaagtgcactgttggagtcgtgggggaggcttggtacgaggccgggggggtccctggagacctctctgtcgcagcctgtcggattcctacctttagactaactatcgccatgagcgtgggtcccgccgtaggccctaccggaggggggacggggcgtggggtcggttacggggtccttaccgaaaccgtttagttaggttcgtacgtagggaccgggttaggttaaaacgttaggaacggtaaaccttaaccggacctaacggtaccgttcccttacggttaacggggaaaccgggggttaccccggggtttactaaacgtttacccgtaaccgtttccgtaaccccgggtaagggggtaaacccttaaacgtttacccgaaaagggtacggtacccgtaaacggggttaccggtttaaacccgttacggtaaaccgtaaaagtaccggtaaaaccggtacgggtacccggtaagggggaacgggtaaacccggtaacggggaacccgtaaacccggggtaccgtttaaagtttaacgtttaaccgttgggttaccgttaagacccgttagttaccggttacgggcccgggttaacggggttaccgttacccgttttaaacgttacggttacggtaaaccgttaagggttttaacgggtttttcgggttttaaccgggacccttaaaccgg

SEQ ID NO: 111095 - DNA, 534 bp, Homo sapiens
  misc_feature: GYAE6OF02GX0G9.35.6.A06.1.454.CMB.1.raw
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
  modified_base (500)..(534): a, c, t, g, unknown or other
  misc_feature (500)..(534): n is a, c, g, or t
tcagtacagatcgtcacgaccggtgctcgatttagatctactgacagggggtccgggagatcatgagggtgtccttggggttttgggggggaagaggaagactgacggtccccccaggagttcaggtgctgggcacggtgtacctgcaaatgaacagcctgggagacgaggacacggccgtatattactgtgcgacatctgcgagggtgccttactatgacaataggttggtttggccacatctacttacttgaggacgtgggcagggacctggccgccgtctcctcgacgcctccaaccgaacggcccctagttccggttcccttcccccgtcgggaccctaccccctccgtaccaacggacgtcctaccgtcggtcgggggacaccgacggccggccgtcgggctcgccgtgggacaagtacctacttaccgacgtactcgtagtacgtggaggccggtcgtgggacaacgggcgacagtgngnacgcagntcnacgnnnnnnnnnnnnnnnnnnnnnnnnnnnnnnnnnnn

SEQ ID NO: 111096 - DNA, 738 bp, Homo sapiens
  misc_feature: GYAE6OF02IUQG3.35.6.A06.1.454.CMB.1.raw
tcagtacagatcgtcacgaccggtgctcgatttagatctactgacagggggagtcagtctcagtcaggacacagcatggacatgagggtccccgctcagctcctggggctcctgctactctggctccggaggtgccagatgtgacatccagatgaccctagtctccactcctccctgtctagctatcgtggtgggagacagagtccaacatcacttgaccgtaggctagtacacgactaacttaacgtacctttaatttaaacgttaggttaactaacgtaaactaaagtaaaacgtacgaacgggaacctaaaacggtacccccttaaaaccgtccttagtaacttacgtaacgtatacgactaacttacctaaacgtttaacggaaaccggtaacgggtacctaaacgtcggtaactaaagttgtaacggttagggaagttacggtaatacgggtaacgggtactaagtttaacgttttacctttactaaacctacgttacgagtaacgtacgtcctacggactacggtacgtaagtaacgtattaacgtacgtactaaacttaacgtttaactaactaacgtaacctaaactaagttaacgtaataagtaccggtttaacgtaacgtacccttagtaacgttaacgtttcgttaaggtaccgggtaaacggtacgttaaagggacggttacgtaagttaccgaacgtaaccgtaggttacggttacgacgtaccg

SEQ ID NO: 111097 - DNA, 672 bp, Homo sapiens
  misc_feature: GYAE6OF02GPHTQ.35.6.A06.1.454.CMB.1.raw
  modified_base (487)..(487): a, c, t, g, unknown or other
  misc_feature (487)..(487): n is a, c, g, or t
tcagtacagatcgtcacgaccggtgctcgatttagatctactgacagggggagtcagtctcagtcaggacacagcatggacatgagggtccccgctcagctccgtggggctcctgctactctggctccgaggtgccagatgtgacatccagatcgacccagtcctccatccctccctgtctgcatcgtgtaggagacacgcgtcaaccatctacgttcggcccgggacaaacggtcgaagagcctagtttggactagtttacgtttaaagttggtaactaccgaaaccggaaaccaacggggaaacgtaccccctaaactcctagatacctagtgcctgtacacgttactatttacgacgtaaagggtccggggtacccggagtaacggttcgaggtggacgtaggtaggtacgtcggtacgggaactaagtacgttccgacgtcaccactacgtccacgactagtctacgtacacgttagaacgtntttaccgactaaccgtttactgttaccgtaacaaacgtagttaccggttaacgaccgtacccgccgactaaccgtcgaccgtccgtaccggaccgacggtaaccaacgggtacgtaacggaagttaaaacgttaaacggtaccggttaggtaccgtacggtcgaaccccgtaacgtgtttacccg

SEQ ID NO: 111098 - DNA, 842 bp, Homo sapiens
  misc_feature: GYAE6OF02H28TW.35.6.A06.1.454.CMB.1.raw
tcagtacagatcgtcacgaccggtgctcgatttagatctactgacagggtctgagagaggagcccagccctgggattttcaggtgttttcatttggtgatcaggactagaacagagagaactcaccagtggagtttgggctggaggtggtctttttcttgtggtcttaattttaaaaggtgttaccaattgtagaagtgctaccgttggttggagttcgtggggggacgtcgttgggtacgaggggtccgggggggtccctggagtaccttccgtcctggtcgctatcccttgtaggtactttcctaaccgtttagaccttaaactagtcgtaccagtggtacggtcgttaccggggtccccgaccgaacgggtcccgttaccgggaaggggggtacggggccgtggggtaccggttgggttccttaacgtaaccgtttaagttcggtaccgtagttacggacgggtttaaaggtaacgtaggaaccgtaaccgttacggctaaacggcctttcgtacggtaacgggaaccgggtttccgtatactactacgtccgtaaacggacgtaacctaaagtaccgaaggacgaccgttacggtcgtaaacccgagtaacctaaaaggtcccgaaacggtcgggtaaacccggtcgggggaaacgtaacccgggaacgggtaacccggtaccgggtaaccctttaagtttaacctccggaggttaccgcgttacttaccggtcgtaacgggtacccggggtacggtttccttaaacccttttaaggacgttaacggtaacgtttaaacggggtttccgggttttacgggtttacccaaccgttaacg

SEQ ID NO: 111099 - DNA, 745 bp, Homo sapiens
  misc_feature: GYAE6OF02GTISV.35.6.A06.1.454.CMB.1.raw
  modified_base (193)..(193): a, c, t, g, unknown or other
  misc_feature (193)..(193): n is a, c, g, or t
tcagtacagatcgtcacgaccggtgctcgatttagatctactgacagggggagtcagtctcagtcaggacacagcatggacatgagggtccccgctcagctcctggggctcctgctactctggctccgaggtgccagatgtgacatccagatgacccagtcctccatccctcctgtctgccatctggtagganacagccgtccaccattccacgttcggccgggacaagtcgagacgctagttggctaagtttactttaaagttcggtaactaccggaaacggaaaaccgaacgggtaaaaccgtaccccttaaaacgtcccgtaagtacttaccgtagtccgtactacgtactaacgttcccttagttttcggaacgtaaacgggttccggggtacccggtacgtaacggttcgaggtcggatacggtgtacgtaggtacggaactagttacttaccgaccttcgtaccctaacctagtaccaggtacctaggttacgtaccgtaccgtaaaccgtagttaaacgttacgtttaccgaccttaaaccgtttagttacgtttaccgtactaaaccgtaacgttaaccgttaaccgaacggttacccgggtaccgtaccggttaatccggtaccgtaccggttacggaaccgaacgggtaaccgtacggtaaacgggtacggtaaacgtaaacgttaaacggttacgtacggtacggtaccgtaacggcccgtaagtaccgttccg

SEQ ID NO: 111100 - DNA, 812 bp, Homo sapiens
  misc_feature: GYAE6OF02HU2YK.35.6.A06.1.454.CMB.1.raw
  modified_base (97)..(97): a, c, t, g, unknown or other
  misc_feature (97)..(97): n is a, c, g, or t
  modified_base (567)..(567): a, c, t, g, unknown or other
  misc_feature (567)..(567): n is a, c, g, or t
tcagtacagatcgtcacgaccggtgctcgatttagatctactgacagggggggagtcagtctcagtcaggacacagcatggacatggagggtccccnctcagctccgtggggcctctgctactcgtggcctccggaggtcgccagatggtagacatccaagactcgaacctagtcctacacctcccgtccctggtcctgctacgtcgtaggtacggacgacacggccgtaccaaccacttccgtaaccggttcgggacccggtaataacggtcgaaggtacgtacgtagttcggaacgttacttttaaccgtttaaaaggtcggttaactaaaccggaaaaccggtaaacggaaaccggtaaaccgtacccctaaacgttcgaagtaccttagtacctcgggtacctcgtaacctacttacctttcggtttaaacgaaccgggttaacgggggtacccgggggttaacccgaaagttaccggggttaacgtacgggtaggtaacgttacgggtataccgggttaaggaacggggaactttaaactacccggttactacccggttacnccgtaaaccctagtaccggaactcgtaaccgttctaacgtacccgtaaagtaccgttaactacgtttaccaaccgtttacttacgttaacttacgtaactacgtaagttaaccgaaccggttacacccggttaaccgacttaccgtaacgtacctcggttaccgaccggaacgacggtaaccggtaggaacgttaaacgtaaacgtaacgtagttcgggaactacgtacacgtaccgtcttccgg

SEQ ID NO: 111101 - DNA, 709 bp, Homo sapiens
  misc_feature: GYAE6OF02G1OZT.35.6.A06.1.454.CMB.1.raw
  modified_base (252)..(252): a, c, t, g, unknown or other
  misc_feature (252)..(252): n is a, c, g, or t
  modified_base (315)..(315): a, c, t, g, unknown or other
  misc_feature (315)..(315): n is a, c, g, or t
  modified_base (464)..(464): a, c, t, g, unknown or other
  misc_feature (464)..(464): n is a, c, g, or t
tcagtacagatcgtcacgaccggtgctcgatttagatctactgacaggggtctgagagaggagcccagccctgggattttcaggtgttttcatttggtgatcaggactgaacagagagaactcaccatggagtttggctgaggtggtcttttctgtgcttatttaaaggtgtccaatgtgaagtgcactgttggagtcgtggggagtcttggtacgacgggcggggggtcctaggacgtctactcctggtcncacgcctgtggacttccgtacttagctaactagtcgacctagtcgagtcggtacgggtacccnccgaggccgtaccgggaagggggtacgggtcgtacgggtcgggttaggtacctactaaacgttagttagtcgaccgtaggagggttacgtaaacgttacggaactacgtacgaactacgtactcgtacggtacggaccggggtcccttnaagttccgacttccgacggtaacggtaactaaacgtaccgaacgtcgtaccgaacggttacgaccgtacgtaactaaacgtacaacgtacgtaccgtacgggaacgacggaaccgtacggaaccgtaccgtaatttacgtacgtcgtaacgtccgtaataccgttagtacgggtaccgggtacgtacgtacccgtttagtaacgtacgtacgaaggttttacggttacgtttaggaccttaacgg

SEQ ID NO: 111102 - DNA, 663 bp, Homo sapiens
  misc_feature: GYAE6OF02F4PLS.35.6.A06.1.454.CMB.1.raw
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (642)..(642): a, c, t, g, unknown or other
  misc_feature (642)..(642): n is a, c, g, or t
tcagtacagatcgtcacgaccggtgctcgatttagatctactgacagggggagtcagtctcagtcaggacacagcatggacatggacgggtccccgctcagctccgtggggcctcctgctactcgtggcctccggaggtgccagatgtgacactccagatcgaccctagtcctccactcccttcccgtgtctgcatcgtagaggacacgagccgacacatctacgtcggccganatcgagnactatggacttagtttacttaagtgtaactaacgaaaacggaacgaacggaacctaccctaactcgtagtactatacgtcgactcgacctacttaccttaggtttacgaccggtaagggttcccgggggaccgtacgtacggttgaggtcggaggtaggtagacgtagacggaataacgttacgtacctacctacgtactacgctaccagtcttagtcgtacaccggtaacttaggtaacgttcgtttaaccaccctttaacgttagtaaccttaacgtaaccaaggttaacgttaacgtaacctcgggtacccgactagtaccaccgtacgccggtacgaaccgtacggacctaggaacggtaaggaaactttaaggtaaaccgtaggttacgggcgtanaaccggacctactacggttcc

SEQ ID NO: 111103 - DNA, 801 bp, Homo sapiens
  misc_feature: GYAE6OF02G254M.35.6.A06.1.454.CMB.1.raw
  modified_base (504)..(504): a, c, t, g, unknown or other
  misc_feature (504)..(504): n is a, c, g, or t
tcagtacagatcgtcacgaccggtgctcgatttagatctactgacaggggtctgagagaggagcccagccctgggattttcaggtgttttcatttggtgatcaggactgaacagagagaactcaccatggagtttgggctgaggtggtcttttctgtggtcttaagtttaaaggtgtccaatgtgaagtgcactggttggagtcgtggggagtcgttggtacgagggtcgggggggtccctagacgtacctctccgtgtcgacgtactccgtctggttacttacctaccgtttagacctaactatcgcctaagtgacgtcggtcgggtcccgaccgaggtacccgtcgggaagggggtacggggtcgtcggggtccgggttgggttacctaccttaacggttactttggcggtacgtacggttcgggtaacggttaaataggaaacgtaaccgtacggtacgtacgttactaccggtacgtaacggggtaccggtacccggttnaacctaccggttaacctcccggtaaccggaacgggtaaccttaaaccgttagaaacggttaccaaccggttaacgggttacctaccgttacgaaagttaacggtaactaaacgggcgttacggaagggtaacgtaacgggaaccgccgtaacggttacgttacgttagtttaacgcggttaccggaaccgttagtaccgttacgtaggggtaccggttacggggttattaccccgttaagtaacgttacggaacgtttacgtttacgggggttttacccttccggaacttaaccccg

SEQ ID NO: 111104 - DNA, 689 bp, Homo sapiens
  misc_feature: GYAE6OF02HC30Q.35.6.A06.1.454.CMB.1.raw
  modified_base (323)..(323): a, c, t, g, unknown or other
  misc_feature (323)..(323): n is a, c, g, or t
tcagtacagatcgtcacgaccggtgctcgatttagatctactgacagggggagtcagtctcagtcaggacacagcatggacatgagggtccccgctcagctcctggggctcctgctactctggctcgaggtgccagatgtgacatccagatgacccagtcctccactcctccctgtctgcatcgtggtaggagacagccgtcacctatctacgtcggccggactaagtcgaagagactaggttcggacttagtttactttaaacgttggtaactacgaaacggaaaccgtaacgggaaacctaccccttaaaacgtccgtaanacttacttaacgcgtcgacgacttacttcccttaagttttacgaacggtaaacgggttccgggggtacccgtaacgtaaccggttacgagggtacgtacgtaggtcggttacgtacgggaggaactaagtaacctcgtaccttaccgtctaaccgtactacgtacgtactaacgtcgtacgactaaccgtagttaacgttacgtttaccgaacttaaaccggtacttaacgtttacgaactaaaacggtgtaacgttaaccgacgttaccgacccgtacgtaacgctaaccggttcctaccgggaaccacggacgtacgtacggaggtaactaaagtaacgtgtcgacgcttagcctatacgttcg

SEQ ID NO: 111105 - DNA, 661 bp, Homo sapiens
  misc_feature: GYAE6OF02FTD1B.35.6.A06.1.454.CMB.1.raw
  modified_base (652)..(652): a, c, t, g, unknown or other
  misc_feature (652)..(652): n is a, c, g, or t
tcagtacagatcgtcacgaccggtgctcgatttagatctactgacagggaggatggagactgggacatccagatggacccagtctccatcctccctgtctgacatctgtaggagacacgcgtcaccatcactagccggacaagtcagagcattggcagtttcttaaattggtatcgaacggaaacgaggaaagcccctaaatctagattcgtttaagcgtcttacttgatagtcgggtaccatcgtaagttcaggcggctagtggaatcgtagggacagcctttcgactcgtcacacgtccacacgtcctgcacgtcgtaggtattgtaactttgaacccttaacttgttaaccgtaccaccgtaacagtttgtcggtacgttaccttcccggttacttacgttcccggacgttaacgaaccgttaaaggtcgtaaatcgttaaacccgaaacgttaagtgggtacgtaccgtacgtaccgaacctaacgttcttacggttaccttacggtccctttacccgttaccgccttaactacgtaacctacgtaccttacgtacggtacgtcgggtacggtcggtccgtacgggtaaccgtaaccggtccggagaacggttacgctacggtataaaccgagtatacgagccggaancgatgtacg

SEQ ID NO: 111106 - DNA, 700 bp, Homo sapiens
  misc_feature: GYAE6OF02F19Q6.35.6.A06.1.454.CMB.1.raw
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (390)..(390): a, c, t, g, unknown or other
  misc_feature (390)..(390): n is a, c, g, or t
tcagtacagatcgtcacgaccggtgctcgatttagatctactgacgagggggagtcagtctcagtcaggacacagcatggacatgagggtccccgctcagctccgtggggctcctgctactctggctccgaggtgccagatgtgacatccagatcgacccagtcctccatccctcctgtctgctatctaggtaggacgacagtcgtaccaccatcctacggttacggccggtacgaacgtcgaaggtacgctaagttcggactagttttacttttaaagttcggtaactaacgaaaacggaaccgaaggaaacctacccctaaatccgtagctactntgcgtancattcttagttacagtaaggtccgggacctagtaaggtcaagtcgngtagtagtactggacggataagtaacgttccacgttcctaaccagacgtacacgtacgtacgtacgtcgaacgtaacgtaacgtaaagttacgttttaaccgaaccgtttaaacgttaaccgttaccgttaacgtaccgtaaaacgacgttaaacgtaacgttaccgtacccgtaccggtacctaacgtcccgttacggttaccggacccggtaggaacccggttaacgaccggtaacgtagggtaaaccgttaaaggttaacccgttaaggttacgtacggtacctacggaccttaccgtacgttaccg

SEQ ID NO: 111107 - DNA, 785 bp, Homo sapiens
  misc_feature: GYAE6OF02IMG8Y.35.6.A06.1.454.CMB.1.raw
  modified_base (95)..(95): a, c, t, g, unknown or other
  misc_feature (95)..(95): n is a, c, g, or t
  modified_base (135)..(135): a, c, t, g, unknown or other
  misc_feature (135)..(135): n is a, c, g, or t
  modified_base (561)..(561): a, c, t, g, unknown or other
  misc_feature (561)..(561): n is a, c, g, or t
  modified_base (588)..(588): a, c, t, g, unknown or other
  misc_feature (588)..(588): n is a, c, g, or t
  modified_base (622)..(622): a, c, t, g, unknown or other
  misc_feature (622)..(622): n is a, c, g, or t
tcagtacagatcgtcacgaccggtgctcgatttagatctactgacaggggggagtcagtctcagtcaggacacagcatggacatgagggtccccnctcagctccgtggggctacctgctactctggctcgaggtnccagtatgtgacatccgagatcgacccgtagttcctacctacttccccttccttgttcctacgtacgtacttgtagggtaaggtaacgaacgacggtccggtaccaacccgtaactaccgtaaccgttcgggtacccggggtactaacgttacgaaggccgtaacgtaagttcggaacgttaagttttaaacgtttaaagttacggttaaacgaaccgtaaaaaccggtaaaccggaaacggtaaacccgtaacccgtaaacgttacctaggtaactacgttaagcgtaccgtactcgtactaccgttagttacgaacggttaacgggccgggtaccgtaggtacggtacgtgacgtagtacgtaggtacgtcggtaagggtatacgtaacttactaccgtactaaccgtaactagacgtaaccgngttaaccacgtagacgttacgacgttntacgtttaagtagtttccgaagtttacgtttaanacgtcgtaagtcctaaagttcgtaataacgtactttacccggttggtaccgttaacggttacggttcggtaaccggtacggtaaggaaacgggttaaccggcggtaaacccgttaagaacgttcgggtaacgtccgtaaaccggtgacccttacggttaaccg

SEQ ID NO: 111108 - DNA, 909 bp, Homo sapiens
  misc_feature: GYAE6OF02I1BA0.35.6.A06.1.454.CMB.1.raw
  modified_base (179)..(179): a, c, t, g, unknown or other
  misc_feature (179)..(179): n is a, c, g, or t
tcagtacagatcgtcacgaccggtgctcgatttagatctactgacaggggtctgagagaggagcccagccctgggattttcaggtgttttcatttggtgatcaggactgaacagagagaactcgaccatggagtttgggctggaggtggtcttttcttggtggctagttttaaaaggtntccaatgtgaagtcgcaccgtgttaggacgtctgggggagcttggtacgaggccggggggtccctggagtacctcttcccgtggtagcctacgcctcgtacggtacttacctacccgtttaagctaaacgttactgccgtattaggacgtcgtacgggttcccgacccgtacgggtacccgtccgggacggggggtaacggggcccgttcgggaccggtttcggggtacctaccgtaaaccgtttagttacggtcgttccgttaaggccggggtttaggtaaacgttagggaaacgtaccgttaacgaaccgtaggtacctaacgtcgtacggtaaacgggggtcccgttgaaaccgttcgtagttacccgtaacccgggtaacgggtaaaccttacccggttaaaccgtaaacggtaccgtaacgggttaacccgggttacgtaaccccgtttagaaaccgtaaacggttaggaaaacccgtccgggtaaacccgggtacggggtaaccggaaacggggttaaccgggaaccgtaacccggggttaccggtttaaacgttttaaccggggtttaaccttacggggttacgttacccgggtaaccgtacgttaccggttcggaaaccgggggttcccggggtaaccttcccggtttaaacgttaccgggtacttaacccggttaagttaaccggggtttttccggtttacgggtcccctttaaacccggg

SEQ ID NO: 111109 - DNA, 705 bp, Homo sapiens
  misc_feature: GYAE6OF02FYL5I.35.6.A06.1.454.CMB.1.raw
  modified_base (183)..(183): a, c, t, g, unknown or other
  misc_feature (183)..(183): n is a, c, g, or t
  modified_base (200)..(200): a, c, t, g, unknown or other
  misc_feature (200)..(200): n is a, c, g, or t
  modified_base (693)..(693): a, c, t, g, unknown or other
  misc_feature (693)..(693): n is a, c, g, or t
  modified_base (699)..(699): a, c, t, g, unknown or other
  misc_feature (699)..(699): n is a, c, g, or t
tcagtacagatcgtcacgaccggtgctcgatttagatctactgacagggaggatggagactgggacatccagatgacccagtctccatcctccctgtctgcatctgtaggagacagcgtcaccatcactgccggacagtcagagcatggctagttcttaaatggtatcaacggaaacaggaanccctaaatctgatctancgctgctatcctatttcgactaacggtgggtcccgataaggttcagtcggacagtagattcgagggacaagtacttcaactctaccgactacgtacacggtctaagtcgtcgaaccttaaacctgaaacgttactttaacgacctaaaccccgttatacgttacggtaccaaactaaggtaacgttaaccgaacggttaccgaccccggtaagacgttacgacgttcgtaaccggccgtaaagggacgtaaccggacgttaacggaagtaaacttaaaaggtaactacggtacgtacgtacgtacccgtaaccgtaacgttacgtcgttaaccgttacgtacctttaaccgtaccccgtacctaacgttacccgttaaggtaaaccgtacctttaacggttacccgtaagttaccggaacgggtaccgggtaccggttcgggaaccggtaaccgggtaccgtaccgtaaacggttaagcgtacggactacggntacgtntcgaac

SEQ ID NO: 111110 - DNA, 368 bp, Homo sapiens
  misc_feature: GYAE6OF01CGLHU.33.42.D09.1.454.CMB.1.raw
  modified_base (359)..(368): a, c, t, g, unknown or other
  misc_feature (359)..(368): n is a, c, g, or t
tcagtacacacactcacgaccggtgctcgatttagacacatacgcagggaaagggcagagtcaccatttcaagagacacatccgcgagcgaccatcctacatggagggtgaacgacctgagatctgaagacacggctctagtacttctgtgccgagggcccgagtcctcggtggccttcgaaccctggggccagggaaccctggtcaccgtctcctcagcctccaccaagggcccatcggtcttcccctggcaccctcctccaagagcacctctgggggcacagcggacccctggggactgacctggtcaaggactaacttccagtgtgtgtactgagcgggctggcaaggcgcatagnnnnnnnnnn

SEQ ID NO: 111111 - DNA, 353 bp, Homo sapiens
  misc_feature: GYAE6OF01CX7KM.33.42.D09.1.454.CMB.1.raw
  modified_base (346)..(353): a, c, t, g, unknown or other
  misc_feature (346)..(353): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccaccaagggcccatcggtcttcccctggcgccctgctccaggagcacctccgagagcacagcgccctgggctgcctggtcaaggactacttccagtgtgtgtactgagcgggctggcaaggcgcatagnnnnnnnn

SEQ ID NO: 111112 - DNA, 349 bp, Homo sapiens
  misc_feature: GYAE6OF01B1Z4N.33.42.D09.1.454.CMB.1.raw
  modified_base (345)..(349): a, c, t, g, unknown or other
  misc_feature (345)..(349): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctcaccaagggcccatcggtctcccctggcgccctgctccaggagcacctccgagagcacagcggccctgggctgcctggtcaaggactacttccagtgtgtgtactgagcgggctggcaaggcgcatagnnnnn

SEQ ID NO: 111113 - DNA, 371 bp, Homo sapiens
  misc_feature: GYAE6OF01COX8U.33.42.D09.1.454.CMB.1.raw
  modified_base (246)..(246): a, c, t, g, unknown or other
  misc_feature (246)..(246): n is a, c, g, or t
  modified_base (353)..(371): a, c, t, g, unknown or other
  misc_feature (353)..(371): n is a, c, g, or t
tcagtacacacactcacgaccggtgctcgatttagacacatacgcaggggaaagggcagagtcaccatttcaagagacacatccgcgagcacatcctacatggaggtgaacgacctgagatctgaagacacggctctgtacttctgtgcgagggcccgagtcctcggtggcttcgaacctggggccagggaaccctgggtcaccgtctcctcagcctccacgaacgggcccatcggtcttcccccnggccgcctcgcctccaggagcacctccgagagcacacgcggcctgggctgcctggtcaaggactacgttccagtcgtgtgtactgagcgggctggcaggcgcatagnnnnnnnnnnnnnnnnnnn

SEQ ID NO: 111114 - DNA, 359 bp, Homo sapiens
  misc_feature: GYAE6OF01BAAI3.33.42.D09.1.454.CMB.1.raw
  modified_base (345)..(345): a, c, t, g, unknown or other
  misc_feature (345)..(345): n is a, c, g, or t
  modified_base (350)..(359): a, c, t, g, unknown or other
  misc_feature (350)..(359): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctgggccagggaaccctggtcaccgtctcctcacgcctccaccaagggcccatccggtccttcccccgtggccgccctgcctccgaggacgccacctccgagagcacagcggccctgggctgcctggcaaggctactccagtgtgtgtactgagcggctggcaggcncatgnnnnnnnnnn

SEQ ID NO: 111115 - DNA, 351 bp, Homo sapiens
  misc_feature: GYAE6OF01AC82K.33.42.D09.1.454.CMB.1.raw
  modified_base (344)..(351): a, c, t, g, unknown or other
  misc_feature (344)..(351): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccaccaagggcccatcggtctcccctggcgccctgctccaggagcacctcgagagcacagcggccctgggctgcctggtcaaggctacttccagtgtgtgtactgagcgggctggcaaggcgcatagnnnnnnnn

SEQ ID NO: 111116 - DNA, 373 bp, Homo sapiens
  misc_feature: GYAE6OF01C9T68.33.42.D09.1.454.CMB.1.raw
  modified_base (362)..(373): a, c, t, g, unknown or other
  misc_feature (362)..(373): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaacccgtggggccagggaaccctggtcaccgtctcctcagcctccaccgaagggcccatcggtccttccccctggccacccctcctccaagacgccacctcgtgggggcacgaggccggccctgggcctgccgtggtcaaggactacttccagtgtgtgtactgagcgggctggcaaggcgcagtagnnnnnnnnnnnn

SEQ ID NO: 111117 - DNA, 383 bp, Homo sapiens
  misc_feature: GYAE6OF01AV7DA.33.42.D09.1.454.CMB.1.raw
  modified_base (379)..(383): a, c, t, g, unknown or other
  misc_feature (379)..(383): n is a, c, g, or t
tcagtacacacactcacgaccggtgctcgattttagacacatacgctaggggtaaagggggcgagagtcaccaatttctaaggagacacgatccgcgacggccacgatcctaccagtggaaggtgaacgtaccctgagatctgaagacgacgggctcgtgtacgttctgtagcggagggcccgagtcctcggtggcttcgaaccctggggccagggaaccctggtcatcgtctcctcagcctccaccgaacgggcccatcggtccttcccccctggccaccctcctccaagagcacctcgtggggcacgagcggcctgggctgcctggtcaaggctactccagtgtgtgtacgtgagcgggctggccaaggcgcatagnnnnn

SEQ ID NO: 111118 - DNA, 359 bp, Homo sapiens
  misc_feature: GYAE6OF01BN2WI.33.42.D09.1.454.CMB.1.raw
  modified_base (353)..(359): a, c, t, g, unknown or other
  misc_feature (353)..(359): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctgggccaagggacaagggtcaccgtctcttcagcctccaccaagggcccatccggtcttccccctggccaccctcctccaagacgcacctcgtgggggccacgagccggccctgggctgcctggtcaaggactactccagtgtgtgtactgagcggctggcaaggcgcagtagnnnnnnn

SEQ ID NO: 111119 - DNA, 437 bp, Homo sapiens
  misc_feature: GYAE6OF01EAW4E.33.42.D09.1.454.CMB.1.raw
  modified_base (405)..(406): a, c, t, g, unknown or other
  misc_feature (405)..(406): n is a, c, g, or t
  modified_base (409)..(437): a, c, t, g, unknown or other
  misc_feature (409)..(437): n is a, c, g, or t
tcagtacacacactcacgaccggtgctcgatttagacacatacgcagggaaagggcagagtcaccatttcaagagacacatccgcgagcacatcctacatggaggtgaacgacctgagatctggaagacacggctctgtacttctgtgcgagggcccgagtcctcggtgcttcgaacccgtggggccagggaccctggtcaccgtctcctcacgcctccaccgaagggccccagtccggtccttccccccgtggccacccctcctaccgaagacgccaccgtcgtcgggggccacgacggccggcccgtgggcctcgccgtcggtacaacggtacttaccgttccgtaggttcgtggtcgtacgtggacggtccgggtcgtagggacgaagggccgacgagtagnngannnnnnnnnnnnnnnnnnnnnnnnnnnnn

SEQ ID NO: 111120 - DNA, 481 bp, Homo sapiens
  misc_feature: GYAE6OF01BK0I0.33.42.D09.1.454.CMB.1.raw
  modified_base (420)..(421): a, c, t, g, unknown or other
  misc_feature (420)..(421): n is a, c, g, or t
  modified_base (424)..(424): a, c, t, g, unknown or other
  misc_feature (424)..(424): n is a, c, g, or t
  modified_base (427)..(481): a, c, t, g, unknown or other
  misc_feature (427)..(481): n is a, c, g, or t
tcagtacacacactcacgaccggtgctcgattttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaacccgtggggccagggaccctggtcaccgtctcctcagccctccaccgaacgggcccagtccggtcccttccccccgtgggccgtcccctgcctccgaggacgccacccgtccgagacgccaacgacggccggcccctggggcctcggccctggtaccgaaacggtaccttaccgtttccgagttcgtggttcgtaacgtggacggcgggtctacgggacaagggtccgacgtaagtacggtgnncgntgnnnnnnnnnnnnnnnnnnnnnnnnnnnnnnnnnnnnnnnnnnnnnnnnnnnnnnn

SEQ ID NO: 111121 - DNA, 463 bp, Homo sapiens
  misc_feature: GYAE6OF01B7LBL.33.42.D09.1.454.CMB.1.raw
  modified_base (427)..(427): a, c, t, g, unknown or other
  misc_feature (427)..(427): n is a, c, g, or t
  modified_base (430)..(463): a, c, t, g, unknown or other
  misc_feature (430)..(463): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaacccgtggggccagggaaccctggtccaccgtctcctcacgccctccaccgaacgggccccagtccggtcccttccccccgtggcccgcccctgcctcccgaggacgccacccgtccgagacgccacgacggccggcccgtgggcctcgcccgtgggtaccgaaggtaccttaccgttccgaggttcggttcgttaggttaaccgtgggacgggccggggtcgtcgggaccgaagggccgacgtaagtaggnagnnnnnnnnnnnnnnnnnnnnnnnnnnnnnnnnnn

SEQ ID NO: 111122 - DNA, 585 bp, Homo sapiens
  misc_feature: GYAE6OF01A785U.33.42.D09.1.454.CMB.1.raw
  modified_base (117)..(117): a, c, t, g, unknown or other
  misc_feature (117)..(117): n is a, c, g, or t
  modified_base (206)..(206): a, c, t, g, unknown or other
  misc_feature (206)..(206): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (435)..(436): a, c, t, g, unknown or other
  misc_feature (435)..(436): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
  modified_base (548)..(548): a, c, t, g, unknown or other
  misc_feature (548)..(548): n is a, c, g, or t
tcagtacacacactcacgaccggtgctcgatttagacacatacgcagggaaaggcagacgtcaccatttcaagagacacatccgcgagcacatcctacatggaggtgaacgacctgngatctgagacacggctctgtacttctgtgcgagggcccgagtcctcggtggcttcgaaccctggggcagggacctggtcaccgtctctnaggcctccacaagggccatcggtccttccccgtggccgcctgcctccaggacgctaccgtccgagcgcacgagaccggccctagggggcctcgtccgtcgggtaccaaacggtccttaccgttcccaaggttcgtcgttcgtaccttagggacggaccggggtcgtacgggcgtaaacgggccgtacgaacgttacggctgtgcgtaggntaacgngtacgactncncnncgagagacgtacgtacacgtanananagcgtactactactacgtacacactatacgtacgtacctacgtacgtacgtacgcgacgacgacgacgtagtacgtagtacgtagngtagcgacgtacgactacgtacgtatcgtctacgtcg

SEQ ID NO: 111123 - DNA, 436 bp, Homo sapiens
  misc_feature: GYAE6OF01EFHA5.33.42.D09.1.454.CMB.1.raw
  modified_base (172)..(172): a, c, t, g, unknown or other
  misc_feature (172)..(172): n is a, c, g, or t
  modified_base (252)..(252): a, c, t, g, unknown or other
  misc_feature (252)..(252): n is a, c, g, or t
  modified_base (276)..(276): a, c, t, g, unknown or other
  misc_feature (276)..(276): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
  modified_base (377)..(379): a, c, t, g, unknown or other
  misc_feature (377)..(379): n is a, c, g, or t
  modified_base (381)..(381): a, c, t, g, unknown or other
  misc_feature (381)..(381): n is a, c, g, or t
  modified_base (386)..(387): a, c, t, g, unknown or other
  misc_feature (386)..(387): n is a, c, g, or t
  modified_base (390)..(391): a, c, t, g, unknown or other
  misc_feature (390)..(391): n is a, c, g, or t
  modified_base (393)..(436): a, c, t, g, unknown or other
  misc_feature (393)..(436): n is a, c, g, or t
tcagtacacacactcacgaccggtgctcgatttagacacatacgcagggaaagggcagagtcaccatttcaagagacacatccgcgagcacatcctacatggaggtgaaccgacctgagatcctaggaagacgacggctctagtacttctgtgcgagggcccgatccgtggngcttcgaaccgtggcagggaccctggtcaccgtctcctcacgccctaccaaccgacgggcccagttccgtcccttccccnggcctcccgtgtcctaccgaggcncctaccgcgagacgcacgcgccgccgtcggctcgtcgtacgctacgtcctctccgagtgtcgtntacgnggacggtcggngacggacgacggcanagagcnnnancagtnnacnncnnnnnnnnnnnnnnnnnnnnnnnnnnnnnnnnnnnnnnnnnnnn

SEQ ID NO: 111124 - DNA, 352 bp, Homo sapiens
  misc_feature: GYAE6OF02F6UFS.33.42.D09.1.454.CMB.1.raw
  modified_base (347)..(352): a, c, t, g, unknown or other
  misc_feature (347)..(352): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccaccaagggcccatcggtcttcccctggcgccctgctccaggagcacctccgagagcacagcggccctgggctgcctggtcaaggactacttccagtgtgtgtactgagcgggctggcaaggcgcatagnnnnnn

SEQ ID NO: 111125 - DNA, 353 bp, Homo sapiens
  misc_feature: GYAE6OF02GZKJ1.33.42.D09.1.454.CMB.1.raw
  modified_base (347)..(353): a, c, t, g, unknown or other
  misc_feature (347)..(353): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccaccaagggcccatcggtcttcccctggcgccctgctccaggagcacctccgagagcacagcggccctgggctgcctggtcaaggactacttccagtgtgtgtactgagcgggctggcaaggcgcatagnnnnnnn

SEQ ID NO: 111126 - DNA, 351 bp, Homo sapiens
  misc_feature: GYAE6OF02GPZR3.33.42.D09.1.454.CMB.1.raw
  modified_base (345)..(351): a, c, t, g, unknown or other
  misc_feature (345)..(351): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccaccaagggcccatcggtcttcccctggcaccctcctccaagagcacctctggggcacagcggcctgggctgcctggtcaaggactacttccagtgtgtgtactgagcgggctggcaaggcgcatagnnnnnnn

SEQ ID NO: 111127 - DNA, 352 bp, Homo sapiens
  misc_feature: GYAE6OF02HG4EQ.33.42.D09.1.454.CMB.1.raw
  modified_base (346)..(352): a, c, t, g, unknown or other
  misc_feature (346)..(352): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccaccaagggcccatcggtcttcccctggcgccctgctccaggagcacctccgagagcacagcggccctgggctgcctggtcaaggctacttccagtgtgtgtactgagcgggctggcaaggcgcatagnnnnnnn

SEQ ID NO: 111128 - DNA, 355 bp, Homo sapiens
  misc_feature: GYAE6OF02F9VBL.33.42.D09.1.454.CMB.1.raw
  modified_base (348)..(355): a, c, t, g, unknown or other
  misc_feature (348)..(355): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccaccaagggcccatcggtcttccccctggcgccctgctccaggagcacctccgagagcacagcggccctgggctgcctggtcaaggactacttccagtgtgtgtactgagcgggctggcaaggcgcatagnnnnnnnn

SEQ ID NO: 111129 - DNA, 355 bp, Homo sapiens
  misc_feature: GYAE6OF02GEG4F.33.42.D09.1.454.CMB.1.raw
  modified_base (349)..(355): a, c, t, g, unknown or other
  misc_feature (349)..(355): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccaccaagggcccatcggtcttccccctggcgccctgcctccaggagcacctctgggggcacagcggccctgggctgcctggtcaaggactacttccagtgtgtgtactgagcgggctggcaaggcgcatagnnnnnnn

SEQ ID NO: 111130 - DNA, 354 bp, Homo sapiens
  misc_feature: GYAE6OF02GZKQ3.33.42.D09.1.454.CMB.1.raw
  modified_base (348)..(354): a, c, t, g, unknown or other
  misc_feature (348)..(354): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccaccaagggcccatcggtcttccccctggcgccctgctccaggagcacctccgagagcacagcggccctgggctgcctggtcaaggactacttccagtgtgtgtactgagcgggctggcaaggcgcatagnnnnnnn

SEQ ID NO: 111131 - DNA, 353 bp, Homo sapiens
  misc_feature: GYAE6OF02F17SI.33.42.D09.1.454.CMB.1.raw
  modified_base (348)..(353): a, c, t, g, unknown or other
  misc_feature (348)..(353): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccaccaagggcccatcggtcttccccctggcgccctgctccaggagcacctccgagagcacagcggccctgggctgcctggtcaaggactacttccagtgtgtgtactgagcgggctggcaaggcgcatagnnnnnn

SEQ ID NO: 111132 - DNA, 393 bp, Homo sapiens
  misc_feature: GYAE6OF02GPNEQ.33.42.D09.1.454.CMB.1.raw
  modified_base (363)..(393): a, c, t, g, unknown or other
  misc_feature (363)..(393): n is a, c, g, or t
tcagtacacacactcacgaccggtgctcgatttagacacatacgcaggggtaaagggggcagagtcaccatttcaagagacacatcgcgagcacatcctacattggaggtgaacgacctgagatcctgaagacacggctctgtacttctgtgcgagggcccgagtcctcggtggcttcgaaccctggggccagggaccctggtcaccgtctcctcagcctccaccaagggcccatcggtacttccccctggcaccctcctccaagacgcaacctctagggggacacgagcggcccctcggggcctcgcctggtcaaggactacttccagtgtgtgtactgagcgggctggcaaggcgcatagnnnnnnnnnnnnnnnnnnnnnnnnnnnnnnn

SEQ ID NO: 111133 - DNA, 355 bp, Homo sapiens
  misc_feature: GYAE6OF02G6R6G.33.42.D09.1.454.CMB.1.raw
  modified_base (347)..(355): a, c, t, g, unknown or other
  misc_feature (347)..(355): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccaccaagggcccatcggtcttccccctggcgccctgctccaggagcacctccgagagcacagcggccctgggctgcctggtcaaggctacttccagtgtgtgtactgagcgggctggcaaggcgcatagnnnnnnnnn

SEQ ID NO: 111134 - DNA, 374 bp, Homo sapiens
  misc_feature: GYAE6OF02HZM3M.33.42.D09.1.454.CMB.1.raw
  modified_base (361)..(374): a, c, t, g, unknown or other
  misc_feature (361)..(374): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctggtggcttcgaaccctggggccagggaaccctggtccaccgtctcctcagcctccaccaagggccccatccggtccttccccctggccgccctgcctccaggacgccacctccgagagccacacgcggccctgggctgcccgtggtacaaggacctacttccagtgtgtgtactgagcgggctggcaaggcgcatagnnnnnnnnnnnnnn

SEQ ID NO: 111135 - DNA, 352 bp, Homo sapiens
  misc_feature: GYAE6OF02HDM2U.33.42.D09.1.454.CMB.1.raw
  modified_base (262)..(262): a, c, t, g, unknown or other
  misc_feature (262)..(262): n is a, c, g, or t
  modified_base (273)..(273): a, c, t, g, unknown or other
  misc_feature (273)..(273): n is a, c, g, or t
  modified_base (341)..(341): a, c, t, g, unknown or other
  misc_feature (341)..(341): n is a, c, g, or t
  modified_base (347)..(352): a, c, t, g, unknown or other
  misc_feature (347)..(352): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccaccaagggcccatcggtcttccccctggcgccctgctccaggancacctccgagngcacagcggccctgggctgcctggtcaaggactacttccagtgtgtgtactgagcgggctggcaggcncatagnnnnnn

SEQ ID NO: 111136 - DNA, 357 bp, Homo sapiens
  misc_feature: GYAE6OF02HL1GG.33.42.D09.1.454.CMB.1.raw
  modified_base (341)..(341): a, c, t, g, unknown or other
  misc_feature (341)..(341): n is a, c, g, or t
  modified_base (347)..(357): a, c, t, g, unknown or other
  misc_feature (347)..(357): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccaccaagggcccatcggtctccccctggccgccctgctccaggagcacctccgagagcacagccggccctgggctgcctggtcaaggactacttcagtgtgtgtactgagcgggctggcaggcncatagnnnnnnnnnnn

SEQ ID NO: 111137 - DNA, 370 bp, Homo sapiens
  misc_feature: GYAE6OF02ITOEO.33.42.D09.1.454.CMB.1.raw
  modified_base (363)..(370): a, c, t, g, unknown or other
  misc_feature (363)..(370): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccaccaacgggcccatccggtccttcccccgtggccgcccctgcctccgaggacgccacctccgagacgccacacgcggccctgggctcgcctggtcaaggactacttccagtgtgtgtactggaggcgggctggcaaggcgcatgnnnnnnnn

SEQ ID NO: 111138 - DNA, 441 bp, Homo sapiens
  misc_feature: GYAE6OF02I9S81.33.42.D09.1.454.CMB.1.raw
  modified_base (422)..(422): a, c, t, g, unknown or other
  misc_feature (422)..(422): n is a, c, g, or t
  modified_base (424)..(441): a, c, t, g, unknown or other
  misc_feature (424)..(441): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctgggccagggaaccctggtcaccgtctcctcacgcctccaccaacgggcccatccggtccttcccccgtggcccgtcccctggcctcccaggacgccaaccctcccgagacgccaacacggccggcccgtcgggccgtcggcccgtgggttaccgaaaggggaccttacccgttcccgtacggtcggttcgtggttaacctggtacggccggggcgtcgggcgtaagggccggcaagtaggcngnnnnnnnnnnnnnnnnnn

SEQ ID NO: 111139 - DNA, 363 bp, Homo sapiens
  misc_feature: GYAE6OF02FRV7Q.33.42.D09.1.454.CMB.1.raw
  modified_base (351)..(363): a, c, t, g, unknown or other
  misc_feature (351)..(363): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccaccaagggcccatcggtcttccccctggccgccctgcctccaggagcacctccgagagcacagcggccctgggctgcctggtcaaggctacttccagtgtgtgtactgagcgggctggcaagggcgcagtagnnnnnnnnnnnnn

SEQ ID NO: 111140 - DNA, 371 bp, Homo sapiens
  misc_feature: GYAE6OF02FPIGN.33.42.D09.1.454.CMB.1.raw
  modified_base (361)..(371): a, c, t, g, unknown or other
  misc_feature (361)..(371): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaccctggggccagggaccctggtcaccgtctcctcagcctccaccaagggccccatcggtcttccccctggccgccctgcctccaggagccacctccgagacgcacagccggcccctgggctcgcctgggtaccaaggacctacttccgagttgtgtgtacctggagcgggctggcagggcgcatgnnnnnnnnnnn

SEQ ID NO: 111141 - DNA, 358 bp, Homo sapiens
  misc_feature: GYAE6OF02IEF34.33.42.D09.1.454.CMB.1.raw
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (344)..(358): a, c, t, g, unknown or other
  misc_feature (344)..(358): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtcaccgtctcctcagcctccacaaggcccatcggtctcccctgcgccctgctcaggngcacctccganagcanacgcgcccgtggctgccgtggtcaaggctacttccagtgtgtgtactgacggcgggctaggcaggcgcatagnnnnnnnnnnnnnnn

SEQ ID NO: 111142 - DNA, 427 bp, Homo sapiens
  misc_feature: GYAE6OF02IYT1Q.33.42.D09.1.454.CMB.1.raw
  modified_base (213)..(213): a, c, t, g, unknown or other
  misc_feature (213)..(213): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (396)..(427): a, c, t, g, unknown or other
  misc_feature (396)..(427): n is a, c, g, or t
tcagtacacacactcacgaccggtgctcgatttagacacatacgcagggaaagggcagagtcaccatttcaagagacacatccgcgagcacatcctacatggaggtgaacgacctgagatctggaagacacggctctgtacttctgtgcgagggcccgagtccgtcggtggcttcgaacccgtggggccagggaccctggtcaccgtctcctnagcctccaccaagggcccagtcggtccttcccccgtggccgccctgctccgaggcacctacctccggagacgcacaggcccggacccgttgggcctggccctgggtacaacgggaccttacgttcccaaggttcgttgtagtacgtagcggtcgggctcggtacgaggcgcaacgtagncngnnnnnnnnnnnnnnnnnnnnnnnnnnnnnnnn

SEQ ID NO: 111143 - DNA, 441 bp, Homo sapiens
  misc_feature: GYAE6OF02HNL89.33.42.D09.1.454.CMB.1.raw
  modified_base (402)..(441): a, c, t, g, unknown or other
  misc_feature (402)..(441): n is a, c, g, or t
tcagtacacacactcacgaccggtgctcgatttagacacatacgcaggggaaagggcagagtcaccatttcaagagacacatccgcgagcacatcctacatggaggtgaacgacctgagatctgaagacacggctctgtacttctgtgcgagggcccgagtcctcggtggcttcgaaccctgggccaggaccctggtcaccgtctcctcacgccctccgaccaacggggccccagttccggttcccttcccccccgtgggcccgtccccgtcgcctcccgaggacgcctacccgtccgagacgacaccagccggccctggggctcgccgtggtaccaaggacctacgttccaaggttgtgtaggtactggaggcgggctgggactaacgggcaccaagtgcnnnnnnnnnnnnnnnnnnnnnnnnnnnnnnnnnnnnnnnn

SEQ ID NO: 111144 - DNA, 459 bp, Homo sapiens
  misc_feature: GYAE6OF02I2CU2.33.42.D09.1.454.CMB.1.raw
  modified_base (260)..(260): a, c, t, g, unknown or other
  misc_feature (260)..(260): n is a, c, g, or t
  modified_base (420)..(422): a, c, t, g, unknown or other
  misc_feature (420)..(422): n is a, c, g, or t
  modified_base (424)..(425): a, c, t, g, unknown or other
  misc_feature (424)..(425): n is a, c, g, or t
  modified_base (427)..(459): a, c, t, g, unknown or other
  misc_feature (427)..(459): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaacccgtggggccagggaaccctggtccaccgtctcctcacgccctccaccaacgggccccatccggttccttcccccgtggcccncccctcgcctccgaggacgccacccgtccgagacgccacacggccggtccccgtgggccttcggccgtggtacccgaacggacttaccgttcccgaggttcggtgtcggtacctggacggccgggtcgtgggaccgtaacggggccgacaagtaggcagnnngnngnnnnnnnnnnnnnnnnnnnnnnnnnnnnnnnnn

SEQ ID NO: 111145 - DNA, 400 bp, Homo sapiens
  misc_feature: GYAE6OF02F7QGX.33.42.D09.1.454.CMB.1.raw
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (278)..(278): a, c, t, g, unknown or other
  misc_feature (278)..(278): n is a, c, g, or t
  modified_base (362)..(400): a, c, t, g, unknown or other
  misc_feature (362)..(400): n is a, c, g, or t
tcagtacacacactcacgaccggtgctcgatttagacacatacgcagggaaagggcagagtcaccatttcaagagacacatccgcgagcacatcctacatggaggtgaacgacctgagatctgaagacacggctctgtacttctgtgcgagggcccgagtcctcggtggcttcgaaccctggggccagggaaccctggtccaccgtctcctcagcctccaccaagggcccatcggtcttccccngccgccctgcnccaggancacctcgagagcacgngccgcccgtgggctcgccgtggtacaacggacctacttccgagtgtgtgtacgtgaggcggtctggctaacggcgacacgtgcnnnnnnnnnnnnnnnnnnnnnnnnnnnnnnnnnnnnnnn

SEQ ID NO: 111146 - DNA, 529 bp, Homo sapiens
  misc_feature: GYAE6OF01BZ83W.52.6.A06.1.454.CMB.1.raw
  modified_base (515)..(515): a, c, t, g, unknown or other
  misc_feature (515)..(515): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaacgtccccaaactcatgatctttgaggtcagtgatcggcccgctagggtttctcatcgcttctccggctccaagtctggcagcacggcctccctgaccatctctgggctccgaggctggaggacgaggctgattattactgcagtctcatataacagacaagaaactacgttgggtgtcgggcggacgggaccaaagtcgacccgtcgtacgtcacggcccgaaggctcgccccgtcgcnctcgtcgttccccg

SEQ ID NO: 111147 - DNA, 533 bp, Homo sapiens
  misc_feature: GYAE6OF01C3DF3.52.6.A06.1.454.CMB.1.raw
  modified_base (315)..(315): a, c, t, g, unknown or other
  misc_feature (315)..(315): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaccagcaatgacattggtacttataattctgtctcctggtaccaacaataccccggcaaagtccccaaactcatgatctttgaggtcagtgatcggccgnagggtttctcatcgcttctccggctccaagtctggcagcacggcctccctgaccatctctgggctccaggctgaggacgaggctgattattacgtgcagctcatataacaagacaagaaactacgttgggtgtttcgggcggtacgggacctaaacgtcgaccgtccgtacgtacacgcccaaggcctcgtcccccctggtccactcctcgttacccc

SEQ ID NO: 111148 - DNA, 532 bp, Homo sapiens
  misc_feature: GYAE6OF01C0XTG.52.6.A06.1.454.CMB.1.raw
  modified_base (390)..(390): a, c, t, g, unknown or other
  misc_feature (390)..(390): n is a, c, g, or t
  modified_base (429)..(429): a, c, t, g, unknown or other
  misc_feature (429)..(429): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctggcccagtctgccctgactcagcctgcctccgtgtctgggtctcctggacagtcgatcaccatctcctgcaccggaccagcaatgacattggtacttataattctgtctcctggtaccaacaatacccggcaaagtccccaaactcatgatctttgaggtcagtgatcggccgcaggggtttctcatcgcttctccggctccaagtctggcagcacggcctcctgccatctctgggctcaggctgagacgngctgattattatgcagctcatatacaagcaacgtaaacncgttagggtcggtttccggcgggtacgggaccctaaaacgtcgacccgtccgtacgtcacgcccaaggctacgtccccctacgtcaactccgttgttcccccg

SEQ ID NO: 111149 - DNA, 548 bp, Homo sapiens
  misc_feature: GYAE6OF01DKLI5.52.6.A06.1.454.CMB.1.raw
  modified_base (430)..(430): a, c, t, g, unknown or other
  misc_feature (430)..(430): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctcctgcaccggaaccagcaatgacattggtacttataattctgtctcctggtaccaacaatacccggcaaagtccccaaactcatgatctttgaggtcagtgatcggccgcaggggtttctcatcgcttctccggctccaagtctggcagcacggcctccctgaccatctctgggctccaggctgaggacgagctgattatctgcagctcatacacaaacagaaacncgttgggtgttcgggccggcgggaaccaaacgtcgacccgttccgttcgtaccgacgccccgtaaaggcccgtcgccccccgtcgggtacctacgttcctccgttcccctaacccccg
